United States Patent 11,542,490 (RNAS FOR WOUND HEALING) - sequence listing, part 2

SEQ ID NO: 1855 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt5)
gggagaaagcuuaccaugaagugggugaccuucaucagccugcucuuucuguucuccucugccuacagcaugaaaaagaacauucuuaaaauccugauggacuccuauucuaaggagagcaaaauucagacagucagacggguuacguccgugucucuccuggcuguguaccuuaccaugaauacaagcucccugguccucgccaagcccaucgaaaacaccaaugauacaagcauuaagaacguggagaaacugcgcaaugcgccuaacgaagaaaauucuaagaaaguugaagacuccaagaacgauaaaguggagcacgucaagaauaucgaggaagcuaagguggagcaaguugccccggaagugaaaagcaagucuacccugagauccgccagccggcgcagacggaaacgcaucgcuaacacaaauucugagaaguaugacuuugaguaccucaacggccuguccuauaccgaacuuacgaaucugauuaaaaacaucaaguggaaucagauuaacggacucuucaacuacagcaccggaucccagaaauuuuucggcgauaagaauagaguccaggccaucauuaacgcucugcaagagucugggcggacauauaccgccaaugacaugaagggaaucgaaacauuuaccgaggugcuucgcgcgggcuucuaccugggguacuauaacgauggacucagcuaccugaaugacagaaacuuucaggauaaaugcauucccgccaugaucgcuauccagaagaauccuaacuucaaacugggcacggccgugcaggacgaagucauuacaucccucggcaagcugaucgggaaugcuagcgccaacgcggagguugugaauaacugugugcccguccuuaaacaauuucgggagaaucugaaccaguaugccccugauuacgugaagggaaccgcuguuaaugaacucauuaagggcaucgaguucgacuuuucuggggccgcuuaugaaaaagaugugaagacaaugcccugguacggaaaaauugacccuuucaucaacgagcugaaggcccuuggccuguaugggaacaucaccuccgccaccgaaugggcuagcgacgucggaauuuacuaccucucuaaauucggccuguauagcacaaaucgcaacgauaucgugcagucccuggagaaggcgguugacauguacaaguauggcaaaauugccuuuguggcuauggagagaaucacgugggauuacgacgggauuggaucuaauggcaagaaagucgaucaugacaaguuccucgaugacgccgaaaaacacuaucugccgaagaccuacacauuugauaacgggaccuucaucauccgggccggagacaaggugagcgaggaaaagauuaagcgccuuuauugggcuuccagagaggucaaaagccaguuucaucgggugguuggcaaugauaaggcccuggaaguggggaacgcggacgacguccucacaaugaaaaucuucaauucucccgaggaguacaaguuuaacaccaauauuaacggaguguccacggauaauggcggccuguacaucgaaccuagagggacauucuauaccuacgagcgcacaccccaacagagcauuuuuagccuugaggagcuguuccggcacgaguauacccauuaccuccaggcuagauaucugguugacggacuguggggccaagggccuuuuuacgagaaaaaccgccucaccugguucgaugaaggaacagccgaauuuuucgccggcuccacgcggaccagcggggugcugcccagaaaguccauccuuggcuaucuggcuaaggacaaagucgaucaccgcuacucucucaagaaaacacugaauagcggauacgacgauuccgacuggauguucuauaacuacggcuuugccguggcucacuaucuguacgagaaggauaugccgaccuucauuaaaaugaauaaggccauccuuaacacagacgugaagucuuaugaugaaaucauuaaaaagcucagcgacgaugcgaacaaaaauaccgaguaccagaaccauauccaggagcuggccgacaaguaucagggggcugggauuccucugguuuccgacgauuaccucaaagaccacggcuacaagaaggccagcgaagucuauucugagaucuccaaagcugccagccugacgaauaccucugugacagcggaaaagucccaauacuuuaacaccuucacacuucgggggaccuauacgggagagacaagcaaaggcgaauuuaaggauugggacgagaugucuaaaaagcuggaugggacccucgagagccuggccaaaaauuccuggagcggcuacaaaacacugaccgcuuauuucaccaacuacagagugacaucugacaauaagguccaguaugaugugguuuuucauggagugcuuacggacaacgccgauauuuccaauaacaaagcucccaucgccaaggucaccggcccuagcacaggggccgugggacgcaauaucgaguucuccggcaaagacucuaaggaugaagacgggaaaauuguuagcuacgauugggacuuuggagacggcgcuaccucccgggggaagaacucugugcacgcguacaagaaagccggcacauauaaugucacccucaaggugacggaugacaaaggagcuacagccaccgaaucuuucaccaucgagauuaagaacgaagauacaaccacacccaucacgaaagagauggagcccaaugacgauauuaaggaagccaacggcccuaucguugagggggugaccgucaagggagaccugaacggcuccgaugacgcugauacauuuuacuucgacgugaaagaagauggggacgugaccaucgagcugccguauucuggaagcuccaauuuuacauggcucgucuacaaggagggcgacgaucagaaccacauugccagcgggaucgacaaaaauaacucuaagguuggcaccuucaaauccacgaagggaagacauuauguguucauuuacaagcacgauagcgcgucuaauaucuccuauagccugaacauuaaaggccuugggaaugaaaagcugaaagagaaggaaaacaaugacucuuccgauaaagcuaccgugauccccaacuuuaauacaaccaugcagggaagccuccugggcgacgauucccgcgacuacuacagcuucgaggucaaggaagagggggaggugaacaucgaacuggauaagaaagacgaguuuggaguuacauggacccuucauccugaaucuaauauuaacgaucggaucacauauggccaaguggacggcaauaaggucagcaacaaagugaagcucagacccgggaaauacuaucugcugguuuacaaguauuccggaucuggcaauuacgagcuccgggugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1856 - RNA, 3322 nt, Artificial Sequence
  mRNA product Design1 comprising derived and/or modified sequence from Clostridium histolyticum__BAA34542.1__ColH (opt5)
gggagaaagcuuaccaugaacuuccugaagaucauucucaauagaggcaaaaccaugaagcggaaaugccugagcaagcgccuuaugcuggccaucacaauggcuacgauuuuuaccgugaacuccacacuccccaucuacgccgcggucgacaaaaauaacgcuaccgccgccguucagaaugagucuaagagauauacagugagcuaccugaagacccuuaacuauuacgaucugguggaccuccuggucaaaacagaaauugagaaucugccugaucucuuccaauauuccucugacgcuaaggaauuuuacgggaacaaaacccggaugagcuucaucauggaugagaucggacgcagagccccgcaguauacggaaauugaccacaagggcauccccacccugguggagguugugcgggcuggguuuuaccuuggauuccauaauaaagagcugaacgaaauuaauaagcgcuccuuuaaggagagagucaucccuucuauucucgccauccagaaaaaccccaauuucaagcugggcacagaagugcaggauaaaauuguuagcgcgaccgggcuucuggccggaaacgagacagcuccucccgagguggucaauaacuuuaccccuauccuccaagacuguaucaagaacauugaucgguacgcccuggacgaucugaaauccaaggcucucuucaaugugcuggccgcgccgacguaugacaucacagaauaccuucgcgccaccaaagagaagcccgaaaacacaccuugguauggcaagauugauggcuuuaucaaugagcugaaaaagcucgcucuguacgggaaaauuaacgacaauaacagcuggaucaucgacaauggaauuuaucacaucgcuccccuuggcaagcugcauucuaacaauaaaauugggaucgaaacccucaccgaggugaugaaggucuacccuuaucuguccaugcagcaccuucagagcgccgaucagauuaagagacauuacgacucuaaagaugccgagggaaacaagaucccccucgacaaauucaagaaagaaggcaaggagaaguacugcccgaaaacauauacguuugaugacgggaagguuaucauuaaagccggagcucggguggaagaggaaaaggugaaacgccuguacugggcguccaaggaggucaauagccaauucuucagaguguauggcaucgauaagccucuugaggaaggcaaccccgacgauauucugaccaugguuaucuacaauucuccugaggaauauaaacucaacuccgugcuguacggguaugacacaaauaacggaggcauguacauugagcccgaagggaccuuuuucacauacgagcgggaggcccaggaaagcaccuauacgcuugaggaacuguuucgccacgaguacacacacuaucuccagggaagauacgcuguccccggccagugggggcggaccaagcuguaugauaacgacagacugaccugguacgaggaaggaggcgccgaacucuucgccggcuccacacgcaccucugggauccugccucggaaaagcauuguguccaauauccauaacacaacgagaaauaaccgcuauaagcugagcgacaccguucacucuaaauacggagcuuccuuugaguucuacaauuaugccuguauguuuauggauuacauguauaacaaggacaugggcauccugaauaaacucaacgaucuggcgaagaauaacgacguggauggguacgacaauuauauucgggaucugagcucuaacuacgcucuuaaugacaaguaucaagaucauaugcaggagagaaucgacaacuacgaaaaucucacagucccguucguggccgaugacuaccugguccgccacgccuauaaaaaccccaacgagauuuacagcgagaucuccgaaguggcuaagcugaaagaugccaagucugagguuaaaaagagccaguauuuuuccaccuucacacuccggggaagcuacaccggcggggcuucuaagggcaaacuggaagaccaaaaggccaugaauaaauuuauugacgauucccuuaagaaacuggacacguauagcuggucuggauacaagacccucacagcguauuucaccaacuacaagguggauuccagcaauagagucacauacgacgugguuuuucacggcuaucugccuaacgagggggauuccaaaaauucucugcccuacggaaagaucaacggcaccuauaaagggacggaaaaggagaaaaucaaguucagcuccgagggaucuuucgacccugauggcaagauugugagcuacgaaugggacuuuggggauggcaauaaauccaacgaggaaaaucccgagcauagcuaugacaaggucggaacauacaccgugaaacuuaaggugacagaugacaaaggcgaaucuuccguuagcaccaccacagccgagaucaaggaucucucugagaacaaacugccggucauuuauaugcacgugccuaaguccggggcucugaaucagaagguggucuucuacggaaaaggcacguacgaccccgacgggagcaucgccggauaucagugggauuuuggcgacgggucugauuucagcuccgaacagaacccuagccauguguacaccaagaaaggcgaguauacaguuacccuccgcgugauggacucuuccggacaaaugagcgaaaagacaaugaaaauuaagaucaccgaucccgucuacccuaucggcacggagaaggagcccaauaacuccaaagaaacagcuucugggccgauugugccuggaauccccguuagcggcaccauugagaauaccuccgaccaggauuauuuuuacuucgacgugaucacacccggggaagucaagauugauaucaacaaacugggauauggcggggccaccugggugguuuacgacgagaacaauaacgcggugucuuacgccacagaugacggccagaaucuuagcggaaaguuuaaagcugacaagccuggccgguauuacauccaccuguauauguucaacggguccuacaugccguauagaauuaauaucgaaggaucugucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1857 - RNA, 3283 nt, Artificial Sequence
  mRNA product Design1 comprising derived and/or modified sequence from Clostridium histolyticum__BAA34542.1__ColH (opt5)
gggagaaagcuuaccaugaagagaaaaugccugagcaagcggcucaugcuggccaucaccauggcuacaauuuucacggugaacuccacccuucccaucuacgccgcggucgacaaaaauaacgcuacagccgccguucagaaugagucuaagcgcuauaccgugagcuaccugaaaacacucaacuauuacgaucugguggaccuucuggucaagaccgaaauugagaaucucccugaucuguuucaauauuccucugacgcuaaggaguucuacggcaacaaaacaagaaugagcuuuaucauggaugaaauugggcggcgcgccccgcaguauaccgaaaucgaccacaagggaauccccacgcugguggagguugugagagcuggcuucuaccucggguuucauaauaaagagcugaacgaaauuaauaagcgguccuucaaagagcgcgucaucccuucuauucuugccauccagaagaaccccaauuuuaagcugggaaccgaagugcaggauaaaauuguuagcgcgacaggccuccuggccgggaacgagaccgcuccucccgagguggucaauaacuucacaccuauccuucaagacuguauuaagaauaucgauagauacgcccuggacgaucucaaauccaaggcucuguuuaacgugcuggccgcgccgaccuaugacaucacggaauaccuccgggccacaaaagagaagcccgaaaacaccccuugguauggaaaaauugauggcuucaucaaugagcugaagaaacuugcucuguacggcaagauuaacgacaauaacagcuggaucauugacaaugggaucuaucacaucgcuccccucggaaagcugcauucuaacaauaaaauuggcaucgaaacacuuaccgaggugaugaaggucuacccuuaucuguccaugcagcaccuccagagcgccgaucagauuaaacgccauuacgacucuaaggaugccgaggggaacaagaucccccuggacaaauuuaagaaagaaggaaaggagaaauacugcccgaagaccuauacauucgaugacggcaagguuauuaucaaagccggggcuagaguggaagaggaaaaggugaaacggcuguacugggcguccaaggaggucaauagccaauuuuuccgcguguauggaaucgauaaaccucucgaggaaggcaaccccgacgauauucugacgaugguuaucuacaauucuccugaggaauauaaacuuaacuccgugcuguacggcuaugacaccaauaacgggggaauguacauugagcccgaaggcacauucuuuaccuacgagagagaggcccaggaaagcacauauacccucgaggaacuguuccggcacgaguacacgcacuaucuucaggggcgcuacgcuguccccggacaguggggcagaacaaagcuguaugauaaugaccggcucaccugguacgaggaagggggagccgagcuguuugccggcuccaccagaacaucuggcauccugccucgcaagagcauuguguccaacauccauaacaccacacggaauaacagauauaagcucagcgacacgguucacucuaaauacggggcuuccuucgaauuuuacaauuaugccuguauguucauggauuacauguauaacaaggacaugggcauucugaauaaacuuaacgaucuggcgaagaauaacgacguggauggauacgacaauuauauccgcgaucucagcucuaacuacgcucugaaugacaaauaucaagaucauaugcaggagcggaucgacaacuacgaaaaucugaccgucccguuuguggccgaugacuaccuugucagacacgccuauaagaaccccaaugagauuuacagcgagaucuccgaaguggcuaagcucaaagaugccaagucugagguuaaaaagagccaguauuucuccacauuuacccugcgcgggagcuacacaggaggcgcuucuaaagggaagcuggaagaccaaaaggccaugaacaaauucauugacgauucccucaagaaacuggacaccuauagcuggucuggcuacaagacgcuuaccgcguauuuuacaaacuacaaaguggauuccagcaaucgggucaccuacgacgugguuuuccacggauaucugccuaacgagggcgauuccaaaaauucucuccccuacgggaagaucaacggaacauauaagggcaccgaaaaggagaaaauuaaguuuagcuccgaggggucuuucgacccugauggaaaaaucgugagcuacgaaugggacuucggcgaugggaauaaguccaacgaggaaaaucccgagcauagcuaugacaaggucggcacguacacagugaaacugaaggugaccgaugacaaaggagaaucuuccguuagcacaaccaccgccgagaucaaggaucugucugagaacaaacuuccggucauuuauaugcacgugccuaaguccggcgcucucaaucagaaaguggucuuuuacgggaagggaacauacgaccccgacggcagcaucgccggguaucagugggauuucggagacggcucugauuuuagcuccgaacagaacccuagccauguguacacgaagaaaggggaguauaccguuacacugagagugauggacucuuccggccaaaugagcgaaaagaccaugaaaauuaagaucacagaucccgucuacccuauuggaaccgagaaagagcccaauaacuccaaggaaacggcuucuggcccgaucgugccugggauccccguuagcggaacaauugagaauaccuccgaccaggauuauuucuacuuugacgugaucacccccggcgaagucaagauugauaucaacaaacugggguauggaggcgccacaugggugguuuacgacgagaauaacaacgcggugucuuacgccaccgaugacgggcagaaucucagcggcaaguucaaagcugacaagccuggacgcuauuacauucaccuguauauguuuaacggcuccuacaugccguaucggaucaauaucgaagggucugucggaagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1858 - RNA, 3217 nt, Artificial Sequence
  mRNA product Design1 comprising derived and/or modified sequence from Clostridium histolyticum__BAA34542.1__HsALB(1-18)_ColH(41-1021) (opt5)
gggagaaagcuuaccaugaagugggugaccuucaucagccugcucuuucuguucuccucugccuacagcguccagaacgaguccaaaagauauacaguuucuuaccuuaagacgcugaauuauuacgaccucguggaucugcuugugaaaaccgaaauugagaaccugcccgaccucuuucaauauagcuccgaugcuaaggaguucuacggcaauaaaacacggaugucuuuuaucauggacgaaauugggcgcagagccccucaguauaccgaaaucgaucacaagggcauuccgacacuggucgaggugguucgggcgggauucuaccugggguuucauaacaaggagcucaaugaaaucaacaaacgcagcuucaaggagagagugauccccuccauucuggcuauccagaaaaauccuaacuuuaagcugggaaccgaaguccaggacaaaauugugagcgccacaggccugcucgccgggaaugagaccgcucccccugagguugugaacaauuucacgcccauccugcaagauugcauuaagaacaucgaccgguacgcccuugaugaccugaagucuaaagcucucuuuaauguccuggccgcgccuaccuaugauauuacagaauaccugcgcgccaccaaggagaaaccggaaaacacacccugguauggaaagaucgacggcuucaucaaugagcucaaaaagcuggcucuuuacggcaaaauuaacgauaacaauuccuggaucauugacaacgggaucuaucacauugccccucugggaaagcuccauagcaauaacaagaucggcaucgaaacccugacggaggugaugaaaguguaccccuaucuuucuaugcagcaccuucaguccgcugaccagauuaagagacauuacgauagcaaagacgccgaggggaauaagaucccucucgauaaauuuaagaaggaaggaaaagagaaguacugucccaaaacauauaccuucgacgauggcaaggucauuaucaaagcgggggcccggguugaagaggaaaaggugaagcgccuguacugggcuucuaaagaggugaacucccaauucuuuagagucuauggaauugacaagccgcuggaggaaggcaauccugaugacauccucacaauggugaucuacaacagccccgaggaauauaaacuuaauuccguucuuuacggcuaugauaccaacaaugggggaauguacauugagccugaaggcaccuucuuuacauacgagcgggaggcccaggaaucuacguauacccuggaggaacucuuccgccacgaguacacacacuaucugcaggggagauacgcugugcccggacaguggggccggaccaagcuguaugacaacgaucgccugacaugguacgaggaagggggagccgagcucuuugccggcagcaccagaacguccggcauccugccccggaaaagcauugucucuaauauccauaacacaaccagaaauaaccgcuauaagcuguccgacaccgugcacagcaaguacggggcuucuuucgaauuuuacaacuaugcgugcauguucauggacuacauguauaauaaagauaugggcauucucaacaagcugaaugaccuugccaaaaacaaugauguugacggauacgauaacuauauccgggaccugagcuccaauuacgcucucaacgauaaguaucaagaccauaugcaggagagaauugauaauuacgaaaaccugacagugccuuuugucgccgacgauuaccuggugcgccacgccuauaaaaauccgaacgagaucuacucugagaucagcgaagucgcuaaacuuaaggacgccaaguccgaggugaagaaaagccaguauuucucuaccuuuacacuccggggguccuacacgggaggcgcgagcaaggggaaacuggaagaucaaaaggcuaugaauaaauucauugacgacucucugaagaagcucgauaccuauuccuggagcggcuacaaaacacugaccgccuauuuuacaaacuacaagguugacuccucuaauagagugaccuacgaugucguguuccacggauaucuucccaacgagggcgacagcaaaaacucccugccuuacgggaagaucaauggaacguauaaaggcaccgaaaaggagaagauuaaauucucuagcgagggguccuuugaucccgacggaaagaucguuagcuacgaaugggauuucggcgacgggaacaaaucuaaugaggaaaacccugagcauuccuaugauaaggugggcacauacaccgucaaacucaaggugacagacgauaagggagaaagcucuguguccaccacgacagccgagauuaaagaccugagcgagaauaagcugcccguuaucuauaugcacgucccgaaaucuggcgcucuuaaccagaaggugguguuuuacgggaaaggaaccuacgauccugacggcagcaucgccggguaucagugggacuucggagauggcuccgacuuuagcucugaacagaaucccucccaugucuacacaaagaaaggggaguauaccgugacccuccgcguuauggauagcuccggccaaaugucugaaaagacaaugaagauuaaaaucacggacccuguguaccccauuggaaccgagaaggagccuaacaauagcaaagaaacagcuuccggccccaucgucccggggauuccugugucuggaaccaucgagaacacaagcgaucaggacuauuucuacuuugauguuaucacccccggcgaagugaagauugacaucaauaaacugggguauggaggcgccacgugggucguguacgaugagaacaauaacgcgguuuccuacgccacagacgaugggcagaaucugucuggcaaguucaaggcugacaaacccggacgguauuacauucaccucuauauguuuaacggcagcuacaugccuuauagaaucaacauugaaggguccgugggacgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1859 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt5)
gggagaaagcuuaccaugaagugggugaccuucaucagccugcucuuucuguucuccucugccuacagcaugaaaagaaagugccuuuccaaacggcugaugcucgcuauuacaauggccacgaucuuuaccgucaacucuacacugcccauuuaugcggcuguugacaagaauaacgccaccgccgcucgcagacggcgcaaaagagugcagaaugagagcaagcgguacacaguguccuaucuuaagacccugaacuacuaugaucucgucgaccugcuggugaaaacagaaaucgagaaucucccugaucuguuccaauacucuagcgacgccaaggaauuuuauggcaacaaaacccgcauguccuucauuauggaugagaucgggagacgggcuccgcaguacacggaaaucgaccacaagggcauucccacccuuguugaggugguccgcgccggauuuuaccugggguuccauaauaaagagcucaacgaaaucaauaagagauccuuuaaggagcgggugauuccuucuauccuggcgauucagaaaaaccccaauuucaaacuuggaacagaaguucaggauaagaucguguccgccaccggccugcucgcugggaacgagacagccccucccgaggucgugaauaacuuuaccccuauucugcaagacuguaucaagaauaucgaucgcuaugcucuggacgaucucaaaagcaaggcccuguucaacgugcuugcggccccgacguacgacauuacagaauaucugagagcuaccaaagagaagcccgaaaacacaccuugguacggaaagaucgauggcuuuauuaaugagcucaaaaagcuggcccuuuauggcaaaaucaacgacaauaacucuuggauuaucgacaaugggaucuaccacauugcuccccugggaaagcuccauuccaacaauaaaaucggcauugaaacccugaccgaggucaugaagguuuauccuuaccugagcaugcagcaccuccagucugccgaucagaucaagcggcauuacgacuccaaagaugccgaggggaacaagauuccccuggacaaauucaagaaagaaggaaaggagaaguauugcccgaaaacauacacguucgaugacggcaaggugaucaucaaagcuggggcgcgcguggaagaggaaaaggucaaaagacuuuauugggccagcaaggaggugaauagccaauuuuuccggguuuacggaauugauaagccucuggaggaaggcaaccccgacgauauccucaccauggugauuuauaauucuccugaggaauacaaacugaacagcguccuuuauggcuacgacacaaauaacgggggaauguacaucgagcccgaaggcaccuuuuucacauaugagagagaggcucaggaauccaccuacacgcuggaggaacucuuucgccacgaguauacacacuaccugcaggggcgguaugccgugcccggacaguggggcagaaccaagcuguacgauaaugaccgccucaccugguaugaggaagggggagccgagcuguucgcuggcagcacacggaccucuggcauucuuccuagaaaauccaucguuagcaacauucauaacacaacgcgcaauaaccgguacaagcugucugacaccgugcacagcaaauacggggccuccuuugaguucuauaauuacgcguguauguuuauggauuauauguacaacaaggacaugggaauccucaauaaacugaacgaucuggcuaagaauaacgacgucgauggcuaugacaauuacaucagagaucuuucuagcaacuaugcccucaaugacaaguaccaagaucauaugcaggaacgcauugacaacuacgaaaaucugacagugccguucgucgccgaugacuaucuggugcggcacgcuuacaaaaaccccaaugagaucuauuccgagauuagcgaaguugccaagcucaaagaugcuaagucugaggugaaaaagucccaguacuuuagcaccuucacacugagagggucuuauaccggaggcgccuccaaggggaaacuugaagaccaaaaggcgaugaacaaauuuaucgacgauagccugaagaaacucgacacguacuccuggucuggcuauaagacccugacagccuacuucaccaacuacaaggucgauagcuccaaucgcgugacauaugacguuguguuccacggauaccugccuaacgagggcgauucuaaaaauagccuucccuaugggaagauuaacggaaccuacaaaggcacggaaaaggagaaaaucaaguuuuccagcgaggggucuuucgacccugauggaaagaucgucuccuaugaaugggacuuuggcgaugggaauaaaagcaacgaggaaaaucccgagcauucuuacgacaaggugggcacauauaccgugaaacucaagguuacagaugacaaaggagaauccagcgucucuaccaccacagcugagauuaaggaucugagcgagaacaaacugccggugaucuacaugcacgugccuaaguccggcgcccucaaucagaaggucguguucuacgggaaaggaacguaugaccccgacggcagcauugcuggguaccagugggauuuuggagacggcucugauuucuccagcgaacagaacccuucccauguuuauaccaagaaaggggaguacacagugacccugcgggucauggacucuagcggccaaauguccgaaaagacaaugaaaaucaagauuaccgaucccguguauccuaucggaacggagaaggagcccaauaacucuaaagaaacagccagcggcccgaucguuccugggauucccguguccggaaccaucgagaauaccucugaccaggauuacuuuuauuucgacgucauuacacccggcgaagugaagaucgauauuaacaaacuuggguacggaggcgcgaccuggguuguguacgacgagaauaacaacgccgucagcuaugcuacagaugacgggcagaaucuguccggcaaguuuaaagccgacaagccuggaagauacuauauccaccucuacauguucaacggcagcuauaugccguaccggaucaauauugaagggucugugggacgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1860 - RNA, 793 nt, Artificial Sequence
  mRNA product Design1 comprising derived and/or modified sequence from Homo sapiens__NP_001133.1__HsAMELX (opt5)
gggagaaagcuuaccaugggcaccuggauccuguucgccugccuccugggggcugccuuugcgaugccccuuccuccgcaccccggacauccuggcuacauuaacuucagcuaugaggugcugacaccccucaagugguaccaguccaucagaccucccuauccuucuuacggguaugaaccgaugggaggcuggcugcaccaucaaauuauccccguccuuagccagcagcacccucccacgcauacccugcagccucaccaccauauucccguugugccggcucaacagccugugaucccccagcagccuaugaugcccguccccgggcaacacuccaugacaccuauccagcaucaccagccgaaucugcccccucccgcccagcaaccuuaccagccccagccggugcaaccucagccccaccagccuaugcagccccaaccucccguucauccgaugcagccucucccuccccagcccccgcugcccccuauguuucccaugcagccucugcccccuaugcuccccgaccuuacccuggaggccuggccgucuacagauaaaaccaagcgggaagagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1861 - RNA, 352 nt, Artificial Sequence
  mRNA product Design1 comprising derived and/or modified sequence from Homo sapiens__NP_001133.1__HsAMELX-TRAP (opt5)
gggagaaagcuuaccaugccccugccuccgcaccccggccauccuggguacaucaacuucagcuaugaggugcucaccccucugaagugguaccaguccauuagaccucccuaucccucuuacggauaugaaccgaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1862 - RNA, 385 nt, Artificial Sequence
  mRNA product Design1 comprising derived and/or modified sequence from Homo sapiens__NP_001133.1__HsAMELX-LRAP (opt5)
gggagaaagcuuaccaugccccugccuccgcaccccggccauccuggguacaucaacuucagcuaugaggugcucacaccccugaagugguaccaguccauuagaccucccccuaugcuuccggaccugacccucgaagccuggcccucuacggauaaaaccaagcgggaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1863 - RNA, 424 nt, Artificial Sequence
  mRNA product Design1 comprising derived and/or modified sequence from Homo sapiens__NP_001133.1__HLA-A2-SP_HsAMELX(17-60) (opt5)
gggagaaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuauucggcccccuuauccgagcuacggcuaugaacccaugggaggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1864 - RNA, 457 nt, Artificial Sequence
  mRNA product Design1 comprising derived and/or modified sequence from Homo sapiens__NP_001133.1__HLA-A2-SP_HsAMELX(17-47,168-191) (opt5)
gggagaaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuauucggcccccuccgaugcuccccgaccugacacuggaagccuggccuagcaccgauaaaacaaagcgcgaggaaguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1865 - RNA, 796 nt, Artificial Sequence
  mRNA product Design1 comprising derived and/or modified sequence from Homo sapiens__NP_001134.1__HsAMELY (opt5)
gggagaaagcuuaccaugggcaccuggauccuguucgccugccucgugggggcugccuuugcgaugccccugccuccgcaccccggacauccuggcuacauuaacuucagcuaugagguccuuacaccccugaagugguaccaguccaugaucagaccucccuauucuagcuacggguaugaaccuaugggaggcuggcuccaccaucaaauuaucccgguugugucccagcagcacccccugacgcauacccuucagucucaccaccauauuccugugguccccgcucaacagccucgggugcgccagcaggcccugaugcccguuccggggcaacagagcaugacaccuacccagcaccaucagcccaaucucccucugcccgcccaacagcccuuucagccucaaccggugcagccccagccucaccagcccaugcaaccucagcccccgguccagccuaugcagccccugcucccucaacccccucugcccccgauguucccucuuagaccccugcccccuauccucccggaccugcaccuugaggcuuggcccgccacagauaaaaccaagcaggaagagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1866 - RNA, 355 nt, Artificial Sequence
  mRNA product Design1 comprising derived and/or modified sequence from Homo sapiens__NP_001134.1__HsAMELY-TRAP (opt5)
gggagaaagcuuaccaugccccugccuccgcaccccggccauccuggguacaucaacuucagcuaugaggugcucaccccucugaagugguaccaguccaugauuagaccucccuauucuagcuacggauaugaacccaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1867 - RNA, 388 nt, Artificial Sequence
  mRNA product Design1 comprising derived and/or modified sequence from Homo sapiens__NP_001134.1__HsAMELY-LRAP (opt5)
gggagaaagcuuaccaugccccugccuccgcaccccggccauccuggguacaucaacuucagcuaugaggugcucacaccccugaagugguaccaguccaugauuagaccucccccuauccuuccggaccugcaccucgaagccuggcccgcuaccgauaaaacgaagcaagaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1868 - RNA, 427 nt, Artificial Sequence
  mRNA product Design1 comprising derived and/or modified sequence from Homo sapiens__NP_001134.1__HLA-A2-SP_HsAMELY(17-61) (opt5)
gggagaaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuaugauucggcccccuuauagcuccuacggcuaugaaccgaugggaggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1869 - RNA, 460 nt, Artificial Sequence
  mRNA product Design1 comprising derived and/or modified sequence from Homo sapiens__NP_001134.1__HLA-A2-SP_HsAMELY(17-48,169-192) (opt5)
gggagaaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuaugauucggcccccuccgauccuccccgaccugcaccuggaagccuggccugccacagauaaaaccaagcaggaggaaguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1870 - RNA, 787 nt, Artificial Sequence
  mRNA product Design1 comprising derived and/or modified sequence from Sus scrofa__NP_999071.1__SsAMELX-001-1 (opt5)
gggagaaagcuuaccaugggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuuauacgucuuacggguaugaacccaugggaggcuggcugcaucaccaaauuaucccugucguuagccagcagaccccgcagucccaugcgcuucaaccccaccaccauauuccuauggugcccgcucagcagccugggaucccccagcaaccgaugaugccucugcccggacagcacucuaugacaccuacccagcaucaccagcccaaccucccccugccugcccaacagccguuucagccccaaccugugcagccccagccucaccagccccugcaaccgcagagcccuaugcaucccauccagccucuccugccccagccuccccuuccgccuauguucuccaugcaaucucugcuccccgaccugccccuugaggccuggccugcuacagauaaaaccaagcgggaagaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1871 - RNA, 355 nt, Artificial Sequence
  mRNA product Design1 comprising derived and/or modified sequence from Sus scrofa__NP_999071.1__SsAMELX-TRAP (opt5)
gggagaaagcuuaccaugccccugccuccgcaccccggccauccuggguacaucaacuucagcuaugaggugcucacaccccugaagugguaccagaauaugauuagacacccuuauaccuccuacggauaugaacccaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1872 - RNA, 388 nt, Artificial Sequence
  mRNA product Design1 comprising derived and/or modified sequence from Sus scrofa__NP_999071.1__SsAMELX-LRAP (opt5)
gggagaaagcuuaccaugccccugccuccgcaccccggccauccuggguacaucaacuucagcuaugaggugcucacaccccugaagugguaccagaauaugauuagacacccuucccuucugcccgaccucccucuggaagccuggccggcuaccgauaaaacgaagcgggaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1873 - RNA, 427 nt, Artificial Sequence
  mRNA product Design1 comprising derived and/or modified sequence from Sus scrofa__NP_999071.1__HLA-A2-SP_SsAMEL(17-61) (opt5)
gggagaaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaaauaugauucggcaccccuauacaucuuacggcuaugaaccuaugggaggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1874 - RNA, 460 nt, Artificial Sequence
  mRNA product Design1 comprising derived and/or modified sequence from Sus scrofa__NP_999071.1__HLA-A2-SP_SsAMEL(17-49,167-189) (opt5)
gggagaaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaaauaugauucggcaccccucucuccugccugaccugccgcucgaagccuggcccgccacagauaaaaccaagcgcgaggaaguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1875 - RNA, 751 nt, Artificial Sequence
  mRNA product Design1 comprising derived and/or modified sequence from Sus scrofa__P45561-2__SsAMELX-001-2 (opt5)
gggagaaagcuuaccaugggcaccuggauccuguucgccugccuccugggggcugccuuuagcaugccccuuccuccgcaccccggacauccuggcuacauuaacuucuccuauaucagacaccccuacacaucuuauggguacgagccuaugggaggcuggcugcaucaccagauuauccccguggucagccaacagacgccucagucccaugcgcuccagccgcaccaccauauucccaugguuccugcucaacagcccgggaucccucagcagcccaugaugccgcugccuggacaacacucuaugacccccacacagcaucaccagccuaaucuuccccugcccgcccagcaaccuuuucagccgcagcccgugcaaccucagccccaccagccucuccagccccaaagcccgaugcauccuauccagccccugcugccucagcccccucugcccccgauguucuccaugcagucucuccuuccugaccugccccucgaagccuggcccgcuaccgauaagacaaaacgggaggaaguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1876 - RNA, 787 nt, Artificial Sequence
  mRNA product Design1 comprising derived and/or modified sequence from Sus scrofa__NP_998965.1__SsAMELX-001-3 (opt5)
gggagaaagcuuaccaugggcaccuggaucuucuuugccugccugcucggggcuagccuggccaugccccuuccuccgcaccccggacauccuggcuacauuaacuucuccuaugaggugcugacaccccucaagugguaccagaauaugaucagacacccuuauacgucuuacggguaugaacccaugggaggcuggcugcaucaccaaauuaucccugucguuagccagcagaccccgcagucccaugcgcuucaaccccaccaccauauuccuauggugcccgcucagcagccugggaucccccagcaaccgaugaugccucugcccggacagcacucuaugacaccuacccagcaucaccagcccaaccucccccugccugcccaacagccguuucagccccaaccugugcagccccagccucaccagccccugcaaccgcagagcccuaugcaucccauccagccucuccugccccagccuccccuuccgccuauguucuccaugcaaucucugcuccccgaccugccccuugaggccuggccugcuacagauaaaaccaagcgggaagaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1877 - RNA, 436 nt, Artificial Sequence
  mRNA product Design1 comprising derived and/or modified sequence from Sus scrofa__K7GPB2__SsAMELX-002 (opt5)
gggagaaagcuuaccaugggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuucucugcuucccgaccugccucucgaagcguggccggcuacggauaaaaccaagcgggaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1878 - RNA, 829 nt, Artificial Sequence
  mRNA product Design1 comprising derived and/or modified sequence from Sus scrofa__K7GLD0__SsAMELX-003 (opt5)
gggagaaagcuuaccaugggcaccuggauccuguucgccugccuccugggggcugccuuuagcaugccccuuccuccgcaccccggacauccuggcuacauuaacuucuccuaugaggaccuguaccucgaagcgaucagaauugaucggacagcuuuugugcugacgccccuuaagugguaucagaauaugauccgccacccuuacaccucuuauggguacgagcccaugggaggcuggcugcaucaccaaauuaucccugucguuagccagcagacaccgcagucccaugcccuccaaccccaccaccauaucccuauggugcccgcccagcagccugggauuccccagcaaccgaugaugccucugcccggacagcacucuaugaccccuacacagcaucaccagcccaaccugccccucccugcucaacagccguuccagccccaaccugugcagccccagccucaccagccccugcaaccgcagagcccuaugcaucccauccagccucuucugccccagccuccccucccgccuauguuuuccaugcaaucucugcuucccgaccugccccucgaagccuggccugcuaccgauaaaacaaagagagaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1879 - RNA, 715 nt, Artificial Sequence
  mRNA product Design1 comprising derived and/or modified sequence from Sus scrofa__K7GPE9__SsAMELX-004 (opt5)
gggagaaagcuuaccaugggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuacgccccaaucucaugcgcugcagccucaccaucacauuccgaugguccccgcucagcagccugggaucccccaacagccuaugaugccccuuccgggacagcacagcaugaccccuacacagcaucaccaacccaaccugccucuccccgcccagcagcccuuucagccucaaccgguucagccccagccucaucaaccccugcagccucagucccccaugcacccgauucagccucugcucccccaaccuccccugccucccauguucucuaugcagagccuucugccggaccucccucuggaagccuggcccgcuaccgauaaaacaaagcgggaggaaguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1880 - RNA, 739 nt, Artificial Sequence
  mRNA product Design1 comprising derived and/or modified sequence from Sus scrofa__J9JIM4__SsAMELX-201 (opt5)
gggagaaagcuuaccaugccccugccuccgcaccccggccauccuggguacaucaacuucagcuaugaggugcucacaccccugaagugguaccagaauaugauuagacacccuuauaccuccuacggauaugaacccaugggcggguggcuucaucaccaaaucauuccugucguuucucagcagacgccgcagagccaugcccugcaaccccaccaccauaucccuauggugcccgcucagcagccuggcauuccccagcaaccgaugaugccucuccccggacagcacuccaugaccccuacacagcaucaccagcccaaccugccccuuccugcccaacagccguuucagccccaaccugugcagccccagccucaccagccccugcaaccgcagucuccuaugcaucccauccagccucuccugccccagccuccccugccgccuauguucagcaugcaaucccuccugcccgaccuuccccuggaggcguggccugcuaccgauaaaacaaagcgggaagaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1881 - RNA, 3178 nt, Artificial Sequence
  mRNA product Design1 comprising derived and/or modified sequence from Homo sapiens__NP_006120.1__HsBMP1 (opt5)
gggagaaagcuuaccaugcccggcguggccagacugccucuccugcuugggcugcuccugcuuccgcggcccggacgcccucuggaccucgcugauuacaccuaugaccuggccgaggaagaugacagcgagccccugaacuacaaggauccuugcaaagcggcugccuuccucggcgacaucgcccuggaugaagaggaccuuagagcuuuucagguccaacaggccguugaucugcggcgccacacagcuagaaaguccucuauuaaagccgcggugcccgggaauacgagcaccccuuccugucagucuacaaacggacagccgcaacggggcgccugcgggcgcuggagaggacggagccgcuccagacgggcugccaccucucgccccgaaagaguguggccugacggcgucauccccuucgugauuggcgggaauuuuacaggaagccagcgggcuguuuuccgccaggccaugagacauugggagaagcacaccugugugacauuucucgagcggaccgaugaagacuccuauaucgucuucacguacagaccuugcggcuguugcagcuauguggggcgccggggaggcgggccccaggcgauuucuaucggaaagaacugugauaaguuuggcaucguugugcaugagcugggccacgucgugggguucuggcaugaacacaccagaccggaccgcgaccggcacguguccauugucagagagaauauccaaccuggacaggaguacaacuuucuuaagauggaaccccaggagguugaaagccugggcgagacauaugauuucgacucuauuaugcauuacgcccgcaauaccuuuucccgggggaucuuccucgauacaauugugccuaaauacgaagugaacggagucaagccucccaucggccagagaacccgccugagcaaaggggacauugcucaagcccggaagcuguauaaaugccccgcuuguggagagacgcuccaggauucuacaggcaauuuuuccagcccggaguaccccaacggcuauuccgcccacaugcauugcguguggagaaucucuguuaccccuggggaaaagaucauucugaauuucacaagccuugaccuguaccgcucccggcucuguugguaugauuacguggaggucagagacggauucuggcggaaggcuccccugcgcggcagauuuugcgggagcaaacuuccugaacccaucgugucuaccgauucccggcuguggguugaguucagaagcucuagcaacugggugggaaagggcuuuuucgccgucuaugaagcgauuugcgggggcgacgugaaaaaggauuacggacacauccaguccccgaauuacccugacgacuaucgccccucuaaagucuguauuuggcggauccaagugagcgagggcuuucacguugggcucaccuuccaguccuuugagaucgaaagacaugauagcugcgccuacgacuaucuggaggugcgcgauggacacucugaauccagcacacugauuggcagauacuguggguaugagaagccugacgauaucaaaucuacguccagccggcucuggcugaaguucgucuccgacggaucuauuaacaaggcuggcuuugccgugaauuucuuuaaagaaguugaugagugcagccgccccaacagagggggcugugagcagcggugccuuaacacccugggauccuacaaguguucuugcgacccuggcuaugaacucgcccccgauaaacgcagaugugaggcugccugcgggggauuccugacaaaacuuaauggcagcaucaccuccccgggguggccuaaagaauacccucccaacaagaauuguauuuggcagcugguggcgcccacacaauaccggaucagccuccaguuugacuucuucgagaccgagggaaacgaugucugcaaguaugacuuuguggaagugcgcucuggccugacggcugauuccaaacugcaugggaaguucugcggcagcgagaaaccggaaguuaucacaucucaguacaauaacaugagagucgaguuuaaguccgacaauaccgugagcaaaaagggauucaaggcccacuuuuucucugacaaagaugaauguagcaaggacaacggcgggugccagcaagauugugugaauaccuuuggauccuaugagugccagugucggagcggcuucguccuccaugacaacaaacacgauugcaaggaggccgggugugaccacaaagugacaucuaccuccggaacaauuacgagccccaauuggccugauaaguaccccuccaagaaagaaugcaccugggcuaucucuagcacaccuggccaucgcguuaagcugaccuuuauggagauggacauugaaucccagcccgagugugccuaugaucaccuugaaguguucgacgggagagaugcuaaagccccuguccugggccgguuuugcggaucuaagaaacccgagccggugcucgcgacaggcagcagaauguuccugcgcuuuuacuccgacaacucuguucagcggaagggguuccaagccagccaugcuaccgaguguggaggccaggugagagccgaugucaaaacgaaggaccuguauucccacgcucaguucggggacaauaacuacccuggaggcguggauugcgaauggguuaucguggccgaggaaggcuacggggucgagcuuguguuucagaccuucgaaguggaggaggaaacagacugcggauaugauuacauggagcucuuugacggcuaugauagcaccgcgccccgccuggggcgguacuguggaucuggcccucccgaagaggucuauuccgccggggacagcguucuggugaaguuccacucugaugacacaauuaccaaaaagggauuucaucucagauacacguccacaaaauuccaagauacccugcacagccgcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1882 - RNA, 1408 nt, Artificial Sequence
  mRNA product Design1 comprising derived and/or modified sequence from Homo sapiens__NP_001191.1__HsBMP2 (opt5)
gggagaaagcuuaccaugguggccggcaccagaugccugcucgcucugcuucugccccagguccuccuugggggagccgcgggccugguuccugagcuggggcggcgcaaguucgcugccgccagcuccggaagaccgucuagccaacccuccgacgaagugcucucugaguuugaacugcggcugcucagcauguucggccugaaacagcgcccuacacccuccagagaugcuguggucccucccuacaugcuugaccuguaucggcgccacucugggcagccuggaagcccggcccccgaucauagacucgagcgggcugccucccgcgcgaacacggugagaucuuuucaccaugaagagucucuggaggaacuuccugagaccuccggcaagacaacccggcgcuucuuuuucaaucugagcucuauccccacagaagaguuuauuaccuccgccgagcuccagguuuucagagaacaaaugcaggacgcucugggcaacaauagcucuuuucaccaucggaucaacauuuacgagaucauuaaaccugccacagcuaauuccaaguuccccgugacccgccugcucgauacgagacuggucaaccagaaugccagccggugggaauccuuugacgugaccccggcgguuaugagauggacagcccaggggcacgcuaaccacggauucguggucgagguggcccaucuugaagagaaacaaggcgugucuaagcgccacguccggaucagcagaucccugcaucaggaugagcacagcuggucucagauccgcccucuccugguuaccuuugggcacgacggaaagggccauccccuucacaaacgggaaaagagacaggcuaaacauaagcaacgcaaacggcugaaguccagcuguaagagacacccucucuauguggauuucucugacgugggguggaaugauuggauugucgccccucccggauaccaugccuucuauugccacggcgagugucccuuuccgcuggcugaccaccugaacagcacaaaucaugcgaucgugcagacccucguuaacuccgugaauagcaaaauucccaaggccugcugugucccuacggaacugagcgcuaucuccaugcuuuaccuggaugagaacgaaaaagugguucucaagaauuaucaggacaugguggucgagggcugcgggugucgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1883 - RNA, 1444 nt, Artificial Sequence
  mRNA product Design1 comprising derived and/or modified sequence from Homo sapiens__NP_001193.2__HsBMP4 (opt5)
gggagaaagcuuaccaugauccccggcaacagaaugcugauggugguccuccugugccagguucuucucgggggagccagccacgcuucccugauuccugagaccggcaagaaaaagguggccgaaauccaagggcaugcgggaggccggcgcucugggcagagccacgagcugcuuagagacuucgaagcuacacugcuccagauguuuggacugcggcgcagaccgcagcccuccaaaucugccgugauuccugauuacaugcgggaccuguaucgccuccaaagcggcgaggaagaggaggaacagauccauuccacgggccuggaguaccccgaaagaccugccucucgggcuaauaccguccgcagcuuccaccaugaggagcaccuugaaaacauucccgggacauccgagaauagcgccuuuagauuccuguuuaaccucucuuccaucccugaaaaugaggugaucagcucugcugaacugcggcuuuuccgcgagcagguugaucagggaccggacugggagagaggcuuucaccggauuaacaucuaugaagugaugaagcccccugccgaggucgugcccgggcaucugauuacccgccuccuggauacaagacugguucaccauaaugugacccggugggaaacauucgacgucuccccugcggugcucagauggacccgcgagaaacaacccaacuacggacuggccaucgaagugacgcaccuucaccagacccggacacaucagggccagcacgucagaauuagccgcucucugccgcaaggguccggaaauugggcucagcuccggccucugcuuguuaccuuuggccaugauggcagagggcacgcccugacacgccggagacgcgcuaagcggagccccaagcaucacucccagagagcccgcaaaaagaacaaaaauugucggagacacucucucuauguggacuucagcgaugugggauggaacgacuggaucgucgcgccucccggcuaccaagccuuuuauugccauggggauugucccuucccucuggcugaccaccucaauuccaccaaccaugccauugugcagacgcugguuaauagcgugaacucuuccaucccgaaggcuugcuguguccccacagagcugagcgccaucucuaugcuuuaccuggaugaguacgacaaagugguucucaagaacuaucaggaaaugguggucgagggaugcggcugucggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1884 - RNA, 1759 nt, Artificial Sequence
  mRNA product Design1 comprising derived and/or modified sequence from Homo sapiens__NP_001709.1__HsBMP6 (opt5)
gggagaaagcuuaccaugcccggccuggggagacgggcccaguggcucugcuggugguggggacugcuuuguagcugcuguggcccuccgccccugcgcccuccccucccugcugccgcggcugccgccgcugggggacaacugcuuggcgacgggggaucccccggcagaaccgagcagccuccgcccucuccucagagcuccucuggcuuccuguaccggcgccucaagacacaggagaaaagagaaaugcaaaaggaaauccugagcgugcuggggcucccccaccggccucgcccccugcauggacuucagcagccgcagccucccgcccugagacaacaggaggaacagcagcaacagcagcaacucccucggggcgagcccccucccgggcgccugaaauccgcuccgcuuuuuaugcuggaucucuauaacgcccugucugcggacaaugaugaggacggagccagcgaaggcgagagacagcaguccuggccccacgaagcugccuccucuucccagcggcgccaaccucccccuggggcugcccauccccugaacagaaagagccuccuggcgccgggaucuggcuccggcggggccagcccucuuacgucugcucaggauuccgccuuccugaaugacgcugauauggucaugagcuuuguuaaccucguggaguacgacaaagaguucagcccccggcagcgccaccauaaggaauuuaaguucaaucugucucagauuccugagggagaaguggucaccgccgccgaguuuagaaucuauaaagauugcgugaugggcagcuucaagaaccaaacauuucuuauuuccaucuaccagguucugcaggaacaccagcaccgggacagcgaucucuuccugcuggacaccagaguggucugggcuucugaggagggguggcucgaauuugauauuacagcgaccuccaaucugugggugguuacaccccaacauaacaugggacuucagcugagcguggucacccgcgacggcgugcacgugcauccucgggccgcugggcucgucggaagagacggccccuaugauaaacagccguucaugguugccuuuuucaaggugucugaggugcacguccgcacgacccggagcgccuccucuagacgccggcagcaaagcagaaaucgcuccacacagagccaggacguggcucggguuucuuccgccagcgauuacaacucuuccgaacugaaaaccgcguguagaaagcacgagcuuuaugugagcuuccaagaccugggcuggcaggauuggaucaucgcuccuaagggguacgccgccaauuacugcgacggagaauguuccuuuccccucaacgcucauaugaaugccacaaaccacgcuauuguccagacccuggugcaucugaugaaucccgaguauguuccuaaaccgugcugugcccccacgaagcucaacgcgaucucugugcuguacuucgaugacaacagcaaugucauucuuaaaaaguaucgcaacauggugguccgggccugcggcugucacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1885 - RNA, 1513 nt, Artificial Sequence
  mRNA product Design1 comprising derived and/or modified sequence from Homo sapiens__NP_001710.1__HsBMP7 (opt5)
gggagaaagcuuaccaugcacgugagaagccugcgggccgcugcuccccauuccuucgucgcgcucugggcuccucuguuucuucugcgcucugcccucgccgacuucagccuggauaacgagguucacuccucuuuuauccauagacggcuucgcagccaggaaagacgggagaugcaacgcgaaauucuguccauccucggccugccgcacagaccccggccucaucugcaggggaagcacaauucugcucccauguucaugcucgaccuguacaacgccauggcuguggaggaaggaggcgggccuggaggccagggguuuagcuaucccuacaaagccguguucuccacccagggaccuccgcuugcgagccugcaagauucucacuuucucacagacgccgauauggucauguccuucgugaaucugguugagcaugacaaggaguuuuuccacccccgcuaucaucacagagaauuucgguucgaucuuagcaaaauuccugagggcgaagcugugacggccgcugaguuucgcaucuacaaggacuauauuagagagcgguucgauaacgaaaccuuccgcaucucugucuaccaggugcugcaggagcaccucggcagagaauccgaccuguuucugcucgauagccggacacugugggccucugaggaaggguggcuuguuuucgacaucaccgcgacauccaaucauuggguggucaaccccagacacaaucugggacuccagcugagcguggagacccuugauggccaauccauuaacccuaaacuggccgggcucaucggacgccauggcccccagaauaagcagccguuuaugguggcuuucuuuaaggccacagagguccacuuccggucuauuagaagcaccggguccaaacagcgcagccaaaaccggucuaagacgccuaaaaaucaggaagcucugagaauggccaacguugccgaaaauuccagcucugaccagcgccaagccugcaagaaacaugagcuguaugugagcuuucgggaccucggauggcaggauuggaucauugcgcccgagggcuacgccgcuuacuauugugaaggcgagugcgccuucccucugaacuccuacaugaaugccaccaaccacgcuaucgugcagacacuuguccacuuuauuaaccccgagaccgugcccaagccuuguugcgccccgacacagcugaaugcgaucucuguucucuauuucgacgauagcuccaacgugauccugaagaaauacagaaauauggucgugcgcgcuugugggugccauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1886 - RNA, 517 nt, Artificial Sequence
  mRNA product Design1 comprising derived and/or modified sequence from Homo sapiens__NP_006264.2__HsCCL7 (opt5)
gggagaaagcuuaccaugaaggccagcgcugcccugcucugccugcuucugaccgcggcugccuucucuccccagggccucgcccaaccuguggggaucaacacauccacgaccuguugcuacagauuuauuaauaaaaagaucccgaaacagcggcuggagagcuaucgcagaacaaccuccucucacuguccccgggaagcugucauuuucaagacaaaacuugacaaggagaucugcgccgauccuacccagaaguggguucaggacuuuaugaaacaucuggauaagaaaacacaaacccccaagcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1887 - RNA, 3841 nt, Artificial Sequence
  mRNA product Design1 comprising derived and/or modified sequence from Homo sapiens__NP_001954.2__HsEGF (opt5)
gggagaaagcuuaccaugcugcucacccugaucauucuucugcccguggucagcaaguucuccuuuguuucucucagcgccccucagcacugguccugcccggagggcacacuggcugggaacggaaauucuacgugugugggccccgccccuuuccuuaucuuuagccaugggaacuccauuuucagaaucgacaccgaaggaacaaauuacgagcaacugguggucgaugcgggcgugucuguuauuauggacuuucacuauaacgaaaaacggaucuacuggguggaucucgagcgccagcugcugcagagagucuuccucaaugggagccggcaggaacgcgugugcaacaucgagaagaauguuuccggaauggcuauuaacuggaucaaugaggaagugauuuggagcaaccaacaggagggcaucauuaccgucacagacaugaaaggcaauaacucucauauccugcuuuccgcccugaaguaucccgccaauguggcuguggauccugucgaaagauuuauuuucuggagcucugagguugccgggucccucuaccgggcugaccuggauggagugggcgugaaagcccuucuggagaccagcgaaaagaucacagcggucucucucgacgugcuggauaagcgccuguuuuggauccaguauaacagagagggguccaauagccucauuuguuccugcgacuacgauggaggcucuguucacaucagcaaacaucccacccagcacaaccuguucgccaugucccuuuuuggggaccggauuuucuauagcacguggaagaugaaaaccaucuggauugcuaacaagcacacaggaaaagauauggugcgcaucaaucugcauucuuccuuugucccucucggcgaacugaaggugguucacccgcuugcccaacccaaggcugaggacgacaccugggaaccugagcagaaacuguguaagcucagaaaaggcaacugcagcucuacagugugugggcaggaucugcagagccaucugugcaugugugccgagggauacgcgcucucccgggaccgcaaguacugcgaagaugucaaugagugugccuucuggaaccacggcugcacccuggggugcaaaaauacgcccggaucuuauuacuguacaugcccugugggcuucguccuucugcccgacgggaagagaugucaccaacucgugagcugcccgcggaacguuuccgaauguagccaugauugcgugcugaccucugagggaccucuuuguuuuugccccgaaggcuccguccuggagcgcgacggcaaaacauguagcggguguucuuccccugauaauggaggcugcagccagcucugcgugccccugucccccguuucuugggagugcgacuguuucccuggguaugaucugcagcucgacgaaaagagcugcgcugccuccggaccgcaacccuuucugcuuuucgcuaacucucaggauaucagacacaugcauuuugacggcaccgacuacgggacccugcucagccagcagaugggcaugguguaugcccuggaucacgacccugucgagaauaagauuuacuucgcccauacagcucugaaauggaucgaacgggcgaacauggauggaucccaaagagagcgccuuauugaagagggcguggacgugcccgaggggcucgccguugauuggaucggacggagauuuuauuggacggaccgcggcaagagccugauugggcggucugaucugaauggaaaaagauccaagaucaucaccaaagaaaacauuagccagccucgcggcaucgcuguccaccccauggccaagcggcuuuucuggacagacaccgggauuaauccgagaaucgagucuuccagccugcagggccuuggacgccuggugauugccucuagcgaucucaucuggccuuccggcauuacaaucgacuuucugaccgauaagcuguacuggugugacgcuaaacagagcgugaucgaaauggccaaccuugaugggucuaagcggagacgccucacgcaaaaugacgucggacaccccuucgcgguggcuguuuuugaggacuacgugugguucuccgauugggccaugccuagcgucaugcgggugaacaaaagaacaggcaaggaccggguucgccugcagggguccaugcugaaacccucuagccucguggucgugcauccucuggccaagcccggagcugauccgugccuuuaucagaacggcgggugugagcacauuugcaagaaaagacugggcaccgccugguguuccugccgggaaggauuuaugaaggcuucugacggcaaaaccugucucgcccuggaugggcaucagcugcuugcgggaggcgagguugaccucaagaaucaagugacaccucuggauauccugagcaaaaccagagucuccgaagacaacauuacagagucucagcacaugcucguggccgaaaucauggugagcgaucaggacgauugcgcucccgucggguguuccauguacgcccgcugcauuagcgagggagaggacgcuacgugccagugucugaagggcuucgccggggauggcaagcucugcucugacaucgacgaaugugagaugggaguucccgugugcccuccggcguccagcaaauguaucaauaccgaaggcggguaugugugccgguguucugagggauaccaaggcgaugggauucacugccuggacaucgaugaaugucagcucggagagcauuccugcggcgagaacgccagcuguacaaauaccgaaggcggguauacaugcaugugcgcuggaagacugucugagcccggccugauuuguccugacuccacgcccccuccccaccuucgcgaagaugaccaucacuacagcgucagaaacuccgauagcgagugcccucucucucaugacggguauugucugcacgauggagugugcauguacaucgaagcccuggacaaguacgcuuguaauugcguugugggcuauauuggggagcggugucaguaccgcgaucucaaauggugggagcugagacacgccggacauggccaacagcagaaggucaucgugguugccgugugcgucgugguucuugugaugcugcuccugcugagccuuuggggcgcucacuauuaccggacccagaaacugcucuccaagaaccccaaaaauccguaugaagagucuagccgcgacgucagaucccggcgcccugcggacaccgaagaugggaugucuagcuguccccaaccuugguucguggugaucaaggagcaucaggaccugaagaacggaggccagcccgucgccggggaggauggacaggcugccgacggcuccaugcaaccgacaucuuggagacaggaaccucagcucugcgggaugggaaccgagcagggcuguuggauucccguuagcuccgauaaaggcagcugcccucaagugauggaacggucuuuucacaugcccuccuacgggacacagacccuggagggaggcguggaaaagccccauagccuucugucugccaauccucucuggcagcaacgcgcucuggacccgccccaccagauggagcugacgcagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1888 - RNA, 727 nt, Artificial Sequence
  mRNA product Design1 comprising derived and/or modified sequence from Homo sapiens__NP_001423.1__HsEREG (opt5)
gggagaaagcuuaccaugaccgccggcagacggauggagaugcugugcgcugggcgcgugcccgcccuccugcuuugucugggauuccaccuccugcaggcgguccuuagcacaacgguuaucccuuccugcauuccgggcgaaucuagcgacaacuguaccgcucuggugcaaacagaggauaaucccagaguggcccaggucuccaucaccaagugcucuagcgacaugaacggguacugucuccauggacagugcauuuaucugguggauaugucccagaauuacugucggugcgaaguuggcuauacaggggugcgcugugagcacuuuuuccugaccguccaucaaccucucucuaaagaauacguggcccugacaguuauccuuauuauccuguuucucaucaccguggucggaagcacguauuacuucugcagaugguaucggaaccgcaaguccaaagagcccaagaaagaguacgaaagagugaccagcggcgacccugagcugccccaggugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1889 - RNA, 685 nt, Artificial Sequence
  mRNA product Design1 comprising derived and/or modified sequence from Homo sapiens__NP_000791.1__HsFGF1 (opt5)
gggagaaagcuuaccauggccgagggcgaaaucaccacauucacggcucugaccgagaaguuuaaccugcccccugggaauuacaaaaagccgaaacuccuuuauugcagcaacggaggccacuuccugcggauucuccccgacgggacaguggauggaaccagagaccgcuccgaucagcauauccaacugcagcuuucugccgaaagcgucggcgagguuuacauuaaguccacagaaaccgggcaguaucuggcgauggacacagauggacuccuguacggcucucagaccccuaaugaggagugucuguuucucgaaagacuggaggaaaaccacuauaauacguacaucagcaaaaagcaugcugagaagaacugguucgugggccuuaaaaagaauggguccugcaaacggggaccccgcacccacuauggccaaaaggccauucuguuucucccucugcccgugucuagcgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1890 - RNA, 1084 nt, Artificial Sequence
  mRNA product Design1 comprising derived and/or modified sequence from Homo sapiens__NP_001997.5__HsFGF2 (opt5)
gggagaaagcuuaccauggugggcgucgggggaggcgacguugaggaugugacccccagaccugggggaugccagaucagcggccgcggggcccggggauguaacggcauuccgggcgcugccgcgugggaagcugcccugcccagacggcgcccuagacggcaccccuccgugaauccucgcucuagagccgcugggagcccccggacacgcggaagacggacggaggaacgcccuuccggcucuagacucggggaccggggacgcggcagagcccugcccgggggacggcuuggcggcagagggcgcggacgggcucccgagagagucggcgggcgcggacggggcagagggaccgccgcgccucgcgccgcucccgccgcucggggaagcagaccuggccccgccggcacaauggcggccggguccaucaccacacugccggcucucccugaagauggaggcucuggggccuucccgccuggacauuuuaaggaccccaaacgccuguacugcaagaacggcggguucuuucuucggauucaccccgauggcagaguggacggaguucgcgagaaaagcgauccucauaucaagcugcaacuccaggcugaggaacggggcguggucuccauuaaaggggugugugccaauagauaucuggccaugaaggaggacggacggcugcucgcuagcaagugcguuaccgaugaauguuucuuuuucgagcgccuggagucuaacaauuacaacacauauagaucccggaaauacaccagcugguauguggcgcuuaagagaacgggccaguacaaacuggggucuaagaccggaccgggccagaaagccauccucuuucugcccauguccgcuaagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1891 - RNA, 802 nt, Artificial Sequence
  mRNA product Design1 comprising derived and/or modified sequence from Homo sapiens__NP_002000.1__HsFGF7 (opt5)
gggagaaagcuuaccaugcacaaguggauccugaccuggauucuccccacacugcuuuacagaagcugcuuccauaucauuugucuggugggcacgaucucccucgccugcaacgacaugaccccugagcagauggcuacaaaugucaacuguucuagcccggaacggcacacccgcuccuaugauuacauggaagggggagacauuagaguucggcgccuguuuugcagaacacaaugguaucuucggaucgauaaacgcggcaaggugaaagggacccaggagaugaagaauaacuacaauaucauggagauuagaacaguggccgucggaaucguggcgauuaaaggcguugaaucugaguucuaucuggcuaugaacaaggaggggaagcucuacgccaaaaaggaauguaaugaggacugcaacuuuaaagaacugauccuggagaaucauuauaacaccuacgccagcgcuaaguggacgcacaauggaggcgagauguucguggcccucaaccagaaaggcauucccguccgggggaagaagaccaaaaaggaacagaaaacagcucauuuucugccuauggccaucaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1892 - RNA, 844 nt, Artificial Sequence
  mRNA product Design1 comprising derived and/or modified sequence from Homo sapiens__NP_001936.1__HsHBEGF (opt5)
gggagaaagcuuaccaugaagcugcuccccagcgugguccugaaacuuuuccuggccgcuguucucuccgcccuggugaccggcgagucucuugaaagacugcggcgcgggcucgcggcuggaacaagcaacccugacccgcccacgguguccaccgaucagcugcugccucucggcgggggaagagaccggaagguccgcgaucugcaagaggccgaccuugaucugcucagagugacacugucuagcaaaccccaggcccuugcuaccccuaauaaggaggaacacggcaaacggaagaagaaagggaagggacugggcaaaaagcgcgaccccugccucagaaaauacaaggauuuuuguauccauggcgaaugcaaguauguuaaagagcugcgggccccuuccuguauuugccacccgggguaccauggagagcgcugucacggccugucucuccccguggaaaacagacuguauacauacgaccauaccacaauccuugcugucguggccguugugcugagcuccgucugccuccuggugauuguggggcuucugauguuccgguaucaccgcagaggaggcuacgaugucgagaaugaagagaagguuaaacucgggaugaccaacagccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1893 - RNA, 2404 nt, Artificial Sequence
  mRNA product Design1 comprising derived and/or modified sequence from Homo sapiens__NP_000592.3__HsHGF (opt5)
gggagaaagcuuaccaugugggugaccaagcugcuccccgcccugcuucugcagcacguccuccugcaucuucugcuccugccuaucgcuauuccguacgccgagggccaaagaaaacggcgcaacacaauccacgaguucaagaaaagcgcgaagacgacccugauuaaaaucgaccccgcucucaagauuaagaccaaaaagguuaauaccgccgaucagugcgccaacagauguacacggaauaaagggcugccuuuuaccugcaaggcuuucguguuugacaaagcccgcaagcagugucuuugguuccccuuuaacuccaugucuagcggagugaagaaagaguucggccaugaauuugaucuguaugagaauaaggacuacaucagaaacugcaucauugggaaaggacgguccuauaagggcacagucucuaucaccaaaagcgggauuaagugucagccuugguccucuaugaucccccacgaacauagcuuccucccuuccagcuaccgcggaaaagaucugcaagagaauuauugcagaaacccgcggggcgaggaaggcgggcccugguguuuuacgucuaauccugaggugcgcuacgaaguuugcgacauuccccaguguuccgagguggagugcaugaccuguaacggagaaagcuauagaggccuuauggaucacacagagucugggaagaucugccagcggugggaccaccagaccccucaucgccacaaguuccugcccgaaagauacccggauaaaggauuugacgauaauuacugccggaacccugacggccaaccccgcccuugguguuauacacucgauccccauacaagaugggaauacugcgcuauuaagacgugugccgacaauacaaugaacgacaccgaugucccccuggaaacaaccgagugcauccaggggcagggagagggcuaucggggcaccgugaauacaaucuggaacgggauuccuugucagagaugggacucccaauacccgcacgaacacgauaugacgcccgagaacuucaaaugcaaggaccugcgcgaaaauuauugucggaacccugauggaagcgagucucccuggugcuuuaccacagacccuaauaucagaguuggcuacuguucccagauucccaacugcgauaugagccaugggcaggacuguuaucgcggaaauggcaaaaacuacauggggaaucucucccaaacccggucuggacugacaugcagcaugugggauaagaacauggaagaccuucacagacauaucuucugggagccggaugcguccaagcugaaugagaacuacugccgcaauccugacgacgaugcccacggccccugguguuauaccggcaacccucucauucccugggacuacugcccuaucagccggugugaaggggauacgacacccaccaucgugaaucuggaccauccggucauuucuugcgcuaaaaccaagcagcuuagaguggugaacggaaucccuacacgcaccaauauuggcuggauggucucccugcgguauagaaacaaacacaucugugggggaagccucauuaaggagucuuggguucugacagcccgccagugcuuccccagccgggaucugaaagacuacgaggcuuggcucggcauccacgaugugcaugggagaggcgacgaaaaguguaaacaggugcugaacgucucccaacuuguguauggacccgaaggcucugaucugguucucaugaagcuggcccggccugcggugcuugacgauuuugucagcacgaucgaccugccgaauuacgggugcaccauucccgagaagacauccuguagcguguauggauggggcuacaccgggcucaucaacuacgauggacugcugcgcguugcccaccucuauauuaugggcaaugagaaaugcucucagcaucacagagggaaggugacacugaacgaauccgagaucugugcuggcgccgagaaaauuggaagcggcccuugcgaaggggacuacggaggcccccuugucugcgagcagcacaagaugcggauggugcugggggucaucgugccuggaagaggcugugcuauucccaaucgcccugggaucuucguucggguggccuauuacgccaaguggauccauaaaauuauccucaccuauaaggucccccagucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1894 - RNA, 2143 nt, Artificial Sequence
  mRNA product Design1 comprising derived and/or modified sequence from Homo sapiens__NP_005336.3 __HsHSPA1A (opt5)
gggagaaagcuuaccauggccaaggcugccgcgaucggcauugaccuggggaccacauacagcugcgugggagucuuccagcacggcaaaguugagaucauugcuaacgaucaagggaauagaacgacccccuccuauguggccuuuacagacaccgaacggcucaucggagaugccgcuaagaaccagguggcccugaauccucagaacacagucuucgacgcuaaacgccuuauuggcagaaaguuuggggauccggugguucagucugacaugaaacauuggcccuuccaagugaucaaugauggagacaagccuaagguccaggugagcuacaaaggcgagaccaaggccuuuuaucccgaagagaucuccucuaugguucugacaaaaaugaaggaaauugcggaggccuaccucggcuauccugugaccaacgcugucaucacggugcccgccuacuucaaugauagccagcggcaggcuaccaaagacgccggggugauugcgggacugaacguccuucgcaucauuaaugagccuacagccgcugccaucgcuuauggccuggauagaaccgggaagggagaacggaacguucucauuuuugaccugggcgggggaacauucgauguguccauccugaccaucgacgacggcauuuuugaggugaaggccacggccggcgauacacaccucgggggagaagacuucgauaaucgccuggucaaccauuuuguggaggaguucaaaagaaagcacaaaaaggacaucucucaaaauaaacgggcuguucgcagacuucggaccgcgugugaacgcgccaagagaacacugagcuccagcacccaggcuucucucgagauugauucccuguuugaaggcaucgacuucuacaccagcauuacacgggcccgcuucgaggaacuuugcucugaucuguuuagauccacgcucgagccgguggagaaagcccugcgggacgcuaagcuggauaaggcccagauccaugaccucguccugguugggggaagcaccagaauccccaaagugcagaaacuucugcaagauuucuuuaacggccgcgaccucaauaagucuauuaacccugacgaagcgguggcuuacggggccgccguccaggcugccauccugaugggagauaaguccgagaacgugcaggaccuucugcuccuggaugucgcuccccugagccucggccuggaaacagccggcggggugaugaccgcgcuuauuaaacggaauagcacaaucccuaccaagcaaacgcagauuuucacaaccuauucugacaaccagcccggaguucugauccagguguacgagggcgaaagagccaugaccaaggauaauaaccuccuggggcgcuuugagcuuagcggaaucccgccugcuccccggggcgucccucaaauugaggugacauucgacaucgaugccaaugggauucugaacguuaccgcuacagacaaauccacgggcaaggccaauaaaaucaccauuacaaacgauaagggaagacucagcaaagaagagaucgaacgcauggugcaggaggcggaaaaguauaaggccgaggacgagguccagcgggaaagagugucugcuaaaaaugcccuggaguccuacgcuuuuaacaugaaguccgccguggaagaugagggccugaaagggaagauuucugaggccgacaaaaagaagguucucgauaaaugucaggaagucaucagcuggcuggacgcuaauacccuugcggagaaggacgaguucgaacacaaacgcaaggaacuggagcaagugugcaaccccaucauuuccggacucuaucagggcgccgggggacccggcccugggggcuuuggagcucagggcccgaaagggggaucuggcagcgggcccacaaucgaggaaguggauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1895 - RNA, 2143 nt, Artificial Sequence; identical to SEQ ID NO: 1894
  mRNA product Design1 comprising derived and/or modified sequence from Homo sapiens__NP_005337.2 __HsHSPA1B (opt5)

SEQ ID NO: 1896 - RNA, 2143 nt, Artificial Sequence
  mRNA product Design1 comprising derived and/or modified sequence from Homo sapiens__NP_005518.3 __HsHSPA1L (opt5)
gggagaaagcuuaccauggccaccgcuaagggcaucgccauugggaucgaccugggaacaacguacagcugcgugggcgucuuccagcacgggaagguugagauuaucgcgaacgaucaaggaaauagaaccacacccuccuauguggcuuuuaccgacacagaacggcucauuggcgaugccgccaagaaccagguggcuaugaauccucagaacaccgucuucgacgccaaacgccugaucgggagaaaguuuaaugauccggugguucaggcugacaugaaacuuuggcccuuccaagugaucaacgagggaggcaagccuaagguccuggugucuuacaaaggcgaaaauaaggccuuuuaucccgaggaaauuagcuccaugguucucacaaaacugaaggagaccgcggaggccuuccuugggcauccugugacgaacgcugucaucaccgugcccgccuacuuuaaugauucucagcggcaggcuacaaaagacgccggagugauugcgggccugaacguccuccgcaucauuaaugaaccuaccgccgcugccaucgcuuaugggcuggauaagggaggccagggggagagacacguucugauuuucgaccucggaggcggcacauuugaugugagcauccugaccaucgacgaugggauuuucgaagugaaggccacggccggagacacacaucuuggcggggaggacuuugauaaccggcuggucucccacuucguggaggaauuuaaacgcaagcauaaaaaggacaucucucaaaauaaaagagcuguucggcgccucagaaccgcgugugagcgggccaagcgcacacugagcuccagcacccaggcuaaccuugaaauugauucucuguacgagggaaucgacuucuauaccuccauuacaagagcccgguucgaggaacucugcgccgaucuguuucgcggcacgcuggagccgguggaaaaagcucucagagacgccaagauggauaaggcgaaaauccacgacaucguccugguugggggaagcacccggauucccaaggugcagagacuucugcaggauuacuucaauggccgcgaccucaacaaaucuaucaacccugaugaggcuguggccuacggcgccgcuguccaagccgcuauucugaugggggacaaguccgaaaaagugcaggaccuucugcuccuggaugucgcgccccugagccucggacuggagacagccggcggggugaugaccgcccuuaucaagcggaauagcacaauuccuaccaagcagacgcaaaucuuuacaaccuauuccgacaaccagcccggaguucugauccagguguacgaaggcgagagagcuaugaccaaagauaauaaccuccuggggcgcuucgaccuuacaggcauuccgccugcuccccggggagucccucagaucgaggugaccuuugauauugacgccaauggcauccugaacguuacagccacggauaagagcaccgggaaagugaauaagauuacaaucaccaacgacaaaggaagacucuccaaggaagagauugaacgcaugguccuggaugcggagaaguauaaagccgaagacgaggugcaacgggagaagaucgcugccaaaaaugcucuggaaucuuacgccuucaacaugaagucugugguuuccgaugagggccucaaagggaagaucagcgaaucugacaagaauaaaauucuggauaaguguaacgagcuucuguccuggcucgaggucaaucagcuggccgaaaaagacgaguuugaccacaagagaaaagaacuggagcagaugugcaaccccaucauuacaaaacuuuaucagggaggcuguaccgggcccgcuugcggcacgggauacgugccuggccgcccggcgaccgggcccacaaucgaagagguggauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1897 - RNA, 2137 nt, Artificial Sequence
  mRNA product Design1 comprising derived and/or modified sequence from Homo sapiens__NP_068814.2 __HsHSPA2 (opt5)
gggagaaagcuuaccaugagcgccagaggccccgcuaucgggauugaccugggaaccacauacuccugcgugggcgucuuccagcacgggaagguugagaucauugccaacgaucaaggaaaucggacgaccccuucuuauguggcguuuacagacaccgaacgccucaucggcgaugcugccaaaaaccagguggccaugaauccgacaaacaccauuuucgacgcuaagagacugaucgggcggaaauuugaggaugccacaguccagagcgacaugaagcauuggcccuuccgcgugguuuccgaaggaggcaaaccuaaggugcaggucgaguacaagggcgaaaccaaaacguuuuuccccgaggagaucucuagcauggugcuuaccaagaugaaagaaauugcugaggccuaucugggaggaaagguucacuccgcggugaucacagucccugccuacuuuaaugauucucaaagacaggcuaccaaagacgccggcacaauuaccgggcucaacgugcugcggaucauuaaugaacccacggcugccgcgaucgccuauggacuugauaagaagggcugugcugggggagagaaaaacgugcugauuuucgaccucggcggcgggacauuugaugucagcauccugaccaucgaggacggaauuuucgaaguuaaguccacagccggcgauacccaucuugggggagaggacuuugacaaucgcauggugagccaccucgcugaagaguucaaaagaaagcauaaaaaggauaucggcccuaacaaacgggccgugcgcagacugcggaccgccugcgaacgcgcuaagagaacacuuucuuccagcacgcaggcgucuauugagaucgacucccuguacgagggggucgauuuuuauaccagcauuacacgggcccgcuucgaggaacucaaugcugaccuguucagaggaacccuugaaccgguggagaaggcccugcgggaugccaaacucgacaagggccagauccaagaaaucguucuggugggcgggucuacacgcauucccaaaauccagaagcugcuccaggacuuuuucaacggaaaagagcugaauaaguccauuaacccugaugaggcugucgccuacggcgcggcugugcaggccgccauccuuauuggggauaagagcgaaaauguucaagaccugcuccugcuugaugugacgccccugucccucggaaucgagaccgcuggcggggucaugacaccucugaucaaaagaaacaccaccauucccacaaagcagacccagacauuuacgaccuacucugacaaccaaagcuccgugcugguccagguguaugaaggcgagcgggccaugacaaaagacaauaaccuccugggaaaguucgaucuuaccggcaucccgccugcucccagagggguuccucagauugaagugacauuugacaucgaugccaaugggauucugaacgucaccgcggccgacaaaagcacgggcaaggagaauaagaucaccauuacaaacgauaaagggcgccucucuaaggacgauaucgaccggauggugcaggaggcugaaagauacaaauccgaggaugaagccaaucgcgaccggguugcugccaagaacgcgcuggagagcuauaccuacaauaucaaacaaacaguggaggaugaaaagcugagaggaaagauuucugagcaggacaaaaacaagauccuggauaaaugucaggaagucauuaauuggcucgaccgcaaccagauggccgagaaggacgaauaugagcacaaacaaaaggagcuggaacgggugugcaaucccaucauuagcaaacuguaccagggcgggcccggcggaggcuccgggggaggcgggucuggagcuagcggcgggccuaccaucgaggaaguggauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1898 - RNA, 2740 nt, Artificial Sequence
  mRNA product Design1 comprising derived and/or modified sequence from Homo sapiens__NP_002145.3 __HsHSPA4 (opt5)
gggagaaagcuuaccaugagcguggucggcaucgaccugggguuccaguccugcuacguugccguggcuagagccggaggcauugagaccaucgcgaacgaauauucugaucgguguacacccgcuugcauuagcuuugggccuaagaaucgcuccaucggagccgccgcuaaaucucaagugauuagcaacgccaagaauacgguccagggcuucaaaagauuucacgggcgggcuuucuccgacccguuuguggaggccgaaaagucuaaccucgcguacgauaucguucagcugcccaccggacuuacaggcaucaaagugaccuauauggaggaagaacgcaauuucacaaccgagcaggucacagccaugcugcucagcaagcugaaggaaaccgcugaguccgugcuuaaaaagccuguuguggacugugucgugagcgugcccugcuuuuacacggaugccgaaagacggucugucauggacgcuacccaaauugccggccugaacugucuccgccugaugaaugagacaaccgcgguugcccuggcuuaugggaucuacaaacaggaucucccugcccuggaggaaaagcccagaaacgugguguucgucgacaugggacauuccgcuuaucaggugagcguuugcgccuuuaaucggggcaaacuuaaggugcuggccacagcuuucgauaccacgcucgggggacgcaaguuugacgagguccuggugaaccacuucugugaagaguuuggcaaaaaguacaaacuugauauuaagucuaaaaucagagcgcugcuccggcugucccaggaaugcgagaagcugaaaaagcucaugagcgccaaugcuucugaccugccucuuuccauugaguguuucaugaacgauguugacgugagcgggacaaugaaucgcggaaaguuccuggaaaugugcaacgaccuccuggccagagucgagccgccccuucgguccgugcuggaacaaaccaaacucaagaaagaggauaucuacgccgucgaaauugugggcggcgcuacacgcaucccugccguuaaggagaaaaucucuaaguuuuucgggaaggagcugagcaccacccugaaugcggacgaagcugugacaagaggaugugcccuccagugcgccauucugucccccgcuuuuaaaguccgggaguucagcaucacggaugugguuccuuaucccauuucucuuagauggaacuccccggccgaagagggcagcucugacugcgaaguguuuagcaagaaccaugcugccccuuucuccaaaguccugaccuuuuaccgcaaggagcccuucacacucgaggcguauuacucuagcccucaggaucugcccuaucccgacccugccaucgcucaguuuuccgugcaaaaagugaccccgcagagcgaugggucuuccagcaagguuaaggucaaagugcgggugaauguccacggaauuuucucuguguccagcgccucccuuguugaagugcauaagucugaggaaaacgaggagcccauggaaacagaccagaaugcuaaagaggaagagaagaugcaagucgaucaggaggagccucacguggaggaacagcagcaacagacccccgccgagaacaaagcggaaagcgaggaaauggagacgucccaggccggcucuaaggacaagaaaauggaucagccuccccaagcuaagaaagccaagguuaaaacaagcaccguggaccugccgaucgagaaucagcuccuguggcagaucgacagagaaaugcugaaccucuacauugagaaugaagggaagaugaucaugcaggauaaacuggagaaggaacgcaacgacgcuaagaaugccgucgaggaguauguguacgaaaugcgggauaaacuuuccggagaguacgaaaaguuuguuagcgaggacgauagaaacucuuucacccugaaacucgaggacacagaaaauuggcuguaugaggauggcgaagaccaaccuaaacagguguacgucgauaagcuggccgagcuuaagaaccucggccagcccauuaagauccgcuuucaggaauccgaggagcggccuaaacuguucgaggaacuggggaagcaaauucagcaguauaugaaaaucaucagcucuuucaagaauaaagaagaccaauacgaucaccucgacgcugcggauaugaccaagguggagaaguccacaaacgaagccauggaguggaugaauaacaaacugaaccuucagaauaagcagagccugacgauggaccccguggucaaaucuaaggagauugaagcuaaaaucaaggagcucaccagcacauguuccccuauuaucagcaagcccaaaccgaagguugaaccucccaaagaggaacagaagaacgccgagcaaaauggacccguggacggccagggggauaacccuggaccgcaggccgcugagcagggcaccgacacagccgugcccucugauuccgacaaaaagcugccugaaauggauauugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1899 - RNA, 2737 nt, Artificial Sequence
  mRNA product Design1 comprising derived and/or modified sequence from Homo sapiens__NP_055093.2 __HsHSPA4L (opt5)
gggagaaagcuuaccaugagcguggucggcaucgaccugggguuccucaacugcuacauugccguugcuagauccggaggcaucgagaccauugccaaugaauauucugaucgguguacacccgcgugcaucagccuggggucccgcacgagagcuauuggaaacgccgccaagucucagaucgugaccaaugugcggaacacaauccacggcuuuaaaaagcugcaugggcgcagcuucgacgauccuauuguccaaaccgagagaauccggcuuccguacgaacuccagaaaaugcccaauggauccgcuggcgugaagguucgcuaucuggaggaagagagaccuuuugccauugaacaggugacaggcaugcuucuggcuaaacucaaggagaccucugagaacgcccugaagaaacccgucgcggacugugugaucagcauuccuuccuucuuuacagaugccgaacggcgcagcguuauggcugccgcucagguggccgggcugaauugccucagacugaugaacgagaccacggcggucgcccuugcuuacggaaucuauaagcaagaccugcccccucucgaugagaaaccgcggaaugugguguucauugacaugggccacucugccuaccagguccugguuugugcuuuuaacaaggggaaacuuaaggugcuggccaccacauucgaucccuaucucggaggccgcaauuuugacgaagcccugguggauuacuucugcgacgaguuuaagaccaaauacaagaucaacgucaaagaaaauuccagagcucugcuccggcuguaucaggagugugaaaaacuuaagaagcugaugagcgcgaacgccucugaucucccucugaauaucgagugcuucaugaacgaccuugacguguccagcaaaaugaaccgcgcucaguuugagcaacugugugccucucuccuggccagaguugaacccccucugaaggcugugauggagcaggccaaucuccagcgggaagauauuuccagcaucgagauugucgggggagcgacaagaauccccgcugugaaggaacagauuaccaaauucuuccugaaggacaucuccacgacacuuaacgccgaugaggccguugcucgcggcugcgcccugcaaugugcuauccucucuccggccuuuaaagugcgggaguucagcauuaccgaccuggucccuuacuccaucacacuuagauggaagaccagcuuugaagauggcucuggggagugcgaaguguucugcaaaaaucaucccgcgccuuuuuccaaggucauuaccuuccacaagaaagagcccuuugaacuggaggccuucuauacaaaccuccaugaggugcccuacccugacgcucgcaucggcagcuuuacgauucagaauguuuucccgcagucugauggagacagcuccaaggugaaagucaaggugcggguuaacauccacgggaucuuuucuguggccagcgcuuccgucauugaaaaacaaaaucuggagggagaucacagcgacgcccccauggaaaccgagacaucuuucaagaacgagaauaaggauaacauggacaaaaugcaaguggaccaggaagagggccaucagaagugucacgcggaacauaccccugaggaagagaucgaucacacaggggccaaaaccaaguccgcugugagcgacaaacaggauagacugaaucagacgcucaagaagggaaaaguuaagucuauugaccugcccauccaguccagccuuugccgccagcugggccaagaucuccugaacuccuauauugagaaugaaggcaaaaugaucaugcaggacaagcuggagaaagaacggaacgaugccaagaaugcugucgaggaauacguguaugacuuuagagaucgccuugggacaguguacgagaaauucauuaccccugaggaccucucuaagcugagcgccguccuggaagauaccgagaacuggcucuacgaagacggagaggaucagcccaaacagguguauguugacaagcugcaagaacuuaagaaauacggccagccgauccagaugaaguauauggagcacgaggaacggccuaaagcccugaacgaccucgggaagaagauccagcuggugaugaaagucauugaggcuuacagaaauaaggaugaacgcuaugaccaucuggaucccacagagauggagaaaguggaaaaguguaucuccgacgcgaugucuuggcuuaacagcaaaaugaaugcccaaaacaagcucucccugacccaggauccuguugugaaggucagcgagauuguggcuaaaucuaaggaacuggacaauuucugcaaccccaucauuuacaaaccuaagcccaaagccgagguuccggaagauaagccuaaggccaauuccgagcacaacggacccauggacggccagagcgggacagagacgaaaucugauuccaccaaggacagcucucaacauacaaaaagcuccggcgaaauggagguggauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1900 - RNA, 2182 nt, Artificial Sequence
  mRNA product Design1 comprising derived and/or modified sequence from Homo sapiens__NP_005338.1__HsHSPA5 (opt5)
gggagaaagcuuaccaugaagcugagccucguggccgcuaugcugcuucugcucuccgccgcgagagcugaggaagaggacaaaaaggaagaugucggcaccguuguggggaucgaccugggaacaacguacucuugcgugggcgucuucaaaaacgggcggguggagauuaucgccaaugaucagggaaaccgcauuacccccagcuauguugccuuuacaccugaaggcgagagacuuaucggggacgcugccaagaaucaacugaccuccaacccggagaauacaguguucgaugcuaaacggcucauuggacgcaccuggaacgaccccucuguccagcaggauaucaaguuucugccuuucaaggugguugaaaagaagacaaaacccuacauccagguggacauuggcggcgggcaaaccaagacguuugccccugaggaaaucagcgcgaugguccugaccaaaaugaaggagacagccgaggcuuaucucggaaagaaagugacccacgccguggucacaguucccgcuuacuucaaugaugcccagagacaggcgaccaaggacgccggcacgauugcugggcugaacgugaugcggaucauuaaugaaccuacagccgcugccaucgccuauggacuugauaaacgcgagggcgaaaagaacauucugguguuugaccucgggggaggcaccuucgaugucucccugcuuacaaucgacaauggcguguuugagguuguggcuaccaacggggacacccaucugggaggcgaagauuucgaccagagagucauggagcacuuuaucaaacucuacaagaaaaagacagggaaggaugugcggaaagacaaucgcgcgguucaaaagcugagacgggagguggaaaaagccaagcgcgcucugucuagccagcaucaggccagaauugagaucgaauccuucuaugagggagaagauuuuagcgagacgcucacccgggccaaauucgaggaacugaacauggaccuuuuccgcucuacaaugaagccgguccagaaggugcuggaggauuccgaccucaaaaagagcgauauugacgaaaucguccuggugggcgggucuacccggauucccaaaauccaacagcuuguuaaggaguuuuucaauggaaaagaaccuuccagaggcaucaaccccgaugaggcuguggccuacggcgcggcuguccaggccggggugcugagcggagaccaagacacaggcgaucucguucugcuggacguguguccucucacccuggggauugagacggucggaggcgugaugacaaaacuuauccccagaaacaccgugguuccgaccaagaaaucucagaucuuuuccacagccagcgauaaucagccuaccgucacaauuaagguguacgaaggggagcgcccccugacgaaagacaaccaccuccugggcaccuucgaucuuacaggcauuccucccgcuccccggggagugccucagaucgaagucaccuuugagaucgacgugaaugggauucugagaguuacagccgaggauaagggaaccggcaacaaaaauaagaucacgauuaccaacgaccaaaaucgccucacaccggaagagaucgaacggauggugaacgaugcugagaaguucgccgaagaggacaaaaagcugaaagagagaauugauacccgcaaugaacuggaguccuaugcguacucucucaagaaccagaucggggacaaagaaaagcugggaggcaaacuuagcuccgaggauaaggaaacaauggagaaggccgucgaggagaaaauugaauggcuggaaagccaucaggacgcugacaucgaggauuuuaaggccaaaaagaaagaacucgaggagaucgugcagcccauuaucucuaagcuguauggguccgcuggcccucccccuaccggagaagaggacacggccgaaaaggaugagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1901 - RNA, 2149 nt, Artificial Sequence
  mRNA product Design1 comprising derived and/or modified sequence from Homo sapiens__NP_002146.2__HsHSPA6 (opt5)
gggagaaagcuuaccaugcaggcccccagagagcuggcugugggcaucgaccucgggaccacauacagcugcgucggaguuuuccaacagggccggguggaaauucuggccaacgaucaggggaaucgcacgaccccuuccuauguggcguuuacagacaccgagagacuugucggagaugcugccaagucucaggccgcucugaacccgcacaauacaguguucgacgccaaacggcucaucggccgcaaguuugcugauaccacaguucaaagcgacaugaaacauuggcccuucagaguggucuccgaagggggaaagccuaaagugcggguuuguuaccgcggcgaggauaagaccuuuuaucccgaagagauuucuagcauggugcuguccaagaugaaagagacggccgaagcguaccuuggccagccugucaagcacgccgugaucaccgugcccgcuuauuucaacgacucucagagacaggccacaaaagaugcuggggccauugcgggacugaauguccuccggaucaucaacgagccuaccgccgcugccauugcuuacggccuggaccgcagaggggccggagaacggaauguucugaucuuugaucucggcgggggaacauucgacgugagcgugcuguccauugaugccggcgucuuugaggugaaggcuaccgcgggcgacacgcaucuugggggagaggacuucgauaaccgccugguuaaucacuuuauggaagaguucagacggaaacauggcaaggaccucagcgggaacaagcgcgcccugagacggcuuagaacagcuugcgaacgcgccaaacggacccugucuuccagcacacaagccacccucgagaucgauucucuguuugaaggaguggacuucuauaccuccauuacaagagcucgcuucgaggagcuguguagcgaucucuuucggucuacgcuggaaccggucgagaaggcccuuagagacgcgaaacuggauaaggcucagauccacgacgugguucucgugggcggguccacccgcauucccaaaguccagaagcugcuucaggauuucuuuaauggaaaagaacugaacaagagcaucaauccugacgaggccguggccuacggcgcugccguccaagcugccgugcucaugggcgauaagugcgaaaaaguucaggaccugcugcuccuggacguggcgccccuuucccuggggcucgagacagccggaggcgucaugaccacacugauccagcggaacgcuaccauuccuacgaagcaaacacagaccuucaccacauacucugauaaucagcccgggguguuuauccagguuuaugagggagaaagagccaugaccaaagacaacaaccuucugggccgcuucgagcucagcgggauuccgccugcuccccggggcgugccucaaaucgaagucacauuugauauugacgccaauggaauccuguccgugacggcgaccgauagaagcacaggcaaggccaacaaaaucaccauuacaaaugacaaggggcgccugucuaaggaggaaguggagcggaugguucacgaggcugaacaguacaaagccgaggaugaagcucagagagaccgggucgccgccaagaacucccucgaggcucauguguuccacgugaaaggaagccugcaggaggaaucucuucgcgauaagauccccgaggaagacagacggaaaaugcaagauaaguguagagagguccuggcguggcucgaacauaaucagcuggccgagaaggaggaauaugagcaccagaaacgcgaacuggagcagauuugccggcccaucuuuagcagacuuuacggcgggccuggagugccgggcggguccucuuguggcacccaagcucgccagggagaccccagcacgggcccuauuaucgaagagguugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1902 - RNA, 1321 nt, Artificial Sequence
  mRNA product Design1 comprising derived and/or modified sequence from Homo sapiens__P48741__HsHSPA7 (opt5)
gggagaaagcuuaccaugcaggcccccagagagcuggcugugggcaucgaccucgggaccacauacagcugcgucggaguuuuccaacagggccggguggaaauucuggccaacgaucaggggaaucgcacgaccccuuccuauguggcguuuacagacaccgagagacuugucggagaugcugccaagucucaggccgcucugaacccgcacaauacaguguucgacgccaaacggcucaucggccgcaaguuugcugauaccacaguucaaagcgacaugaaacauuggcccuuccagguggucuccgaagggggaaagccuaaagugagaguuuguuaccggggcgaggauaagaccuuuuaucccgaagagauuucuagcauggugcuguccaagaugaaagagacggccgaagcguaccuuggccagccugucaagcacgccgugaucaccgugcccacauauuucucuaacagccagcgccaagcuaccaaagacgccggggcuauugccggacugaagguccucccuaucaucaaugaggcgacagccgcugccauugcuuacggccuggauagacgcggggccggaaaacggaacguucugaucuuugaccucggcgggggaaccuucgauguguccgugcugagcauugacgccggcgucuuugaagugaaggcuacggcgggcgauacacaucuugggggagaggacuucgacaauagacugguuaaccacuuuauggaggaguuccggcgcaagcauggcaaagaucucucugggaauaagagagcccugcggcgccuuagaaccgcuugcgagcgggccaaaagaacaccguccagcucuacccaggccacccuggaaaucgacucccucuuugagggaguggauuucuauaagagcauuacacgcgcucgguucgaagaacuguguucugaccuguuuagauccacgcucgagcccgucgaaaaagcccugcgcgaugcgaaacuugacaaggcucagauccacgauuucgugcugggcgggggacuccacagccauccucagggcgccgagguugccgcuggccugcuucaacggcagggggccgaacaggagcaccaacccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1903 - RNA, 2158 nt, Artificial Sequence
  mRNA product Design1 comprising derived and/or modified sequence from Homo sapiens__NP_006588.1 __HsHSPA8 (opt5)
gggagaaagcuuaccaugagcaagggccccgccguggggaucgaccugggaaccacauacuccugcgucggcguuuuccagcacgggaaaguggagauuaucgcuaacgaucaaggaaauagaacgaccccuucuuauguggccuuuacagacaccgaacggcucauuggcgaugcggcuaagaaccaggucgccaugaauccgacaaacaccguguucgacgccaaacgccugaucgggagacgguuugaugacgcuguugugcagagcgauaugaagcauuggcccuucauggucgugaaugacgccggacgcccuaaaguucagguggaguacaagggcgaaacaaaguccuuuuaucccgaggaagucucuagcauggugcuuaccaaaaugaaggagauugcugaggccuaccugggcaaaacggugaccaacgcggucguuacagugccugccuauuucaaugauucccaaagacaggcuaccaaggacgccgggacaaucgcuggacucaacgugcugcggaucauuaaugaacccaccgccgcggccaucgcuuacggccuugauaaaaaggucggggccgagcgcaacgugcugauuuuugaccucggaggcgggacguucgauguuucuauccugacaauugaagacggaaucuuugaggugaagucuaccgcuggcgacacacaccugggcggggaggauuucgacaauagaauggucaaccauuuuauugccgaauuuaaacggaagcacaaaaaggauaucuccgagaauaaacgcgccgugagacggcuccgcaccgcuugugaaagagcgaagcggacccugagcagcuccacacaggccagcaucgagauugacucucuuuaugaaggaaucgauuuuuacacguccauuacccgcgcuagauucgaggagcugaacgccgaccucuuccggggcacacuggauccuguugaaaaagcccuuagagacgcuaagcuggauaagagccagauccaugacauugugcucgucgggggaucuacccgcaucccgaaaauccaaaagcugcugcaggauuucuucaauggcaaagagcucaacaaguccauuaaccccgacgaagccguggcguacggggcugccguccaggccgcuauccugagcggagacaaauccgagaaugugcaggaucuucugcuccuggacguuacaccucuuucucugggcauugaaaccgccggcggggugaugacgguccucaucaagcggaacacaaccauucccaccaagcaaacacagaccuuuacaacguauagcgauaaucagccuggagugcugauccaaguuuacgagggcgagagagcuaugaccaaagacaacaaucugcucgggaaguucgaacugacaggaaucccgcccgccccucgcggcgugccccagauugaggucaccuuugauaucgacgcgaacgggauucuuaauguguccgccguggauaaaagcacaggcaaggaaaacaaaaucaccauuacgaaugacaagggacggcugucuaaggaggauaucgaaagaaugguucaggaggcugagaaauauaaggccgaagacgagaaacagcgcgauaaggucuccagcaaaaacucucucgaaagcuacgcuuucaauaugaaggccaccguggaggacgagaagcugcaaggcaaaauuaacgaugaagacaagcagaaaauccuugacaagugcaaugagaucauuaacuggcuggauaaaaaucagacagcggaaaaggaggaauuugagcaccagcaaaaagagcucgaaaagguguguaacccuaucauuaccaagcuguaucaguccgccgggggaaugcccggcgggaugcccggaggcuucccugggggcggagcuccgcccucuggcggggccagcuccggaccuacaaucgaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1904 - RNA, 2257 nt, Artificial Sequence
  mRNA product Design1 comprising derived and/or modified sequence from Homo sapiens__NP_004125.3 __HsHSPA9 (opt5)
gggagaaagcuuaccaugaucagcgccuccagagcugccgcggcucggcuggugggcgccgccgcuucucgcgggcccaccgccgcuagacaccaggacagcuggaacggacucucccaugaggccuuccggcuggucucucgcagagauuacgcgagcgaagccauuaagggcgcuguuguggggaucgaccuuggaacaacgaauagcugcguggccgucauggagggcaaacaagcuaaggugcuggaaaacgccgagggggcgcggaccacaccuucuguuguggccuuuaccgcugauggagaacgccucgucggcaugccggccaaaagacaggcugugacaaaucccaacaauaccuucuaugccacaaagcggcugauuggccgcagauacgacgauccugagguucagaaagacaucaagaacgugcccuuuaagauuguccgggccagcaauggggaugcuuggguggaggcgcacggaaaacuuuauuccccuagccagaucggcgccuucgugcugaugaagaugaaagaaaccgcugagaacuaccucgggcauacggccaagaaugccgucaucaccguucccgcuuauuuuaacgacucucaacgccaggccacaaaagaugcgggacagauuuccggccugaaugugcugagagugaucaacgaaccuaccgcugccgcccucgcuuacgggcuggacaagagcgaggauaaggucauugccguguaugaccuuggaggcggcacauucgauaucucuauucuggagauccagaaagggguuuuugaagugaaguccaccaauggagacacguuccucggcggggaggacuuugaucaagcucugcuucggcacauugucaaagaguucaagcgcgaaacaggaguggaccugaccaaagauaacauggcccuccagagaguucgggaagcggccgagaaggcuaaaugugagcuguccucuuccgugcagacagacaucaaucugccguaccucaccauggauagcuccggccccaagcaucugaacaugaaacuuaccagagcccaguuugaagggaucgucacagaccugauucgccggacgaucgcuccuugccaaaaggccaugcaggaugcggaggugucuaagagcgacauuggagaagucauccucgugggcggcaugaccagaaugcccaaaguucagcaaacagugcaggaucuguucgggcgcgccccuuccaaggcugucaaccccgacgaggccguggcuauuggagccgccauccagggcgggguucuugcuggagaugugaccgacguccugcuccuggacgugacaccgcugagccucggcaucgaaacccugggcggcguguuuacgaaacuuauuaaucggaacacaaccaucccuaccaagaagucucagguuuucuccacagcggccgauggacaaacccaggucgagauuaaagugugucagggcgagagagaaauggcuggggacaauaagcugcucggacaguucacacugaucggcauucccccugcuccccgcggggugccccaaaucgaggucacguuugauaucgacgccaacggaauugugcacguuagcgccaaagauaagggcaccgggcgggaacagcagaucgugauucagucuagcggcggacuuuccaaagacgauaucgagaauauggucaagaacgccgaaaaguacgcggaggaggacagacgcaaaaaggaacggguggaggcuguuaauauggccgaaggcauuauccacgauacagagaccaaaauggaggaguucaaggaccaacugccugccgaugaaugcaacaaacucaaggaagagauuucuaagaugagagaacugcuggcucgcaaagacagcgagacaggggagaauauccggcaggccgcguccagccuccagcaggcuucucugaaacuuuuugaaauggccuauaagaagauggccuccgagagagaaggaagcgggucuuccgggaccggagagcaaaaagaagaucagaaggaggagaaacagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1905 - RNA, 2245 nt, Artificial Sequence
  mRNA product Design1 comprising derived and/or modified sequence from Homo sapiens__NP_079291.2__HsHSPA12A (opt5)
gggagaaagcuuaccauggccgacaaggaggcuggcgggagcgauggacccagagaaaccgccccuacauccgcguacucuagcccggcucggucccugggcgacacggggaucacaccccucucuccuagccacauugugaacgauaccgacuccaaugucucugagcagcagagcuuccugguugugguggccgucgauuuuggaaccacauccagcggcuaugccuacucuuucaccaaagaacccgagugcauccaugugaugcgcagaugggaagggggagacccuggcguuuccaaccaaaagacacccaccacgauucuucugaccccugagcggaaauuucacagcuucggcuaugcugcccgcgauuuuuaccaugaccucgauccgaaugaggcuaagcaguggcuguaucuugaaaaauucaagaugaagcugcacacaaccggggaccucacaauggauaccgaccugacggccgcgaacggcaaaaaggugaaagcccuggagaucuuugcuuacgcccuccaguauuucaaggaacaagcucugaaagagcuuucugaucaggccggauccgaguuugaaaauagcgacgucagaugggugauuacaguucccgcgaucuggaagcagccugccaagcaguucaugcggcaagcugccuaccaggcugggcuggccucucccgagaacuccgaacagcucaucauugcccuggagccugaagcugcgagcaucuacugucgcaaacuuagacugcaucagaugauugagcucuccucuaaggccgcugugaauggauauagcggcuccgacaccgucggggccggauuuacacaagccaaagagcacauccggcgcaacagacagagccggaccuuccugguggaaaaugugauuggcgagaucuggucugaacuggaggaaggcgauaaguacgucguuguggacuccgggggaggcaccguggaucucacaguccaccagauucgccugcccgaggggcaucuuaaagagcuguauaaggcuacgggaggcccguacgggagccucggaguggacuaugaauuugagaaacugcuuuacaagaucuucggcgaagauuucaucgagcaauuuaagauuaaaagaccugccgcguggguugaccugaugaucgcuuucgaaucucggaagcgcgccgccgcucccgauagaaccaacccucucaauauuacacugcccuuuagcuucaucgacuauuacaaaaaguuucggggccacuccguggagcaugcccugagaaaaucuaacgucgauuucgugaaguggagcucccaggggaugcuccgcaugagccccgacgcuaugaaugcccuguuuaagccuaccauugauucuaucaucgagcaccuucgggaccuguuccagaaaccggaaguuuccacagugaaguuucucuuccuggucggaggcuuugcggaggcuccccuucugcagcaagccgugcaggccgcuuucggggaccagugcagaauuaucauuccucaggaugucggacucaccauccugaaaggcgccgugcuguuugggcucgaccccgcgguuauuaaggugcgccggagcccucugacguacggcgucggagugcuuaacagauauguugaaggcaaacaucccccggagaagcugcucgugaaggaugggacacgcugguguaccgacgucuucgauaaauucaucucugccgaccaauccguggcucugggagagcuggugaagcggagcuacaccccugccaaacccucccagcuuguuaucgucauuaauaucuauucuagcgaacacgauaacguguccuuuauuacagacccuggcgugaagaaaugcgggacccucagacuggaucugacaggaacgucuggcaccgcuguccccgcccgccgggagauccagacacucaugcaguucggggacaccgaaauuaaggccacagcuaucgauauugcgaccagcaaguccgugaaaguuggcaucgacuuucugaacuacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1906 - RNA, 2278 nt, Artificial Sequence
  mRNA product Design1 comprising derived and/or modified sequence from Homo sapiens__NP_443202.3 __HsHSPA12B (opt5)
gggagaaagcuuaccaugcuggccgugcccgagaugggccuccaggggcuguacaucggaagcuccccugaaagaucuccgguccccagcccucccggcuccccucggacccaagagucuugcgggauugcuccccuuacaccuagccaguccccgaagcccgaaguucgcgccccucagcaggcgucuuucagcgugguggucgcuaucgacuuuggaacgaccuccagcggcuaugccuucucuuuugccuccgaucccgaggcuauucacaugaugagaaaaugggaagggggagacccuggcguggcccaucaaaagacacccaccugucugcuccugacaccggagggcgcuuuccacagcuuuggguacaccgcccgggauuauuaccaugaccuugauccugaggaagcgcgcgacuggcuguauuucgagaaauuuaagaugaaaauccacucugccacagaucucacccugaagacgcagcuggaagcuguuaacggaaagaccaugcccgcccucgagguguucgcucaugcccugagauuuuuccgggagcacgcgcuucaggaacugcgcgagcaguccccuagccuccccgaaaaagacacagucagaugggugcugaccguucccgccauuuggaagcaaccugcuaaacaguuuaugcgggaggccgcuuaccuugccggccuggugucucgcgaaaaugccgagcagcuccugaucgcucuggagccggaagcggccuccgucuauugcagaaagcuccggcugcaccagcuucuggaucucagcgggcgcgcucccggaggcgggagacugggagagcggcgcuccaucgacucuagcuucagacaagcccgggaacagcuuagacgcucccggcauagcagaacauuucugguggagucuggcgugggcgaacucugggccgagaugcaggcuggggaucgcuacgucguugccgacuguggaggcgggaccguggaucugacggugcaccaacuggagcagccucauggaacacucaaagaacuguacaaggcguccggcgggcccuauggagcugucggcguggaccuugccuucgagcagcugcucugccggauuuucggcgaagacuuuaucgccaccuucaagagacagcgcccugcugccuggguugaucugacaauugcuuuugaggcccggaaaagaaccgcggggccccaccgcgccggagcucuuaacaucagccugccguucucuuuuauugacuucuaccggaagcaaagaggccacaauguggaaaccgcccuccgccggagcuccgucaacuuugugaaauggucuagccaggggaugcugagaauguccugugaggcuaugaaugagcuguuccagccuacaguuagcggaaucauucagcauaucgaagcccuccuggcgcggcccgaggugcaaggcgucaaacuucuguuucucgucgggggcuucgccgaaucugcugugcugcagcacgccgugcaggcugcccugggagcccgcggccuuagaguuguggucccucaugauguggggcucacgauccugaagggagcuguucuguuuggccaggcgcccggggugguccgggugagacgcuccccucucaccuauggagugggcguucugaaccgguucguccccgggagacacccgccugagaaacuucuggugcgcgacggcagacgguggugcacagauguguuugagcgcuucgucgccgcugaacaaagcguggcccucggagaggaaguuagacggucuuacugucccgcccgccccggccagagacgggugcugauuaaucuguauugcugugcugccgaggacgcgcgcuucaucaccgauccuggggucagaaagugcggagcucuuucccucgaacuggagccggccgacuguggccaggauacagccggggcucccccuggacggcgcgagauuagagccgcgaugcaguuuggcgacaccgaaaucaaggugacggcuguugaugugagcacaaaccgguccgucagagccucuauugacuuccugagcaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1907 - RNA, 1633 nt, Artificial Sequence
  mRNA product Design1 comprising derived and/or modified sequence from Homo sapiens__NP_008879.3__HsHSPA13 (opt5)
gggagaaagcuuaccauggccagagagaugaccauccugggcagcgcugugcucacacugcuucuggccggguaccucgcgcagcaauaucugccccuuccuacgccgaaggucauuggaaucgaccugggcaccacauacugcuccguugggguguucuuucccggaaccggcaaagugaaggucauuccugaugaaaacgggcacaucucuauucccagcaugguguccuucacagacaaugauguuuaugugggauacgagucugucgaacucgcugacagcaacccucagaauaccaucuaugaugccaaacgguuuaucggcaagauuuucacagccgaggaacuggaggcugagaucggccgcuaccccuuuaaagugcugaacaagaaugggaugguugaguucuccgugaccucuaacgaaacgauuaccgucagcccugaauaugugggauccagacuccugcuuaagcugaaagagauggccgaggcuuaccucggcaugccgguggccaaugcggucaucagcguucccgccgaauuugaccugaagcagcggaacucuacaauugaggcugccaaucuugcugggcugaaaauccuccgcgugauuaacgaaccuaccgccgcggccauggcuuacggacugcauaaggccgauguguuccacguccuggugaucgaccucggcgggggaacacuggauguuucccuucugaauaaacagggcggcauguuucucaccagagcuaugagcgggaacaauaagcugggaggccaagacuucaaccagcggcuucugcaguaucucuacaagcagaucuaucaaacguacggguuugugcccucucgcaaagaggaaauucauagacugcggcaggccgucgagauggugaagcugaaucucacacugcaccaguccgcccagcuuagcguucugcucaccguggaggaacaagaucgcaaagagccucauucuuccgacacagaacugcccaaggauaaacuuagcuccgcugacgaccacagagucaacucuggauucggccgggggcugagcgauaagaaauccggagagagccaggugcucuuugaaaccgagaucucucgcaagcuguucgacacccugaacgaggaucucuuccagaagauucuggucccgauccaacaggugcuuaaagaaggccaccuggagaagacagaaauugacgagguugugcucgucggcggguccacgagaaucccucggauccgccaggugauucaggaauuuuucggaaaagaucccaauaccagcguugacccugaucuggcgguggucacaggcguggccauccaagcugggauugacggaggcucuuggccccuucaggugagcgcccuggagauccccaacaagcaucuccagaaaaccaauuuuaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1908 - RNA, 1747 nt, Artificial Sequence
  mRNA product Design1 comprising derived and/or modified sequence from Homo sapiens__NP_057383.2__HsHSPA14 (opt5)
gggagaaagcuuaccauggccgcuaucggcguccaccuggggugcaccagcgccugugucgcgguuuacaaggacggcagagcuggagugguggccaacgaugccggggaccgggucacacccgcugugguugccuauuccgagaaugaagagauugugggacucgcugccaaacagucucgcaucagaaacauuagcaauacggucaugaaggugaaacaaauccugggccgguccucuagcgauccucaggcgcagaaguacauugccgaauccaaaugccuuguuaucgagaagaacgggaagcugcgcuaugaaaucgacaccggagaggagacaaaauucgugaauccggaagaugucgcuagacucaucuuuucuaagaugaaagagaccgcccauagcgugcugggcuccgacgcuaacgauguggucauuacaguucccuucgacuuuggcgaaaagcagaaaaaugcccuuggggaggcggcccgggcugccggauucaacgugcugcgccucauucacgagccuagcgcugcccugcuggccuacggcaucgggcaagauucucccaccggaaaguccaauauucucguguuuaagcugggcgggacaagccuuucucuguccgucauggaagugaacagcggaaucuauagaguucucucuaccaauacggacgauaacauuggcggcgcucauuucaccgagacacuggcgcaguaccuugccuccgaauuucagcggagcuucaaacacgacgugcgcgggaaugcuagagccaugaugaagcugaccaacuccgccgaggucgcuaaacauucucucagcacacugggauccgccaauuguuuucuggauagccucuaugaaggccaggacuucgacugcaacgugucucgggcgcgcuuugagcugcuuuguuccccucuguucaacaagugcaucgaggcuaucagagggcuccuggaucaaaauggauuuaccgccgacgauauuaacaaaguugugcuuuguggcgggagcucucggauccccaagcugcagcagcucauuaaagaccuguucccugccgucgaacugcucaauagcaucccgcccgaugaggugauuccuaucggagcugccaucgaagcuggcauucugaucggcaaggagaaccuucuggucgaagacucccucaugauugagugcucugcccgcgauauccuggugaaggggguugacgagagcggagcguccagauucacggugcuuuuucccagcggcacaccucugcccgcccggagacagcacacccuccaagcuccggggucuauuuccagcgucugucuggaacuguacgagucugauggcaaaaauuccgccaaggaagagacaaaauucgcucaggugguucuccaggaccuggauaagaaagaaaacggacuucgcgacauccuggccgugcucaccaugaagcgggacgggagccugcacgugaccugcacagaucaagagacgggcaagugugaggcgaucuccauugaaaucgccucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1909 - RNA, 2794 nt, Artificial Sequence
  mRNA product Design1 comprising derived and/or modified sequence from Homo sapiens__NP_006635.2 __HsHSPH1 (opt5)
gggagaaagcuuaccaugagcguggucggccuggacguugggucccagucuugcuacaucgccguggcuagagccggaggcauugagaccaucgcgaacgaauuuagcgaucgguguacacccuccgugauuucuuuugggagcaagaaucgcacgaucggagucgcugccaaaaaccaacagauuacccacgccaauaacacaguguccaauuucaagagauuucauggccgggcuuucaacgacccuuuuauccagaaagagaaggaaaaucucucuuaugaucugguuccgcuuaaaaacgggggagugggcaucaaggucauguacaugggcgaggaacaccuguucagcguggagcagauuaccgccaugcuccugacaaaacuuaaagagaccgcugaaaauucccugaagaaacccguuacagacugcgugaucagcgucccuucuuucuucaccgaugccgagcgcagauccgugcucgacgcggcccaaauuguggggcugaacugucugcggcucaugaaugauaugacggcugucgcccugaacuauggaaucuacaagcaggaccuucccagccuggaugaaaaaccucgcauuguuguguuuguggacaugggccauucugcuuuccaggucuccgccugcgcguuuaauaaggggaagcucaaagugcugggaaccgccuucgaucccuuucuuggcgggaagaacuucgacgagaaacugguugagcacuucugugcugaauuuaagacaaaauauaagcucgaugccaaaagcaagaucagagcucugcugcggcucuaccaggagugcgaaaagcugaaaaagcugaugucuuccaauagcaccgaccuuccucucaacauugaguguuucaugaacgacaaagauguguccggaaagaugaaucgcucucaauuugaggaacugugcgccgagcuucugcagaaaaucgaagucccgcucuauagccugcuggagcagacacaucucaagguggaagacguuuccgccguggagaucgucggcggcgcuacccggauucccgcggugaaggaaagaaucgccaaauucuuugggaaggauauuagcacgacacugaacgcugacgaggccgucgcccgcggaugugcccuucagugcgcuauccugucuccugcguucaaagugagagaguuuuccguuaccgaugcugugcccuucccuauuagccucaucuggaaucacgacucugaagauacagagggcguccacgaaguguuuagccggaaccaugccgcccccuucuccaagguucugaccuuucuucgcagagggccguucgagcuggaggcuuuuuacucugacccucaaggagugcccuacccugaagccaaaaucggccgguucgucgugcagaaugugagcgcucagaaggauggggagaaguccagaguuaaagucaaggugcgcgugaacacccacggaauuuucacaaucagcacggccucuauggucgaaaaagugcccaccgaggaaaaugagauguccagcgaggcggacauggaaugucucaaccaacggcccccugagaauccggauacagacaagaacguucagcaggacaauucugaagccggcacccagccccaagugcagacagaugcucagcagaccucccaaagcccucccuccccugagcugacgucugaagagaacaaaauucccgacgccgauaaggcuaaugagaagaaagucgaccagccgccugaagccaagaaacccaagaucaaagugguuaacguggagcugccuauugaagcgaaucucgucuggcagcugggcaaggaucuucugaacauguauaucgagacagaagggaaaaugaucaugcaggacaagcucgagaaggagagaaacgaugccaaaaaugcuguggaagaguacguuuaugaauuucgcgacaagcugugcggacccuacgagaaauucauuugcgaacaagaucaucagaacuuucugcggcuucucaccgagaccgaggacuggcuguaugaagagggcgaagaucaggccaagcaggcuuacguggacaaacuggaggagcucaugaagaucgggacaccugucaaggugagauuccaagaagccgaggaacgccccaaaauguuugaggaacugggacagcggcuucagcacuaugccaagauugcugcggauuucagaaauaaagacgagaaguacaaccacaucgacgagagcgaaaugaaaaagguggagaaguccgucaaugaaguuauggaguggaugaacaaugugaugaacgcccaagcuaaaaagucucuggaucaggacccggugguccgcgcccaggaaauuaaaaccaagaucaaagagcucaauaacacaugugagccugugguuacgcagcccaagcccaagauugaaagcccuaaacuggagcggaccccgaauggccccaacaucgauaagaaagaagaggaccuggaagauaagaauaacuuuggggccgagccuccccaucaaaauggcgagugcuacccuaacgaaaagaacuccgugaauauggaccuugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1910 - RNA, 3217 nt, Artificial Sequence
  mRNA product Design1 comprising derived and/or modified sequence from Homo sapiens__NP_006380.1 __HsHYOU1 (opt5)
gggagaaagcuuaccauggccgacaaggugagacggcagcgccccagacggcgcgucugcugggcucugguugccgugcuccuggcggaucuucuggcucucagcgacacccuggccgugauguccgucgaucuuggcucugagagcaugaaaguggccaucguuaagccuggggugccgauggaaaucguccugaacaaagaguccagacggaagacacccgugaucguuacgcucaaagaaaaugagcgcuucuuuggagacucugcugccagcauggcuauuaagaacccuaaggccacccugagauacuuccaacaucugcucggcaaacaggcggauaauccccacguggcccuguaucaggcucgguuuccugaacacgagcuuacauucgacccccagcgccaaaccguccauuuucagaucuccucucagcugcaguucagcccugaggaagugcucgggauggugcugaacuacuccagaagccuugccgaggauuuugcugaacaaccgauuaaggacgccgucaucacaguucccguguucuuuaaucaggcggagcggcgcgccgugcugcaggcugccagaauggcuggacucaaaguccugcagcugaucaacgauaauaccgccacagcccucucuuauggcguguuccggcgcaaggacauuaacaccacggcucaaaauaucauguuuuacgauaugggguccggaagcaccguuuguacaauugugaccuaucagauggucaaaacaaaggaggcgggcaugcagccucaacugcagaucagaggcgugggguucgaccggacccuuggaggccuggaaauggagcucagacugcgcgaacggcuugccgggcuguuuaacgagcagagaaagggacagcgcgcuaaagauguucgggaaaaucccagagccauggccaagcuccugcgcgaggcuaaccggcugaaaacggugcucucugccaaugcggaccacauggcucaaauugagggccugauggacgaugucgacuucaaggccaaagugacaagagucgaguucgaggaacuuugcgccgaucuguuugagcgcgugccugggcccguucagcaggcucuccaguccgccgaaaugagccuggacgagaucgagcaagugauucuugucggaggcgcuacccgggugccgagaguucaggaagugcugcucaaggccgucggcaaagaggaacuggggaagaacaucaaugcggaugaggccgcugccaugggagcuguguaccaggccgcggcccugucuaaggcuuucaaagugaagccuuuuguuguccgcgacgccgugguguaucccauccucgucgaguucacacgggagguggaggaagaaccuggcauucauucccugaaacacaacaagagaguucuuuuuagccggauggggcccuacccccagcgcaaagugaucaccuucaacagauacucccacgauuuuaauuuccauauuaacuauggagaccugggcuuucucgggccugaagaucugcgggucuucggaucucaaaaucugaccacagugaagcucaagggcguuggcgacagcuuuaaaaaguacccggauuaugaguccaaagggaucaaggcucacuucaaccucgacgagagcggagugcugucucuggacagagucgaauccguguuugagacgcucguugaagauagcgccgaggaagagucuacccugacaaaacuuggcaauaccauuagcucccuguucgggggaggcacaacccccgacgccaaggagaacgggacggauacagugcaggaagaggaagagucuccugcugaaggcagcaaggacgagcccggagagcaggucgaacucaaagaggaagcggaggccccuguggaagauggcucccagcccccgccucccgagccuaagggggacgcuacccccgagggagaaaaagccaccgagaaggaaaauggcgauaaaagcgaggcccaaaagccuucugagaaggcugaagccgggcccgagggaguggcgccggcuccugaaggcgagaaaaagcagaaacccgcccgcaagcggagaauggucgaagagaucgggguugagcugguggugcuggaccuucccgaucucccugaagacaaacuggcccaguccguccaaaagcugcaggaucucacacugcgcgaccuugagaaacaggaaagagagaaggcugccaacagccuggaagcguucaucuuugagacccaggauaagcucuaccaaccggaguaucaggaagugucuacagaggaacagcgggaggaaauuuccggcaaacugagcgcugccuccacguggcuggaggacgagggaguuggcgccaccacagugaugcuuaaggaaaaacucgcugagcugcgcaagcugugucaggggcuuuucuuuagagucgaagaacggaaaaaguggcccgagcgccugucugcccuugacaaucugcucaaccauagcuccauguuccugaagggagcuagacugaucccugaaauggaucaaauuuuuaccgagguggaaaugacaacccuugagaaaguuaucaaugaaacgugggccuggaagaacgcgacccucgccgagcaggcuaaacugcccgccacagagaagccugugcugcucucuaaagacauugaagcuaagaugauggcccuggaucgggagguccaguaccuucugaauaaggccaaauucaccaagccccgcccuagacccaaagacaagaacggcacacgggcugaaccgccucucaaugcgagcgccuccgaucagggggagaaagugauucccccugcuggacaaaccgaagacgccgagcccaucagcgagccggaaaagguugagacgggcucugaaccuggggauacagagccccuggaacugggcggaccuggcgccgagcccgagcagaaggaacaguccaccgggcaaaaacgcccccuuaagaacgacgagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1911 - RNA, 2416 nt, Artificial Sequence
  mRNA product Design1 comprising derived and/or modified sequence from Homo sapiens__NP_005339.3 __HsHSP90AA1 (opt5)
gggagaaagcuuaccaugcccgaggaaacccagacacaagaccagcccauggaggaagaggaaguggagacguucgccuuucaggcugagaucgcccagcugaugagccucauuaucaacaccuucuacuccaauaaggaaauuuuucugagagagcuuaucucuaacagcuccgaugcgcuggacaaaauucgguaugaaucucucacagauccgagcaagcuggacuccggcaaagagcuucacaucaaucugauccccaacaagcaagaucgcacccucacaauugucgacaccgggaucggaaugacaaaagcugaucugauuaauaaccugggcaccaucgccaagucugggacgaaggccuucauggaggcucuccaggccggagcugacauuagcaugaucggccaguuugggguuggauucuacuccgccuaucugguggcggaaaaagugaccgucauuacaaagcauaaugaugacgagcaguacgccugggaaagcucugcuggcggcuccuuuaccgugagaacagauaccggggagccuaugggacggggcacgaaaguuauccuucaccugaaggaagaccaaacagaguaucucgaggaacgcagaaucaaagagauugugaagaagcauagccaguucaucggguaccccauuacccuguuugucgaaaaagagcgggauaaggaagugucugacgacgaggccgaggaaaaagaggauaaggaagaggaaaaagagaaggaggaaaaagaguccgaagacaagccugagaucgaggauguuggaagcgacgaagaggaagagaagaaagauggcgacaagaaaaagaaaaagaagauuaaagaaaaguauaucgaucaggaggagcuuaacaaaacaaagcccaucuggacccgcaauccugacgauauuaccaacgaagaguacggggaguucuacaaaucucugacaaaugacugggaggaucaccucgcugugaagcauuuuuccgucgaaggacagcuggaguucagagcccugcucuuugugccgcggcgcgcgcccuucgaccuguucgagaacagaaagaaaaagaauaacaucaaacuuuaugugcggcgcgucuuuauuauggacaauugcgaagaacugaucccugaauaccucaacuucauuagaggcguuguggauagcgaggaccugccccuuaacaucucccgggaaaugcugcaacagucuaagauccucaaagugauucgcaagaaucuggucaagaaaugucuggagcucuuuacggagcuggccgaagauaaggagaacuauaaaaaguucuacgaacaguuuagcaaaaauaucaaacuuggcauucacgaggacucccaaaacagaaagaagcugagcgagcuccugcgguauuacaccucugcuuccggggaugaaauggugagccuuaaggacuauugcacaagaaugaaagagaaucagaagcacaucuacuacauuaccggagaaacaaaagaucagguugccaacucugcuuucguggagcgccugcggaagcauggccucgaagucaucuauaugauugagccuaucgacgaguacugugugcagcaacugaaagaauuugaggggaagacccugguuagcgugacgaaggaaggacucgagcugcccgaagaugaggaggagaaaaagaaacaggaagaaaagaaaacaaaguucgagaaucuuugcaagaucaugaaagacauucuggaaaagaaagucgagaagguggucguguccaacagacucguuaccucuccguguugcaucgugaccagcacauauggcuggaccgccaauauggagcgcauuaugaaagcccaggcucugcgggauaacuccacaaugggguacauggcggccaagaagcaccuggaaaucaauccugaccauagcauuaucgagacgcuuagacagaaagcugaagccgauaagaacgacaaaucugucaaggaccucgugauccugcuguaugagaccgcccuccuguccagcggauuuucucuugaggauccccaaacacacgcuaaucgcauuuaccggaugaucaaacugggccucggcauugacgaagaugacccuaccgccgaugacacauccgcggcuguuaccgaggaaaugccuccccuggagggggaugacgauacgagcagaauggaagagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1912 - RNA, 556 nt, Artificial Sequence
  mRNA product Design1 comprising derived and/or modified sequence from Homo sapiens__NG_005218__HsHSP90AA3P (opt5)
gggagaaagcuuaccauggacagcuccaagcuggauucuggcaaagggcuccacaucaaccuggugcccaauaagcagaaccaaacccuuacaauugucgacacgagaaucggaaugaccaaaacagaucugauuaauaaccucggcaccguuacaaagagcgggaccaaagccuucauggaggcucugcaggccgacgcggauaucuccaugauuggacauuuuggcgugggguucuacucugcuuaucuuguggccaagaaggucacagugaucagcaaacacaauaacgacgaacaguacaccugggaguccucugccggaggcagcuuuacgguucggaccgaugaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1913 - RNA, 2392 nt, Artificial Sequence
  mRNA product Design1 comprising derived and/or modified sequence from Homo sapiens__NP_031381.2__HsHSP90AB1 (opt5)
gggagaaagcuuaccaugcccgaggaagugcaccauggcgaggaagaggucgaaaccuucgccuuucaggcugagaucgcccaacugaugagccucauuaucaacacauucuacuccaauaaggagauuuuucugagagaacuuaucucuaacgcgagcgacgcucuggauaaaauucgguaugagucccucacggacccuucuaagcuggauagcgggaaagaacuuaagaucgacaucauuccgaauccccaggagcgcacccugacacucguugauaccggaaucggcaugacaaaagccgaccugauuaacaaucuggggaccaucgccaaguccggaacaaaggcuuucauggaggcccuccaggcuggcgccgauauuucuaugaucgggcaguuuggagugggcuucuacagcgcguaucugguggccgaaaaagucgugguuauuaccaagcacaacgacgaugagcaauacgcuugggaauccagcgccggcgggucuuuuacggugagagcugaccauggagagccuaucggccgggggaccaaagucauccuucaccugaaggaagaucagacagaguaucucgaggaacgcagagugaaagagguugugaagaagcauucccaguucauuggauaccccaucacccuguaucuugaaaaagagcgggaaaaggagauuagcgacgaugaggccgaagaggaaaaaggcgagaaggaagaggaggacaaagacgaugaagagaagccuaaaaucgaagacgucgggucugaugaggaggacgauuccggaaaggacaagaaaaagaaaacaaagaaaauuaaggaaaaguacaucgaucaggaggaacugaauaaaaccaagcccaucuggacgcgcaacccugacgauauuacacaagaggaauacggcgaguuuuauaaaagccucaccaaugacugggaggaucaccuggcggugaagcacuucucuguggaaggccagcuggaguuuagagcccuccuguucaucccgcggcgcgcucccuuugaccuuuucgaaaacaaaaagaagaaaaauaacauuaagcuguacgucagacggguuuucaucauggacuccugcgaugagcucauuccugaauaucugaauuuuauccgcggggugguggacagcgaggaucuuccccugaacaucuccagagagaugcuccagcagucuaaaauucugaaggucauccggaaaaauauugugaagaagugucuggaacucuucagcgagcuggccgaagacaaagagaacuacaagaaauuuuaugaggcuuucuccaagaaccuuaaacugggaauccaugaggauagcacaaaucgcagacggcucucugagcugcuuagauaccacaccucccaaagcggcgacgaaaugaccucucugagcgaguauguuucccgcaugaaggaaacacagaaaucuauuuacuacaucacgggggagagcaaggaacagguggccaacuccgccuuugucgaacgggugagaaagcgcggauucgagguuguguauaugaccgaaccuauugaugaguacugcguccaacagcucaaagaauuugacggcaagagccuggugucugucacaaaagaggggcuggagcuccccgaagaugaggaagagaagaaaaagauggaagaguccaaggcuaaauucgagaaucuguguaaacuuaugaaggaaauccuggacaagaaaguggagaagguuaccaucagcaaccggcucgugucuuccccgugcuguauugucacaagcaccuauggauggacggcgaauauggaaagaaucaugaaggcccaggcucugcgcgauaacuccacaaugggcuacaugauggccaaaaagcaucuggagauuaauccugaccaccccaucguggaaacccuucggcagaaagccgaggcugauaagaacgacaaagccguuaaggaccucgugguccugcuguuugagaccgcgcuccugucuagcggcuucucccuugaagauccucaaacacacucuaauagaauuuaucgcaugaucaagcuggggcucggaaucgacgaggaugaaguggcugccgaggagcccaacgccgcugugcccgacgaaauuccuccgcuggagggcgaugaagacgccagccggauggaggaaguugauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1914 - RNA, 2629 nt, Artificial Sequence
  mRNA product Design1 comprising derived and/or modified sequence from Homo sapiens__NP_003290.1__HsHSP90B1 (opt5)
gggagaaagcuuaccaugagagcccugugggugcucggccugugcuguguccuucugaccuucgggagcguucgggcugacgaugagguggacguggauggaacagucgaagaggaccucggcaagucccgcgaagggucuagaacggaugacgaggugguucagcgggaagaggaggccauccaacuggauggacuuaacgcgagccagauucgcgaacugagagagaaauccgaaaaguuugcuuuccaggccgaggugaaucggaugaugaaacucaucauuaacucucuguacaagaauaaagagaucuuucugcgcgaacucauuagcaacgccuccgacgcucuggauaagaucagacuuaucucucugaccgacgagaaugcccucagcggcaacgaagaacugacagucaagauuaaaugcgauaaggagaaaaaucuucugcacgugaccgacacagggguuggaaugacccgggaggagcucgugaagaaccugggcacaaucgcuaaauccggcaccagcgaguuccugaauaagaugacggaggcccaggaagaugggcaaucuaccuccgagcucauuggacaguuuggcgucggguucuauagcgcguuucugguggccgacaaggugaucgucacaucuaaacauaacaaugacacccagcacauuugggaauccgauagcaacgaguucucuguuaucgcugacccccgcggaaauacacuuggcagagggaccacgauuacacuggugcucaaggaggaagccuccgauuaccuggagcuugacaccaucaaaaaccuggugaagaaauauagccaguuuaucaauuucccuauuuacgucugguccucuaagacagaaaccguggaggaaccgauggaggaggaagaggcugccaaagaagagaaggaggaaagcgaugacgaggcggccguugaagaggaagaggaggaaaagaaacccaagaccaaaaagguggagaaaacagucugggauugggaacucaugaacgacaucaagccuauuuggcaacggcccuccaaggagguggaagaggaugaguauaaagccuuuuacaagagcuucucuaaagaauccgacgauccuauggcuuauauccauuuuacggcugagggagaaguuaccuucaagagcauucuguucgugcccacaucugccccucgcggccuguuugacgaguacggcagcaaaaaguccgacuacaucaagcucuaugucagacggguguucaucaccgaugacuuucacgauaugaugccgaaauaccugaacuucgucaagggggugguugacucugaugaccuuccccugaaugugagccgcgaaacacuccagcagcauaaacugcuuaaggucauucggaaaaagcuggugagaaagacccucgauaugaucaaaaagauugccgacgauaaauauaacgacacguuuuggaaggaguucggaacaaauaucaaacugggcguuauugaggaucacuccaacagaacccgccuggcuaagcuccugcgguuucagagcucucaccauccuaccgacaucacaucccuugaucaauacguggaaagaaugaaagagaagcaggacaagaucuauuucauggcggggagcucucgcaaagaagccgaguccagccccuuugucgagcggcugcucaagaaaggauacgaagugauuuaucugaccgagccuguggacgaauacuguauccaggcucugcccgaguucgauggcaagagauuucaaaauguugccaaagaaggggucaaguucgacgaguccgagaagacaaaagaaucucgcgaggccguggaaaaggaguuugaaccgcuucucaacuggaugaaagauaaggcucugaaagacaagauugagaaggccguggucagccagcggcugacggaguccccuugcgcgcucguggcuucucaguacggauggagcggcaauauggaaagaaucaugaaagcccaggccuaucaaaccggcaaggauauuuccacaaacuacuaugcuagccagaaaaagaccuucgagaucaauccccgccacccucugauucgggacaugcuuagacgcaucaaagaagaugaggacgauaagacaguucuggaccucgccgugguccuguucgaaaccgcuacgcugcggucuggguaccuucuccccgauaccaaggccuauggagacagaaucgagcggaugcugcgccugucccucaacauugaucccgacgcgaaaguggaggaagaaccugaagaggagccggaagagacagccgaagacaccacagaggauaccgaacaggacgaggaugaggaaauggacguuggcacggaugaggaagaggaaacagcuaaggagagcaccgccgagaaagacgaacugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1915 - RNA, 2332 nt, Artificial Sequence
  mRNA product Design1 comprising derived and/or modified sequence from Homo sapiens__NP_057376.2__HsTRAP1 (opt5)
gggagaaagcuuaccauggccagagagcugcgggcucuccugcuuuggggccgcagacugcggccccuccugcgcgccccugcgcuugcugccgugcccgggggaaagccgauccugugcccuagacggaccacagcccagcucggcccccgcagaaacccugcuuggagccugcaagccgggcggcuguucuccacgcagaccgcugaagacaaagaggaaccccuccacucuauuaucagcuccacagagucuguccagggaagcaccuccaagcaugaauuucaggccgagacaaagaagcugcuugauauuguugcgcgcucucuguacagcgagaaagaaguguucaucagagagcucauuuccaaugccagcgacgcucuggaaaaacuucggcacaagcuggugucugauggccaagcccucccugagauggagauccaucugcagaccaacgcugaaaaagggacaaucaccauucaggacacgggaaucggcaugacccaggaggaacuggucuccaaucucggcacaauugcccgcagcgggucuaaggcguuucuggaugcccuucaaaaccaggcugaggccuccagcaaaaucauuggacaguucggcgugggguuuuauucugcuuucaugguugccgacagaguggaagucuacucccggagcgccgcuccgggaucccugggcuaucaguggcucucugaugggagcggaguguuugagaucgcggaggccuccggcguucgcaccggcacaaagauuaucauccaccugaaaagcgacuguaaggaguucucuuccgaggcuagagugcgggaugucgugaccaaguacagcaauuuugugucuuucccccuuuaucugaacgggagacgcaugaauacgcuccaagccauuuggaugauggacccuaaagauguccgggaauggcagcaugaggaauuuuacagauauguugcccaggcucacgacaagccccgcuacacacugcacuacaaaaccgaugccccucugaacauccggagcauuuucuaugugcccgacaugaagccguccauguuugacgugucuagagagcucggaagcuccgucgcgcuguacagccgcaaagugcuuauccaaacaaaggcuaccgauauucugccuaaauggcuccgguucaucagaggcguuguggacucugaggauaucccccugaaucuuucccgcgaacugcuccaggagagcgcccugauucggaagcugagagacguccuccagcagcgccugaucaaguucuuuauugaucaaucuaaaaaggacgccgaaaaauaugcuaaguucuuugaggauuacgggcuuuucaugcgggaaggaaucgugaccgccacagagcaggagguuaaagaagacauugcuaagcugcucagauaugaguccagcgcccugccuuccggccagcugacgucucuuagcgaauacgcgucccggaugcgcgccgggaccagaaacaucuauuaccucugcgcucccaaucggcaucuggccgagcacucucccuacuaugaggcuaugaagaaaaaggauacagaagugcuguuuuguuucgagcaguuugacgaacucacccugcuucaucugagagaguucgauaaaaagaaacucaucagcgucgaaacagacauuguggucgaccacuacaaggaggagaaguuugaagaucgcuccccugccgcggagugccugagcgaaaaagagaccgaagaacugauggccuggaugcggaacgugcuuggaucuagaguuacgaaugugaaggucacacuccgccuggacacccacccggcuauggugaccguucuggagaugggcgccgcuagacauuuccuccggaugcaacagcuggccaaaacacaggaggaacgcgcccagcuucugcaacccacccucgaaaucaacccuagacacgcucugauuaagaaacugaaucagcuucgggcguccgagcccggccucgcccagcugcugguggaucagaucuaugaaaacgcuaugauugccgccgggcucgucgacgauccucgcgcuauggugggaagacugaacgagcuucuggugaaggcccucgagcggcauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1916 - RNA, 679 nt, Artificial Sequence
  mRNA product Design1 comprising derived and/or modified sequence from Homo sapiens__NP_000609.1__HsIGF1 (opt5)
gggagaaagcuuaccaugggcaagaucagcucccugcccacccagcuuuucaaaugcuguuuuugcgacuuccugaaggugaaaaugcacacaaugucuagcucccaucucuuuuaccuggcccucugucugcuuacguucaccucuagcgcuacagccgggccugagacccugugcggagcggaacucgucgaugcucugcaauuuguuuguggcgacagaggguucuauuuuaacaagccgacaggauacggcuccucuagccggcgcgcuccccagaccgggauuguggaugagugcuguuucagauccugcgaccugcggcgccucgaaauguauugugccccucugaaacccgccaagagcgccagaucugugcgggcucagcgccacacagauaugccuaagacccagaaagagguccaucuuaagaaugccuccagaggaagcgcgggcaacaaaaauuaccggaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1917 - RNA, 760 nt, Artificial Sequence
  mRNA product Design1 comprising derived and/or modified sequence from Homo sapiens__NP_000603.1__HsIGF2 (opt5)
gggagaaagcuuaccaugggcauccccaugggaaagagcaugcuggugcuccugaccuuccuugccuuugcuuccugcuguauugccgcguacagaccuucugagacacugugcgggggcgaacucgucgacacgcugcaguucguuuguggggaucggggauuuuauuucagccgcccggcuuccagagugucucggcgcagcagaggcaucguggaggaaugcuguuuucgguccugcgaccuugcccugcucgagaccuacugugccacacccgcuaaaucugaacgcgaugucagcaccccucccacagugcugccugacaacuuccccagauauccuguugggaaguuuuuccaauacgauaccuggaaacaguccacacagcggcugcgcagaggacucccggcccugcuucgggcucgcagaggccacgugcuggccaaggagcucgaggcguuucgggaagccaaacgccauagaccccugauugcccuuccuacccaggaccccgcucacggcggggcuccucccgagauggccagcaaucggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1918 - RNA, 856 nt, Artificial Sequence
  mRNA product Design1 comprising derived and/or modified sequence from Homo sapiens__NP_000591.1__HsIL6 (opt5)
gggagaaagcuuaccaugaacagcuucuccaccucugccuuuggccccguggcuuucagccuggggcuccugcuuguccugccugccgcguuuccggcucccguuccucccggagaggacuccaaggauguggccgccccucacagacagccccucacaucuagcgaacggaucgacaaacaaauucgcuacauccuggauggcauuuccgcucuuagaaaggagacgugcaauaaaucuaacaugugugaaagcuccaaggaggcccuggcugaaaauaaccucaaucugccuaaaauggccgagaaggacgggugcuuccagagcggauuuaacgaggaaaccugucuggugaagaucauuacaggccuccuggaguucgaagucuaucuugaguaccugcagaaucgguuugagucuuccgaagaacaggcgcgcgccgugcaaaugagcaccaaaguucucauccaguuccugcagaagaaagcuaagaaccuugaugccaucacaaccccggaccccacaaccaaugcuucucugcucacgaaacugcaggcccaaaaccaguggcugcaggauaugaccacacaucucauucugagauccuuuaaggaguuccuucagagcucucugcgggcgcuccgccaaaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1919 - RNA, 1498 nt, Artificial Sequence
  mRNA product Design1 comprising derived and/or modified sequence from Homo sapiens__NP_002183.1__HsINHBA (opt5)
gggagaaagcuuaccaugccccugcucuggcugagaggcuuccuucuggccagcugcuggaucauugugcgguccucuccuaccccggggagcgagggacacuccgcugcccccgacuguccuucuugcgcgcucgcugcccugcccaaggaugucccuaacagccagcccgaaaugguugaggccgugaaaaagcauauccuuaauaugcugcaccucaaaaagcgcccugacgugacacaaccgguccccaaagcugcccugcugaacgcuauuagaaagcuccaugugggcaagguuggggaaaauggauacguggagaucgaagaugacauuggccggcgcgccgagaugaacgagcugauggaacagacguccgagaucaucaccuuugcggaaucugggacagccagaaaaacccuucacuucgagauuagcaaggagggauccgaucugagcgucguggaacgggcugagguuuggcucuuucugaaagugccuaaggccaaucgcacaagaaccaaagucacaauccggcuuuuccagcagcaaaagcauccccagggcucucuggacaccggcgaagaggcugaagagguggggcucaagggagagcgcuccgaacugcugcucagcgagaaaguggucgaugccagaaagucuacguggcacguuuuuccuguguccagcucuauucagcggcugcuugaccagggcaaauccagccuggaugugcgcaucgcgugugaacaaugccaggaguccggggccucucucguccugcuuggaaagaaaaagaaaaaggaagaggagggcgaagggaagaaaaagggaggcggcgaagggggagcuggcgccgacgaggagaaagaacagagccacagacccuuccugaugcuccaggcucggcaauccgaggaucauccgcaccgcagacggagacgcgggcuggagugugacggaaaggugaacauuugcuguaaaaagcaguuuuucguuagcuuuaaggauaucggcuggaaugacuggauuaucgccccuucuggguaucaugccaacuacugcgaaggagagugucccucccacaucgcuggcaccagcggcucuagccuguccuuccacucuacagugauuaaucauuaucggaugagagggcacagcccuuuugcgaaccucaaauccugcuguguccccaccaagcugcgccccaugagcaugcuuuacuaugacgauggacagaauaucauuaaaaaggacauccaaaacaugauuguggaagagugcggcugcucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1920 - RNA, 1441 nt, Artificial Sequence
  mRNA product Design1 comprising derived and/or modified sequence from Homo sapiens__NP_002184.2__HsINHBB (opt5)
gggagaaagcuuaccauggacggccugcccgggagagcccucggagcugccugccugcuucugcucgcggcuggcuggcuggggccugaggccuggggaagcccgacacccccucccaccccugccgcucccccuccgcccccucccccuggcucccccgggggaucucaggauacguguaccagcugcggcggcuuccggcgcccggaggaacuugggagaguggacggagauuuucuggaagccgucaagcggcacauccucucccgccugcaaaugagaggccggccuaacauuacacaugcuguucccaaagccgcgauggugaccgcccugcgcaagcuccacgcugggaaagugagagaggacggacgggucgaaaucccucaucuggauggccacgccucucccggggcugacggacaggagcgcgugagcgagauuaucuccuucgccgaaacagauggccuugcgucuagcagaguucggcuguacuuuuucauuuccaaugagggcaaccagaaucucuuugugguccaggccagccuguggcuuuaucugaagcuccugcccuacgugcuggaaaaagggucucgcagaaagguucgggugaaggucuauuuccaagagcagggacauggcgaccgcuggaacaugguggagaaaagaguggaucucaagcgguccggguggcacaccuuuccucugacagaagcuauccaggcccuuuucgagagaggagaacgccggcugaaucucgacguccagugugauagcugccaagagcuggcuguugugccgguguuugucgaccccggcgaagagucucacagaccuuucgugguugugcaggcccgccuuggggauucccggcauagaauccgcaaacggggacuggagugugacggcagaaccaaccucugcugucgccagcaguuuuucauugacuuucggcugaucggcuggaaugauuggauuaucgcccccacgggguacuauggaaacuacugcgaaggcagcuguccugcuuaucuggcggggguccccggaucugccuccagcuuccacaccgcugugguuaaucaauacagaaugcgcggccucaacccggggacagucaauuccugcuguauuccuaccaagcugucuacaaugagcaugcuuuacuucgacgaugaguauaacaucgugaaacgggacgugcccaauaugauugucgaagagugcggcugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1921 - RNA, 3676 nt, Artificial Sequence
  mRNA product Design1 comprising derived and/or modified sequence from Homo sapiens__NP_000623.2__HsITGAM (opt5)
gggagaaagcuuaccauggcccugagagugcuccugcuuaccgcucugacacucugccacggcuucaaccuggacacggagaaugccaugaccuuucaggaaaacgcgcggggguucggacaaagcgugguucagcuucagggcucccgcgugguggucggggcuccccaggagaucguggccgccaaucaaagaggaucucuguaccagugugauuauagcacaggcuccugcgaaccuauucggcuccagguuccgguggaggcugucaacaugucucuggggcugagccucgccgcuaccacauccccuccucagcugcuugccuguggacccaccgugcaucaaacaugcucugaaaauaccuacguuaagggccuguguuuucucuucggcagcaaccugcgccagcagccucagaaauuucccgaggcgcuuagagggugcccucaagaggacuccgauaucgccuuccugauugacggaagcggcucuaucauuccgcacgauuuucggcgcaugaaggaguucguguccacggucauggaacagcucaaaaagagcaaaacccuguuuucucugaugcaguauuccgaagaguucagaauccauuuuacauucaaggaguuucaaaauaaccccaauccucggagccucgugaagcccaucacccagcugcuugggcgcacacacaccgcuacgggaauuagaaaagugguccgggaacuguucaacaucacaaauggcgcccgcaagaacgcuuucaaaauucucguugugaucaccgacggggagaaguuuggagauccucugggcuacgaagacgugauucccgaggccgauagagaaggcgucauccgguaugugauugggguuggagacgcguuccgcucugagaaauccagacaggagcuuaauacaaucgccagcaagccgccucgggaucauguguuucaggucaacaauuucgaagcucugaagaccauccaaaaccagcucagagagaaaauuuuugccaucgaaggcacccagacaggguccucuagcuccuucgagcacgaaaugagccaggagggauuuucugcugccauuacguccaacggcccccugcugagcaccguggggucuuacgacugggccggaggcguuuuccucuauacaagcaaggagaaauccaccuuuaucaauaugacacgcguggauucugacaugaacgacgcuuaccugggcuacgcggccgcuauuauccuucggaauagaguccaaagccuggugcucggggccccucgcuaucagcacaucggacuggucgccauguuccggcagaacaccggcaugugggaauccaaugcuaacgugaaggggacgcagauuggagccuacuuuggcgcgagccuuuguucuguugauguggacuccaaugggagcacagaucugguccucaucggcgcuccccauuauuacgagcaaaccagaggaggccaggugucuguuugcccccugccucgcgggcgggccagauggcagugugacgccgugcuguauggagaacagggccaaccgugggggcgcuucggagcugcccucaccguccugggcgaugugaacggggacaaacuuacagauguggcuauuggcgcccccggagaggaagacaaucggggcgcgguuuaccuguuucacgggaccuccggaagcggcaucuccccuucucauagccagagaauugccggguccaagcucucuccccgccugcaguauuucggacaaagccuguccggcgggcaggaucuuacaauggacggccucgucgaucugacggugggagcucagggccacgugcugcuccugcggagccagccuguccuuagagugaaagccaucauggaguucaacccccgggagguugcucgcaauguguuugaaugcaacgaccaagucgugaaggggaaggaggccggagaaguuagagugugucugcacguccagaaaucuacccgggacagacuccgcgagggccagauccaguccgugguuacauacgaucuggcgcuggacagcgggcggccgcauucuagagccguguucaaugagaccaagaacuccacacgcagacaaacccagguccuuggacucacgcagaccugcgaaacacugaaacugcagcucccuaauugcauugaggaucccgugagcccuaucgugcugcggcuuaacuuuucucuggucggcacaccccucagcgcuuucgggaaccugcgcccuguucuggccgaagacgcucaaagacuuuuuaccgcccucuuccccuuugagaagaauuguggcaacgauaauauuugccaggacgaucuguccaucaccuucagcuuuaugucucuggacugucucguggugggaggcccgcgggaguucaacgucacggugacaguucgcaaugauggggaagacuccuacagaacccaggugacauuuuucuuuccucuggaucuuagcuaucggaaagucuccacccugcaaaaccagcgcucucagagaagcuggcggcucgccugcgaguccgcuucuagcaccgaaguguccggagcgcugaagucuacaagcuguuccauuaaucaccccaucuuccccgagaacagcgaaguuacguucaauauuaccuuugacguggauucuaaggccucccugggcaacaaacuucuccugaaggcuaaugucacaagcgagaacaauaugccucgcaccaacaaaacagaguuccagcuggaacucccggugaaguacgccguuuauaugguggucaccucucaugggguguccacgaaauaccugaauuuuacagccagcgagaacaccucuagagugaugcaacaccaguaucaggucuccaaccuuggacagcggagccugcccaucucccucguuuuccuggugccugugagacugaaucaaaccgucaucugggaccgcccccaggugacauuuagcgaaaaccuuucuagcacaugccauaccaaggagcggcugccuucccacucugacuuccucgcugaacugagaaaggcccccguugugaauuguagcauugcggucugccagcgcauccagugugauauucccuuuuucggcauccaagaggaauuuaacgcuacgcucaaaggcaaucuguccuucgacugguacauuaagaccucucacaaccaucuucugaucgugagcacagccgagauccucuuuaaugauuccguuuucacccugcugcccgggcagggagccuucgugcggucucagacagagaccaaagucgaaccguuugaggugccuaacccccuuccucugauugucggcagcuccgucgggggacuccugcuccuggcucuuaucacggccgcgcuguauaagcucggcuucuuuaaaagacaguacaaggacaugaugagcgaagggggacccccgggcgcugagccucaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1922 - RNA, 1621 nt, Artificial Sequence
  mRNA product Design1 comprising derived and/or modified sequence from Homo sapiens__NP_002415.1__HsMMP8 (opt5)
gggagaaagcuuaccauguucagccugaagacccuccccuuucugcuucugcuccacgugcagaucuccaaagccuucccugucucuagcaaggagaaaaacacaaagacgguucaagacuaccuggaaaaauuuuaucagcuuccguccaaucaguaccagucuaccagaaagaacggcacaaaugugauuguggagaagcugaaagaaaugcaacgguucuuugggcucaacgucaccggaaagcccaaugaggaaacacuggauaugaugaaaaagccucgcugcggcgugcccgacagcgggggauucaugcugaccccuggcaaccccaaaugggagagaacaaaucucaccuaucggauccgcaacuacacgccucagcuguccgaggcugaaguugagagagccauuaaggaugcguuugaacuuuggucuguggcuagcccgcugaucuucacccggauuucccagggggaggccgacaucaauaucgccuuuuaucagcgcgaucauggagacaacagccccuucgauggcccuaauggcauucucgcucacgccuuucaacccgggcagggaaucggcggggacgcucauuucgaugccgaggaaacauggaccaacacaucugcgaauuacaaccuguuucuugucgccgcucacgaguucggacauucccugggccucgcccacagcucugacccuggggcucugauguaucccaauuacgccuucagagaaaccuccaacuacagccugccgcaggaugacauugauggaauccaggcgauuuauggccucucuuccaacccuauccaacccacgggcccuagcacacccaagcccugugacccuucccugaccuuugacgccauuacaacccuucggggagagauccuguucuuuaaagaucgcuacuucuggagacggcacccgcagcuccagcgcguggaaaugaauuuuaucucucuguucuggcccagccuuccuaccgggauucaagcugccuaugaggacuuugauagagaccugaucuuccucuuuaagggcaaccaguacugggcucuguccggguaugauauucugcagggauaccccaaagacaucagcaauuauggcuucccuucuuccguucaggccauugaugccgcuguguuuuaccggagcaagacauacuucuuugucaacgaccaauucuggcgcuaugauaaucagagacaguucauggagcccggguacccgaaaucuaucagcggagcguuuccuggcaucgaauccaagguggacgccguguuccagcaagagcacuuuuuccaugucuuuucuggcccccgguauuacgcuuucgaucucauugcccagagaguuacgcgcguggcccgggggaacaaauggcugaauugcagauauggaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1923 - RNA, 2341 nt, Artificial Sequence
  mRNA product Design1 comprising derived and/or modified sequence from Homo sapiens__NP_004985.2__HsMMP9 (opt5)
gggagaaagcuuaccaugagccuguggcagccccucgugcugguccuucugguucucggcugcuguuucgccgcuccuagacaacggcaguccacccuggugcuuuuuccgggggaccugcgcacaaaccucacggauagacagcuggccgaggaauaccuguaucgguacggauauacccgcguggcggagaugagaggcgaaucuaaaagccucgggcccgcucugcuucugcuccagaaacaacugucccuuccugagacaggagaacuggacucugccacccucaaggccaugcggacaccccgcugcggcgucccugaucuggggagauuccagaccuuugagggagaccugaaauggcaccaucacaauaucacauacuggauucagaacuauagcgaggaucucccccgggcugugaucgacgaugccuucgcucgcgccuuugcgcugugguccgccguuaccccucuuacguucaccagaguguacucucgggacgcugauauugucauccaguuuggcguggccgaacauggcgacggguauccguucgauggaaaggacggccugcucgcucacgccuuucccccugggcccgggauucaaggcgaugcgcauuucgacgacgaugagcuguggagccuugggaaaggaguuguggucccuacacgcuuuggcaaugccgacggcgcugccugucacuuccccuuuaucuucgaagggagauccuacagcgcuugcaccacagauggacggucugacggccugccgugguguuccaccacggccaacuacgauacagacgaucgcuucggguuuugcccuagcgagagacucuauacccaggacggaaaugccgauggcaagcccugucaguucccuuuuaucuuccaggggcaaucuuacuccgcuugcacaaccgacggacggagcgauggcuauagauggugugcgaccacagccaacuacgaccgcgacaagcuguuuggcuucugccccacgcgggcugauucuaccgugaugggaggaaauuccgccggcgagcuguguguguuucccuucacauuucucgggaaagaauauagcacaugcaccuccgagggaagaggcgacgggcgccuguggugcgccaccacgucuaacuucgauagcgacaagaaauggggcuuuuguccugaucagggauacucccuuuuccuggucgcugcccacgaauuuggccaugcgcucgggcuggaccacagcucuguuccggaggcucuuauguaucccauguaccgguucacagaaggaccuccccugcauaaggaugacgugaauggcauuagacaccucuacgggccucgccccgagccggagccucggcccccuaccaccacaacaccccagccuaccgcgcccccgacggugugcccuaccggaccucccacaguccaccccuccgaaagaccgaccgccggccccacagggccucccagcgcuggcccuaccggacccccuacggccggccccucuaccgcuacaaccgugccgcugagcccuguugaugacgccuguaacgugaauaucuucgaugcgauugccgagaucgggaaccaacuguaucucuuuaaagacggaaaguacuggcgcuucuccgaaggccgggggucuagaccccagggaccuuuucugauugcugauaaguggcccgcccuuccgcgcaaacuggacagcgucuucgaggaacggcucuccaagaaacuguuuuucuuuagcggcagacagguguggguuuauacaggggcuucugugcugggcccucggcgccuugacaagcucggacugggcgccgaugucgcccaggugaccggggcccugagauccggacggggcaaaaugcuccuguucagcgggagacgccuuuggcgguuugacgucaaggcucaaaugguggaucccagaucugccuccgagguugaccgcauguucccuggagugccccuggauacgcaugacgucuuucaguacagagagaaggcuuauuucugccaggaucgguuuuacuggcgcgugagcuccagaucugaacucaaucagguugaccaagugggcuaugucacauacgauauccugcagugucccgaggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1924 - RNA, 1633 nt, Artificial Sequence
  mRNA product Design1 comprising derived and/or modified sequence from Homo sapiens__NP_002418.1__HsMMP13 (opt5)
gggagaaagcuuaccaugcaccccggcgugcuggccgcuuuccucuuucugagcuggacccauugcagagcccuuccucugccguccgggggagacgaggaugaccucucugaagaggaucugcaguucgcggaacgguaccuucgcagcuauuaccaccccacaaaccuggcuggcauccucaaggagaaugccgccuccucuaugacggaaagacugcgggagaugcagagcuuuuucgggcuggaggucaccggaaaacucgacgauaacacacuggacguuaugaagaaaccucgcuguggcgugcccgaugugggggaauauaaugucuuuccuagaacccuuaagugguccaaaaugaaccugacauaccggauugugaauuauacccccgacaugacacauucugagguugaaaaggcuuucaagaaagccuuuaagguguggagcgaugucaccccucucaacuucacgcgccugcacgacggaaucgcugauauuaugaucuccuuuggcauuaaagagcauggcgacuucuacccguuugaugggcccagcggacuucuggcccacgcguucccucccggcccuaauuaugggggagacgcccacuuugacgaugacgagaccuggacaucuuccagcaagggcuacaaccucuuccugguggcugcccaugaguucgggcacucucugggacucgaucauuccaaagaccccggcgcucugauguuuccgaucuacaccuauacaggcaagagccacuucaugcuuccugaugacgauguucaagggauccagucucuguacggacccggcgacgaggauccuaaucccaagcaccccaaaaccccugacaagugcgauccgucccucagccuggacgccauuacgucccuuagaggggaaacaaugaucuuuaaagaccgguucuuuuggcgccugcauccccagcaaguggaugcggaacucuuccugaccaagucuuuuuggccugaacugcccaacagaauugacgccgcuuaugagcacccuagccaugaucucaucuucauuuuucggggacgcaaauucugggcccugaauggcuacgacauccuugagggguaucccaagaaaauuuccgaacugggacucccgaaggaggucaagaaaaucagcgcugccgugcacuuugaagauacaggcaagacccugcuuuucucuggcaaccagguguggagauacgacgauaccaaucauaucauggacaaagauuauccucggcugauugaggaagacuuucccgggaucggagauaaggucgacgccguuuacgagaaaaacggcuacauuuauuucuucaaugggccuauccaguuugaguacuccauuuggagcaaccgcaucgugagagugaugcccgcuaacucuauccucugguguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1925 - RNA, 1285 nt, Artificial Sequence
  mRNA product Design1 comprising derived and/or modified sequence from Homo sapiens__NP_001286.1__HsCCR1 (opt5)
gggagaaagcuuaccauggagacccccaacacaacggaagacuacgauaccacaaccgaguucgacuauggcgaugccacaccuugccagaaggugaaugaaagagcuuuuggggcccaacugcucccgccccuguacagccuugucuucguuaucggacuggugggcaacauucucgugguccuggugcuuguucaguauaaacggcugaagaauaugaccuccaucuaccuccugaaccuggcgauuucugaccuccuguuucuuuucacacugccuuuuuggaucgauuauaaacucaaggacgauuggguguucggggacgcuauguguaaaauucugagcggauuuuacuauaccggccuuuacuccgagaucuucuuuaucauucugcucacgaucgaucgcuaccuggccauuguccacgccguguucgcucugagagcccggaccguuacauuuggggugaucaccucuauuaucauuugggcucucgccauccuggcgagcaugcccggacuuuauuucuccaagacacagugggaauuuacccaucacacgugcucucugcauuucccucacgagagccuccgcgaguggaagcuguuccaggcccuuaaacugaaucucuuuggccugguccugccccuccuggugaugaucauuuguuacacaggcaucauuaagauccuucugagacggccuaacgagaaaaaguccaaagcugugcgccucauuuucgucaucaugaucaucuuuuuccuguuuuggaccccguauaaucuuacaauucugauuagcguuuuccaagacuuucucuucacccaugaaugcgaacagucuagacaccuggaucuggccguccaggugaccgaggugaucgcuuacacacacuguugcgugaaccccguuauuuaugccuuugugggggagcgguuccgcaaguaccucagacagcuguuucaucggcgcgucgcggugcaccuuguuaaguggcugccuuuccucuccguggacagacuggaacgggucagcucuacgucccccagcaccggagagcaugaacugucugccggcuuuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1926 - RNA, 853 nt, Artificial Sequence
  mRNA product Design1 comprising derived and/or modified sequence from Homo sapiens__NP_002598.4__HsPDGFA (opt5)
gggagaaagcuuaccaugagaacccuggccugccuccugcuucugggcuguggguaccucgcucacgugcuggccgaggaagcggagaucccccgggaagucauugagcgccuugcuagaagccagauccauuccauucgggaccugcaacgccuccuggaaaucgauucuguuggaagcgaggacucccuggauacaucucucagagcccacggcgugcaugccacgaagcacgugccugagaaacggccgcugcccauucgcagaaagcggagcaucgaagaggcugucccugccgugugcaaaacccgcacaguuaucuaugaaauucccagaucccagguggacccuaccucugcuaacuuccuuaucuggcccccuugugucgaggugaagcggugcacaggguguugcaauaccagcuccguuaaaugucagccgagccgcgugcaucacagaucugucaagguggccaagguggaguacguccggaaaaagcccaaacugaaggaaguucaggugcgccucgaggaacaccuggagugcgcgugugccacaaccucccuuaacccugauuauagagaagaggacacgggacggcccagagagagcggcaaaaagcgcaagcggaaaagacugaagccuaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1927 - RNA, 943 nt, Artificial Sequence
  mRNA product Design1 comprising derived and/or modified sequence from Homo sapiens__NP_002599.1__HsPDGFB (opt5)
gggagaaagcuuaccaugaacagaugcugggcccuguuccucagccuguguugcuaccuucggcugguguccgcugagggcgaccccaucccugaggaacucuaugaaaugcugucugaucacagcauucgcuccuuugacgaucuucagagacugcuccauggggacccgggagaggaagauggcgccgagcuggaccugaauaugacccggucucacagcgggggagagcucgaaucccuggcgcgcggcagacggucucuugggagccugacaaucgcugagcccgccaugauugccgaauguaagacgcgcaccgaggucuucgagaucuccagacggcucauugaucgcacaaacgcuaauuuucugguuuggccucccugcguggaagugcaaagauguagcggaugcuguaacaaucggaacguccagugccgcccuacccaggugcagcuuagacccguucaagugcggaaaaucgagaucguccgcaagaaaccuauuuucaagaaagccacagugacccuggaagaccaucucgcuuguaagugcgagacaguugccgcggccagaccggugacccggucucccggcggcucccaggaacagagagcuaagacgccucagacccgcgucacaauccggaccgugagagugcgccggcccccuaaagggaagcacagaaaauuuaagcauacacacgauaaaaccgcccugaaggagacgcugggagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1928 - RNA, 1255 nt, Artificial Sequence
  mRNA product Design1 comprising derived and/or modified sequence from Homo sapiens__NP_057289.1__HsPDGFC (opt5)
gggagaaagcuuaccaugagccuguucggccuccugcuucugaccuccgcccucgcugggcagagacaaggaacacaggccgagucuaaccugagcuccaaguuucaguucucuagcaauaaagaacagaacggcgugcaagacccccagcacgagcggaucauuacggucuccaccaaugggucuauccauagcccucgcuuuccgcacacauaccccagaaacaccguucuuguguggcggcugguggcggucgaagagaauguguggauucagcucacauucgaugaacgcuuuggacuggaggacccugaggaugacaucugcaaguaugauuucguugaaguggaggaacccuccgacggcaccauucuggggagaugguguggaagcggcacagucccuggcaaacagaucucuaaggggaaccaaauccggauucgcuuuguguccgaugaguacuuccccagcgagccuggauuuugcauccauuauaauauuguuaugccgcaguucaccgaagcugugucucccuccguccucccucccagcgcccugccucuugaccugcucaacaaugccaucacggcuuuuucuacccuggaggaucuuauuagauaccuggaacccgagcgguggcagcucgaccuggaagaucuguaucgcccgacauggcagcuccugggcaaagccuucguguuugggagaaagucccggguggucgaccuuaaccugcucaccgaggagguucgccuguacagcuguacaccuagaaauuucuccgugucuauccgggaggaacuuaagcgcaccgauacgauuuucuggcccggaugccugcucgugaaaagauguggcgggaacugcgcuuguugccugcacaauuguaacgaaugccaaugugucccuagcaaggugaccaaaaaguaucaugagguucugcagcuccggcccaaaacaggagugagaggccugcacaagucccuuacagacgucgcccuggaacaccaugaggagugcgacugcgugugucgcggcagcaccgggggaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1929 - RNA, 1312 nt, Artificial Sequence
  mRNA product Design1 comprising derived and/or modified sequence from Homo sapiens__NP_149126.1__HsPDGFD (opt5)
gggagaaagcuuaccaugcacagacugaucuucguguacacccucauuugcgccaacuuuuguagcugccgggacacauccgcuacgccccagucugccagcaucaaggcgcugcgcaaugcuaaccuuagacgggaugaccuguaucgcagagaugagaccauucaagucaaaggcaauggguacguucaguccccucgguucccgaacucuuauccccgcaaucuccugcuuacauggagacugcauagccaggaaaacacccggauccagcucguguuugacaaucaauucggacuggaggaagccgagaacgauauuugucgcuacgacuuuguggaagucgaggauaucuccgagacaucuaccaucauuagaggccgguggugcgggcacaaggaagugccuccccgcaucaaaagcagaacaaaucagauuaagaucaccuucaaauccgacgauuauuuuguugccaagccuggauucaagauuuacuauagccugcucgaggacuuucagcccgcugccgcuucugaaacgaacugggaguccgugaccagcucuaucuccggcgucagcuacaauucuccuuccgugacagauccgacccugauugccgacgcgcuugauaaaaagaucgccgaguucgacacaguugaagaccugcucaaauacuuuaaccccgagagcuggcaggaagaucuggagaauauguaucuugacaccccucgguaccgcgggagauccuaucaugaucggaagucuaaaguggaccuggauagacucaacgacgaugcuaagcgcuacagcuguacgccccggaauuauuccgucaacaucagagaggaacugaagcuggccaacgugguguucuuuccucgcugccuccugguccaacgguguggaggcaauugcggcugugggacaguuaacuggagaagcugcaccuguaauucuggaaaaacagugaagaaauaccacgaggugcuucaguucgaacccggccauauuaagcgccgggggagagcuaaaaccauggcccuggucgacauccagcucgaucaccacgagcgcugcgacugcauuuguuccagccggccgccuagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1930 - RNA, 895 nt, Artificial Sequence
  mRNA product Design1 comprising derived and/or modified sequence from Homo sapiens__NP_003946.3__HsSOCS3 (opt5)
gggagaaagcuuaccauggugacccacagcaaguuccccgccgcuggcauguccagaccucuggacacaucucuccggcugaaaacguuuagcuccaagucugaguaccagcuugucguuaacgccgugcgcaaacugcaagaaagcggguucuauugguccgcggugaccggaggcgaggcuaaucuccugcuuucugccgaaccggccgggacauuucugaucagagauagcuccgaccagcggcauuucuuuacccucagcgucaagacacagucuggaaccaaaaaccugcgcauucagugcgagggcggguccuucagccugcaaucugaucccagauccacacagccugugccccgguuugacuguguucucaagcuggugcaccauuacaugccucccccuggagcuccgagcuuccccucuccucccaccgaaccuuccagcgagguccccgagcagccguccgcccagccucuucccggcucuccuccccgcagagcuuauuacaucuauagcggcggggaaaagauuccccuggugcucucccggccucugagcucuaauguugccacgcuucaacaccugugccgcaaaaccgugaacggacaucucgauuccuacgagaaggucacacagcugccgggccccaucagagaauuucuggaccaguaugaugcgccucucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1931 - RNA, 700 nt, Artificial Sequence
  mRNA product Design1 comprising derived and/or modified sequence from Homo sapiens__NP_003227.1__HsTGFA (opt5)
gggagaaagcuuaccauggugcccagcgccggccagcuggcucucuucgcccuggggaucguccuugcggcuugccaagcccuggagaacuccaccucuccucucagcgccgacccgcccguugcugccgcuguggugucccacuuuaaugauuguccugacucucauacacaguucugcuuucacggaacguguagauuccugguccaggaagauaagcccgccugcgugugucauagcggcuacguuggggcgcggugcgagcacgccgaccuucuggcuguggucgccgcuucccagaaaaagcaagccauuaccgcgcucgugguugugucuaucgucgcccuggcugugcugauuaucacaugugugcucauucauugcugucagguccgcaaacacugcgaaugguguagagcccugaucugccggcacgagaagccuagcgcccuucugaaaggacgcaccgcuugcugucauuccgaaacaguugugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1932 - RNA, 1390 nt, Artificial Sequence
  mRNA product Design1 comprising derived and/or modified sequence from Homo sapiens__NP_000651.3__HsTGFB1 (opt5)
gggagaaagcuuaccaugcccccuagcggccugagacuccugccgcuucugcucccccugcuuuggcugcucgugcugaccccugggcggcccgccgcuggacuguccacaugcaagacgaucgacauggagcucgucaaacgcaagagaauugaagccauccggggccagauucugucuaaacuucgccuggcgagcccucccucccaaggggagguuccuccgggaccccucccugaagcugugcuggcccuuuacaacucuaccagagaucggguggccggcgagagcgcugaacccgagccugagcccgaagccgacuauuacgcuaaggaggucacacgcgugcugaugguugaaacccacaaugagaucuaugauaaauucaagcaguccacacauucuauuuacauguuuuucaacaccagcgagcucagagaagccgugccggagccuguccugcugucccgggcggaacuccgccugcuuagacugaagcucaaaguggagcagcacguugaacuguaucagaaguacagcaauaacucuuggcgguaucuuuccaaucgccugcucgcccccagcgacucuccugaguggcuguccuuugaugugacaggggucgugagacaauggcugagccggggaggcgagaucgaaggcuuccgccucucugcucauuguuccugcgacagcagagauaacacccuucagguggacaucaauggguuuacgaccggacggagaggcgaucuggccacaauucacgggaugaaccgccccuuccugcuccugauggcuacaccccuugagcgggcccagcaucugcaguccucuagacaccgccgggcgcucgacaccaauuacuguuuuagcuccaccgagaaaaacugcugugucagacaacuguacaucgauuuccgcaaggaccugggauggaaauggauucacgaaccuaagggcuaucaugccaauuuuugccucgggccgugucccuacaucuggagccuggauacgcaguauucuaagguucuugcucuguacaaccagcacaauccuggagccuccgcugcccccugcugugugccucaggcccucgaaccccugccgauuguguauuacgucggccggaaaccuaagguggagcaacugagcaacaugaucguuagaucuugcaaauguagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1933 - RNA, 1462 nt, Artificial Sequence
  mRNA product Design1 comprising derived and/or modified sequence from Homo sapiens__NP_003229.1__HsTGFB2 (opt5)
gggagaaagcuuaccaugcacuacugcgugcugagcgccuuccucauccugcaucuugucaccguugcucugucccucucuacauguagcacgcuggacauggaucaguuuaugagaaagcggauugaggccauccgcggccaaauucuuuccaaacugaagcucaccucucccccugaagacuauccggagcccgaagaggugccucccgaagugaucagcauuuacaacuccacaagagaucugcugcaggagaaagcgucucggcgcgcugccgccugcgagagagaacggagcgacgaggaauauuacgcuaaggaggucuauaaaaucgauaugccucccuucuuuccuuccgagaaugccaucccgcccaccuucuaccgcccuuauuuuagaauugugcgguucgacguuagcgcuauggaaaagaacgccucuaaucucgugaaggcggaguuucgcgucuucagacugcagaaccccaaagcccgggugccugaacagcgcaucgagcuuuaccaaauucugaaguccaaagaucucacaagccccacccagagauacaucgacucuaagguugugaaaacacgggcugaaggggaguggcuguccuuugaugucaccgacgccgugcacgaguggcuucaucacaaggaucgcaaucugggauucaagauuagccuccauuguccgugcuguacguuugugccuucuaacaauuauaucauucccaacaaauccgaggaacuggaagcuagauucgccggcaucgacgggaccagcacauacaccuccggagaucagaagacaaucaaaucuacccggaagaaaaauagcggcaagacgccucaucugcuccugaugcuucugcccuccuauagacucgagagccagcaaacaaaccgccggaaaaagagagcgcuggacgccgcuuacugcuuucgcaauguccaggacaacuguugccuucggccccuguauauugauuucaagagagaccucggguggaaauggauccacgaaccuaagggauacaaugccaacuucugugcuggcgccugcccguaucuguggucuuccgauacccagcacagccgcguucugucucucuacaauacaauuaaccccgaggccagcgcuuccccuuguugcgugucucaggaccuggagccccuuaccauccuguacuauauuggcaaaaccccuaagaucgaacaacucagcaacaugaucgugaaauccugcaaguguagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1934 - RNA, 1456 nt, Artificial Sequence
  mRNA product Design1 comprising derived and/or modified sequence from Homo sapiens__NP_003230.1__HsTGFB3 (opt5)
gggagaaagcuuaccaugaagaugcaccuucagagagcccucgugguccuggcucugcugaacuucgccaccguuagccucucccugucuacaugcacgacccuugacuuuggccauaucaaaaagaaacggguggaggcgauucgcgggcaaauccugagcaagcucagacugacaucucccccugaaccgaccgugaugacacacguccccuaccaggugcuggcucucuauaauuccacccgggagcugcuugaagagaugcauggagaacgcgaggagggcuguacacaggaaaacaccgagagcgaauacuaugccaaagagauucacaaguucgauaugauccaggggcuggccgagcauaaugaacucgcuguuugcccuaagggaauuacguccaaaguguuuagauucaacgucucuagcguggagaagaaucggaccaaccuguuucgcgccgaguucagaguucuucgggugcccaauccuuccagcaaacgcaacgaacaaagaaucgaacuguuucagauccuccggcccgacgagcacauugcuaagcagcgcuacaucggcgggaaaaaucugccuacaagaggaaccgccgaguggcugucuuucgaugucacagacaccgugcgggaauggcuccugcgcagagaguccaaccuuggccuggaaauuagcauccacuguccgugccauacguuucagcccaauggcgauauucucgagaacauccacgaagugauggagauuaaguucaagggggucgacaaugaggaugaccauggacggggcgaucuggggagacuuaaaaagcaaaaagaccaccacaacccucaucugauccucaugaugauucccccucaccgccuggauaaucccggacagggcgggcagcggaagaaaagagcgcuggacacaaacuauuguuuucgcaaccucgaagagaauugcuguguucggccgcuguacaucgauuucagacaggaccuuggauggaagugggugcaugaaccuaaaggcuauuacgccaacuuuugcucuggccccuguccuuaccugcgcuccgcugacaccacacacagcaccgugcucgggcuguauaauacccuuaaccccgaggccucugcuucccccugcugugucccucaagaucuggaaccgcucacaauccuguacuaugugggacggacgcccaagguugagcagcugagcaauaugguggucaaguccugcaaaugcucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1935 - RNA, 1603 nt, Artificial Sequence
  mRNA product Design1 comprising derived and/or modified sequence from Homo sapiens__NP_001057.1__HsTNFRSF1B (opt5)
gggagaaagcuuaccauggcccccguggcugucugggccgcgcuggcuguuggccucgagcugugggccgccgcucacgcccuuccugcucagguggccuucaccccguacgcgcccgaaccugggagcacaugcagacugcgggaguauuacgaccaaacggcccagauguguugcuccaaguguucucccggacagcaugcuaaaguguuuugcaccaagacaagcgauaccgucugugacuccugcgaagauucuacauauacccagcucuggaacugggugccugagugucugagcugcggcucccgcuguucuagcgaccaaguugaaacacaggccugcaccagagagcagaaucggaucuguacgugccgccccgggugguacugcgcucuuuccaaacaggagggauguagacugugcgccccucuccggaagugucgcccgggcuucgggguggcgagacccggaaccgaaacaagcgaugucgugugcaaaccuugugcccccggcaccuuuucuaacacaaccuccagcacggacauuugccggccucaccaaaucuguaauguuguggcuauucccggcaacgccucuauggaugcugucugcacauccaccagcccgacacgcucuauggccccuggggccgugcaucugccccagccuguguccaccagaagccagcacacccagcccacacccgagccuuccacggcuccgucuaccagcuuccugcuccccaugggaccuuccccucccgcggaaggcagcacaggggacuuugcccugcccgucggacuuaucguuggcgugaccgcucuggggcuccugauuaucggaguggucaauugugugaucaugacacaaguuaagaagaaaccgcuuugccugcagcgggaggccaaggugccucaucuccccgccgauaaagcucgcggcacccagggcccugagcaacagcaucugcugauuacggcccccucuuccagcucuagcucccucgaaucuagcgcguccgcucuggacagacgggccccuacacgcaaccagccccaggccccgggggucgaggcuagcggagccggcgaagcuagagccucuaccggguccagcgauucuuccccuggaggccacgggacccaagugaauguuacauguaucgugaacgucugcagcuccucugaccacagcucccagugcucuagccaggcguccagcaccaugggagauacagacucuucccccagcgagucucccaaggacgaacaggugccuuucuccaaagaggagugugccuuucggagccaacuugaaacgccggagacccugcucggcucuacagaagagaagccccugccucuuggcguccccgaugcugggaugaagccuagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1936 - RNA, 730 nt, Artificial Sequence
  mRNA product Design1 comprising derived and/or modified sequence from Homo sapiens__NP_002623.2__HsPGF (opt5)
gggagaaagcuuaccaugcccgugaugagacuguucccuugcuuucuccagcugcuugccggccuggcucucccggccguucccccucaacagugggcgcugagcgcugggaacggauccucugaggucgaaguggugcccuuccaggaggucuggggccggagcuacugucgcgcccuugaaagacugguggacguuguguccgaguauccuucugaagucgagcacauguuuagccccuccugcgugucucuccugcgguguaccgggugcuguggagaugagaaucugcauugcguuccuguggaaacagccaacgucacgaugcagcuccugaagauccgcagcggcgacagaccguccuacguggagcuuaccuucagccaacacgugcggugugaaugccgcccccugagagagaaaaugaagccugagcggcgcagacccaaagggcggggaaagcgcagacgggaaaaacagcgcccuacagauugucaucucugcggcgacgcuguccccagacggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1937 - RNA, 1456 nt, Artificial Sequence
  mRNA product Design1 comprising derived and/or modified sequence from Homo sapiens__NP_001020537.2__HsVEGFA (opt5)
gggagaaagcuuaccaugaccgacagacagacagauacggcccccagcccuuccuaccaccuucucccgggccggcgcagaaccguggacgcugccgcgucucgggggcaaggacccgagccugcucccggcgggggagucgaaggcguuggggcccgcggaguggcccugaagcuguucgugcagcugcucggcugcagcagauuuggcggggcugucgugcgggccggagaggcugaaccuuccggcgccgcgcgcucugccagcuccgggagagaggaaccccagccugaggagggagaagaggaagaggagaaagaagaggaacggggcccgcaguggcgccugggggcuagaaagcccggaucuuggacaggcgaggccgcuguuugugccgauagcgcgccugccgcucgggcuccccaagcccuugcccgcgccuccggcagagggggacggguggcucgcagaggcgcggaagagagcgggccuccccauucuccgucccggagaggaagcgccucucgcgcuggcccugggcgggccuccgagaccaugaacuuccugcucagcuggguccacuggucucuggcccugcuccuguaucuucaucacgcuaaauggucccaggccgcgcccauggcugaaggaggcggccagaaucaucacgaggugguuaaguuuauggacguguaccagagaagcuauugccacccuaucgaaacacuggucgauauuuuccaagaguaccccgacgaaaucgaguauauuuuuaaacccuccugugugccucucaugcgcugcgggggauguugcaacgaugagggccuggaaugugugccgaccgaggaaucuaauaucacaaugcagauuaugcggaucaagccccaucaggggcagcacaucggagagaugagcuuccuucaacauaacaagugcgaauguagaccuaaaaaggaccgcgcccggcaggagaaaaaguccgucagaggcaaagggaagggccagaagcgcaaacggaagaaaagcagauacaagucuugguccguuuaugugggagcccgcugcugucugaugcccuggagccucccuggcccccacccgugcgggccuugcucugagcggagaaaacaccuguuugugcaagauccccagaccuguaagugcagcuguaaaaauacggacucccggugcaaggcucgccagcuggaacucaacgagagaaccugucggugcgauaagccuagacgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1938 - RNA, 916 nt, Artificial Sequence
  mRNA product Design1 comprising derived and/or modified sequence from Homo sapiens__NP_001165094.1__HsVEGFA (opt5)
gggagaaagcuuaccaugaacuuccugcucagcugggugcacuggucccuggcccuucugcucuaccugcaucacgcuaaguggucucaggccgcgcccauggcugagggcgggggacaaaaucaucacgaagucguuaaauuuauggacguguaucagagaagcuacugccauccuaucgagacccuuguggauauuuuccaggaauauccggacgagaucgaauacauuuuuaagcccuccugugucccucugaugcggugcggcggguguugcaacgaugagggacucgagugugugcccacagaagagucuaauaucacgaugcagauuaugcgcaucaaaccucaccaaggccagcacaucggggaaaugagcuuccugcagcauaacaagugcgaguguagacccaaaaaggaccgggcccgccaggagaagaaauccguuagaggaaagggcaaaggccaaaagcggaaacgcaagaagucuagauauaaaagcugguccguguacgucggggcccggugcugucugaugccuuggagccucccgggaccccacccuugcggccccuguucugaacgcagaaagcaucuguuugugcaggauccucagaccugcaaaugcuccuguaagaauacagacagccggugcaaagcucgccagcuugagcugaacgaaagaaccugucggugcgauaagccccgcagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1939 - RNA, 841 nt, Artificial Sequence
  mRNA product Design1 comprising derived and/or modified sequence from Homo sapiens__NP_003368.1__HsVEGFB (opt5)
gggagaaagcuuaccaugagcccccugcucagacggcugcuucuggccgcucuccugcagcuugccccugcgcaagcuccggugucccagcccgacgccccuggccaccagcgcaaggucguuucuuggaucgauguguacaccagagccacaugccagccccgggagguggucgugccucugacgguugaacucauggggaccguggcuaagcaacugguccccagcugugugacaguucagcgcugcggaggcuguugcccugacgaugggcuggagugugugccgaccggacagcaucaggucagaaugcaaauucucaugauccgguaucccuccucucagcugggcgaaaugagccuugaggaacacucccagugcgagugucgcccuaagaaaaaggacucugccgugaaacccgauagagcugccacaccucaucaccggccccagccgcgcagcgugccugggugggacuccgcgcccggagccccuagccccgcugauauuacccaucccaccccugccccgggccccucugcucacgccgcgccuuccacaacgagcgcccugacccccggcccugcugccgcugccgccgacgcugcggccucuuccgucgcuaaagggggagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1940 - RNA, 1477 nt, Artificial Sequence
  mRNA product Design1 comprising derived and/or modified sequence from Homo sapiens__NP_005420.1__HsVEGFC (opt5)
gggagaaagcuuaccaugcaucugcucggcuucuuuagcguggccugcucccugcuugcugccgcgcugcuccccgggccuagagaggcuccggccgccgcugccgcuuucgaaucuggacuggaccuuagcgaugccgagcccgacgcgggcgaagccaccgcuuacgccuccaaggaucuggaggaacagcuccggucugucagcuccguugacgagcugaugacagugcuguauccugaguacuggaaaauguauaagugucaacuccgcaaagggggauggcagcacaacagagaacaggcuaaucugaacucucggacggaggaaaccaucaaguuugccgcggcccacuacaauacagagauucuuaaaagcaucgauaacgaguggcgcaagacccagugcaugcccagagaaguguguauugacgucggcaaggaguucgggguggcuacaaauaccuuuuucaaaccucccugcguuuccguguaucgguguggaggcugcuguaacagcgaaggccugcaaugcaugaauacaucuaccuccuaccucagcaagacgcuguuugagaucaccgucccucuuucucaggggccgaaacccgugacaauuuccuucgccaaccauaccagcugucgcugcaugucuaagcuggauguuuauagacaggugcacuccaucauccggcgcagccucccugcuacacugccccagugucaagccgccaauaaaaccugcccuacgaacuacauguggaauaaccauauuugcagaugucuggcucaggaagacuuuauguucuccucugaugcgggagacgauagcacagacggcuuucacgauaucugcgggcccaauaaggagcucgacgaggaaaccugucagugcgucugucgggccggacugcgcccggcuuccugcggcccucacaaggagcuugacagaaacagcugucagugcguguguaaaaauaagcuguuccccucucaaugcggggccaaccgggaauuugaugagaacacaugucagugcgugugcaaacgcaccuguccuagaaaucagccccucaaccccggaaagugcgccugugaaugcaccgaguccccucaaaaaugucugcuuaagggcaaaaaguuccaucaccagacaugcagcuguuaccggagaccgugcacgaaucgccagaaggcuugugagcccggcuucucuuauagcgaagaggucugccgguguguuccuuccuacuggaaaagaccccagaugucuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1941 - RNA, 1282 nt, Artificial Sequence
  mRNA product Design1 comprising derived and/or modified sequence from Homo sapiens__NP_004460.1__HsVEGFD (opt5)
gggagaaagcuuaccauguacagagaguggguggucguuaacguguucaugaugcuguaugugcagcucguccaaggcagcuccaaugaacacgggcccgugaagcggucuagccaguccacccuggagcgcucugaacagcagaucagagccgcuagcucccuugaggaacugcuccggauuacacauucugaggacuggaaacuguggcgcugcagacuucggcucaagagcuuuacguccauggauagccgcucugccucccacagaagcacccgguucgcggcuacauuuuacgacaucgagacccugaaaguuauugaugaagaguggcaacgcacacaguguucuccuagagaaaccugcguggaggucgccuccgagcugggaaagagcacaaacaccuucuuuaaaccgcccugugugaauguuuuccggugcggcggguguugcaacgaagagucucugaucuguaugaauacguccaccagcuauauuuccaagcagcucuuugaaaucucugugccucugacaagcguccccgagcuugugccugugaaggucgccaaccauaccggaugcaaaugucugcccacagcuccucgccacccguacuccaucauuagacggagcauccagauucccgaagaggaccgcugcucucauuccaagaaacucuguccuaucgauaugcugugggacagcaauaagugcaaaugcguucuucaagaggaaaacccccuggccggcaccgaggaucacucucaccuccaggaaccugcucugugugggccccauaugauguucgacgaggauagaugcgaaugugugugcaagacgccguguccuaaggaccugauucagcaccccaaaaauugcagcuguuuugagugcaaggagucccucgaaacauguugccagaaacauaagcuguuccacccugauaccuguucuugcgaggaccggugccccuuucacacaagacccugugccagcggaaaaaccgcgugcgccaagcauugucgcuucccuaaagaaaagcgggcugcccaaggcccgcacuccagaaagaaccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1942 - RNA, 847 nt, Artificial Sequence
  mRNA product Design1 comprising derived and/or modified sequence from Homo sapiens__NP_061986.1__HsFGF21 (opt6)
gggagaaagcuuaccauggacucagacgaaacaggauuugaacacucaggauuauggguaucaguauuagcaggauuacuacucggagcaugccaagcacacccaaucccagacucaucaccauuauuacaauucggaggacaagucagacaacgauacuuauacacagacgacgcacaacaaacagaagcacauuuagaaauaagagaagacggaacaguaggcggagcagcagaucaaucaccagaaucacuacuacaacuaaaagcacuaaaaccaggaguaauacaaauauuaggaguaaaaacaucaagauucuuaugccaaagaccagacggagcacuauacggaucauuacacuuugauccagaagcaugcucuuucagagaacuacuacuagaagacggauacaacguauaccaaucagaagcucauggacuaccuuuacaccuaccaggaaacaaaucaccacacagagauccagcucccagaggacccgcaagauuccuaccauuaccaggauuaccaccagcauuaccagaaccaccaggaauacuagcaccacaaccaccagacguaggaucaucagacccauuaucaaugguaggaccaucacaaggaagaucaccaucauacgcaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1943 - RNA, 1627 nt, Artificial Sequence
  mRNA product Design1 comprising derived and/or modified sequence from Homo sapiens__NP_002412.1__HsMMP1 (opt6)
gggagaaagcuuaccaugcacucauuuccaccacuauuauuacuacuauuuuggggagucguaucacauagcuuucccgcaacacuagaaacccaagaacaagacguagacuuaguacaaaaauaucuagaaaaauacuauaaccucaaaaacgacggaagacaagucgaaaaaagaagaaacagcggaccaguuguagaaaaacuaaaacaaaugcaagaauuuuucggauuaaaaguuacuggaaaaccagacgcagaaacacuaaaaguaaugaaacaaccaagaugcggaguaccagauguagcacaguucguauuaacagaaggaaacccacguugggaacaaacacaucuuacauacagaauugaaaauuacacaccugaccuaccaagagcagacguagaccacgcaauagaaaaagccuuucaauuauggucaaacguaacaccauuaacauucacaaaaguuucugaagggcaagcagacauaaugaucucauuuguuagaggagaccaccgagacaauagcccauucgacgggccaggaggaaaccuagcacaugcuuuccaaccaggaccuggaauaggaggcgacgcacauuucgacgaagacgaacgauggacaaacaauuucagagaauacaaccuacauagaguagcagcccacgaauuaggccacagccuaggcuuaucacacucaacagacauuggagcucuaauguacccuuccuacacauuuucaggagacguacaauuagcccaagacgauauagacggaauacaagcaauauacggacgaucacaaaacccaguacaaccaauaggaccacaaacaccaaaagcaugcgacucaaaauuaacauuugacgccauaacaacaauaagaggagaaguaauguuuuucaaagaccgauuuuauaugagaacaaauccauucuacccagaaguagaauuaaacuuuauaaguguauucuggccucaauuaccaaacggauuagaagcagcauaugaauuugcagacagagacgaaguacgauucuuuaaaggaaauaaauacugggccguacaaggacaaaacguauuacauggauacccaaaagacauauacagcucauucggguuuccaagaacaguaaaacacauagacgccgcauuaucagaagaaaacacaggcaaaacauauuuuuucguagcaaacaaauacuggagauacgacgaauacaaaagaucaauggacccaggauauccaaaaaugauagcacacgauuucccuggcauugggcacaaaguagaugcaguauucaugaaagauggcuuuuucuacuucuuucacggaacucgacaauacaaauucgacccaaaaacaaaaagaauacucacacuacaaaaagcaaacaguugguucaauuguagaaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1944 - RNA, 1387 nt, Artificial Sequence
  mRNA product Design1 comprising derived and/or modified sequence from Homo sapiens__NP_002412.1__HsMMP1(1-19,100-469) (opt6)
gggagaaagcuuaccaugcauucauucccaccacuacuauuauuauuauucuggggaguaguaucacauucauuuguacuaacugaaggaaauccuagaugggaacaaacucacuuaaccuauagaauagaaaacuauacaccagaccuaccaagagccgacgucgaccacgcaauugaaaaagcauuccaauuauggaguaacguaacaccacuaacauucacaaaaguaucagaaggacaagcagacauaaugauaucauuugucagaggagaccaccgagacaacucaccauuugacggaccuggaggaaaucucgcacacgcauuccaaccaggaccaggaauaggaggagacgcacauuuugaugaagaugaacgauggaccaacaauuuuagagaauacaaccuacaccgaguagccgcacacgaacucggacacagccuaggacuaucacacucaaccgacaucggagcacuaauguacccaucauacacauucuccggagacguccaacuagcucaagacgacauagacggaauacaagcaauauacggaagaucacaaaauccuguacaaccaauaggaccacaaaccccaaaagcaugcgacucaaaauuaacauuugacgcaauaaccacaauuagaggugaaguaauguuuuucaaagauagauuuuacaugagaacaaaucccuucuauccagaaguagaauuaaauuucauaucaguauucuggccacaacuaccaaauggauuagaagcagcauacgaauuugcagauagagacgaaguaagauucuucaaaggcaacaaauacugggcaguacaaggccaaaacguacuacacggauauccuaaagacauauacucuuccuuuggauuuccuagaacaguaaaacacauagaugccgcacuaucagaagaaaacaccggaaaaacauacuucuucgucgccaauaaauacuggagauacgacgaauauaaacgaucaauggacccagguuacccaaaaaugauagcacacgauuucccaggaauaggacacaaaguugacgcagucuuuaugaaagacggauuuuucuacuucuuucacggaacacgacaauacaaauucgaucccaaaacuaaaagaauccuaacuuuacaaaaagccaauucuugguuuaauuguagaaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1945 - RNA, 3574 nt, Artificial Sequence
  mRNA product Design1 comprising derived and/or modified sequence from Clostridium histolyticum__BAA77453.1__ColG (opt6)
gggagaaagcuuaccaugaaaaaaaacauacucaaaauucuaauggacucauacucgaaagaaucaaaaauacaaacaguccgcagaguuacaucagucucguuacuagcaguauaccugacgaugaacacauccucguuaguacucgcuaaaccuauagaaaauaccaacgauaccaguauaaaaaacguagaaaaauuaagaaaugcaccaaacgaagaaaacaguaaaaaaguagaagacaguaaaaaugacaaaguagaacauguaaaaaacauagaagaagcaaaaguugaacaaguagcaccagagguaaaauccaaaagcacauuaagaagcgcgucaaucgccaacacaaauucagagaaguacgacuucgaauacuuaaacggauuaaguuauacagaacuaacaaaucucauuaaaaauaucaaauggaaccagauaaauggacuauuuaauuacucaacaggaucacaaaaauuuuucggagacaaaaauagaguacaagcaauuauaaacgcuuuacaagaaagcggacgaacguauacagcaaacgauaugaaaggaauugaaacauucacagaaguacuacgcgcugguuuuuaucugggcuauuauaacgacggacuaucauaccucaacgaccgaaacuuccaagauaaaugcauaccagcgaugauugcaauucaaaaaaacccaaacuuuaaacuaggaaccgcaguccaagaugaaguaauaacgucgcucggaaaacuaauaggaaaugcaagcgcuaaugcagaaguuguaaauaacuguguucccguacuaaaacaauuccgagaaaauuuaaaucaauacgcaccagauuacgucaaaggaacggccguuaaugaacuuaucaaaggaauagaauuugauuucucaggagcagcuuaugaaaaagacguaaagacuaugccaugguacggaaaaauagaucccuuuauaaaugagcugaaggcacuaggccuuuacggaaacaucacaucagcuacagaaugggcgucagaugucgggauauacuaucuaucaaaauucggacuuuacucaaccaaccgaaaugauauaguacaauccuuagaaaaagcaguagauauguauaaauacggaaaaauagcuuucgucgcaauggaacgaaucacaugggauuaugacgguauaggaagcaauggaaaaaaaguagaucaugacaaauuccuagaugacgcagaaaaacauuaccuccccaaaacauacaccuucgauaacggcacauucauaauaagagcuggagacaaaguaucagaagaaaaaaucaaacguuuauacugggcaucacgagagguuaaaucacaauuccauagaguagucgguaaugacaaagcauuagaaguaggcaaugcagacgacguacucacaaugaaaauauucaauucuccugaagaauauaaauuuaauaccaacauuaacggaguaucuacagacaauggaggccuuuacauagaaccaagaggaacguucuauaccuacgaaagaacaccacaacaaucaaucuuuucauuagaagaacuauuuagacacgaauacacacacuaucugcaagcacgauaccugguggauggacuauggggacaagggccauuuuaugaaaaaaaccgcuuaacaugguuugaugaaggcacagccgaauuuuucgcaggaucaaccagaacaucgggugucuuaccacggaaaucaauacucggguacuuagcaaaagacaaaguagaucauagauauucauuaaaaaaaacacuaaauaguggauaugaugacucggauuggauguuuuacaacuaugguuuugcgguagcacauuauuuauaugaaaaagauaugcccacauucauaaaaaugaacaaagcuauauuaaauaccgauguaaagagcuaugaugaaauaauaaaaaaacucagugaugaugcaaauaaaaacacugaauaucaaaaccacauacaagaacuagcagacaaauaccaaggagcagguauuccguuaguuucagaugauuacuuaaaagaccacggauauaaaaaagcaucagaaguauacagugaaauaucgaaagcagccagccuuacaaacaccucaguaacagcagagaaaagucaauauuucaacacauuuacacuaagaggaacauacacgggggaaaccucaaaaggagaauuuaaagauugggaugaaauguccaaaaaacuagacggaacacuagagagcuuagcuaaaaacaguuggagcggauacaaaacuuuaacggcauacuuuacuaacuaccgaguuacaagugacaauaagguucaauacgacguaguauuucacggaguacuaacagacaacgcugauauuaguaacaacaaagcgccuaucgcuaaaguaacaggaccaucgacuggggcagucggaaggaacauagaauuuucugggaaagacaguaaagaugaagacggaaaaauaguuaguuacgauugggauuuuggcgauggagcuaccucucguggaaagaacucugugcaugcauacaaaaaagcaggaacauauaacguaacccuaaaaguaacagacgacaaaggagcaacagcuacagagagcuuuaccauagaaauaaaaaacgaagauacaacgacaccaauaacaaaagagauggaaccuaaugaugacauaaaagaagcuaacggacccauaguggaaggaguaacagugaaaggagaccugaauggcagcgaugacgcugauacuuuuuauuucgaugucaaagaagacggugacguaaccauugaacuaccguacagcggcaguucaaauuuuacaugguugguauauaaagaaggagacgaccaaaaccacauagcaucuggaauagauaaaaauaacucaaaaguugguacauuuaaaaguacaaaagguagacacuauguauucaucuauaaacacgacagcgcaucaaacauauccuauucccucaauauaaagggacuaggaaaugaaaaacugaaagaaaaagaaaauaacgauuccagugacaaagcaacuguaaucccaaauuuuaauacaacaaugcaaggaucuuuauuaggagacgauagucgcgacuauuacucauuugaagugaaagaagaaggagaaguaaauauagaacuugacaaaaaagacgaguucggaguaaccuggacucuccacccagaaucaaauauaaacgauagaaucacauacggacaaguagacgguaacaaagucucaaauaagguaaaacuuagaccagggaaauacuauuuacucguauauaaauacucuggcagcggcaacuacgaguuacggguuaacaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1946 - RNA, 3298 nt, Artificial Sequence
  mRNA product Design1 comprising derived and/or modified sequence from Clostridium histolyticum__BAA77453.1__HsALB(1-18)_ColG(111-1118) (opt6)
gggagaaagcuuaccaugaaaugggucaccuuuauaagucuacuuuucuuauuuuccucagcauauagcauagcaaauacaaauuccgaaaaauaugacuucgaauaccuaaacggucuuaguuacacagaauuaacuaaccuaauuaaaaacauaaaauggaaucaaauaaauggcuuauuuaauuauucaacagguagucaaaaauucuucggagauaaaaacagagugcaagcaauaauaaacgcccuacaagagucaggacgaacauauacagcaaaugacaugaaaggaauagagacauucacagagguauuacgugccggauucuaccuaggauacuacaacgacgguuuaucuuacuuaaaugacagaaacuuccaggauaaauguauaccagcaaugauagcaauacagaaaaacccuaauuucaaacucggaacggcgguucaagacgaaguaauuacaucuuuagguaaauugauaggaaacgcaucagcgaacgccgagguaguaaacaauugcguaccgguccuuaaacaauuuagagaaaaucuaaaccaauaugcaccagacuacgugaaaggaacagcagugaaugaauuaauaaaaggcauugaguucgacuucucaggagcagcauaugaaaaagauguaaaaacaaugccaugguacggaaaaauagauccauucauaaaugaacuaaaagcauuaggauuauacggcaacaucaccagugcaacugaaugggcaucagaugucgggauauacuauuuaucaaaauucggacucuauagcacaaaccgaaacgacauaguacaaucacuagagaaagcaguagacauguacaaauacgggaaaauagcauuuguagccauggaacgaauuacaugggacuacgauggcauagguagcaauggaaagaaaguagaucacgauaaauuccuugacgacgcagaaaaacacuaucuuccuaaaacauacacuuuugauaacgguaccuucauaauacgagccggugauaaaguaagcgaagagaaaauaaaaaggcuauauugggcaagcagagaagucaaaagccaauuucauagaguaguaggaaaugacaaagcacuagaaguuggaaacgcugacgauguucuaacaaugaaaaucuucaacucaccugaagaauacaaauucaacacaaacauaaauggaguaaguaccgacaacggaggauuauauauagaacccagggggacguuuuauaccuacgagagaaccccucaacaaucuauauuuuccuuagaagaauuauuucgacaugaauacacacacuauuuacaagcacgauauuugguagauggacuauggggacaaggaccauuuuaugagaaaaacagacuuacgugguucgacgaaggaacggcagaguucuuugcaggaaguacaagaacaaguggaguauuaccaagaaaaucaauacuagguuacuuagcaaaagacaaaguagaucacagauacagccuaaagaaaacacugaauagcgguuaugaugacagugauuggauguucuauaauuacggauucgcaguagcucacuaucuauaugaaaaagauaugccaacauucaucaaaaugaauaaagcaauacuuaacaccgacguuaaaucauaugacgaaauaauaaagaaauuaagugacgacgcaaacaaaaauaccgaauaccaaaaccacauccaagaacuagcagacaaauaucaaggugcaggaauaccauuaguaucagacgacuaccucaaagaccauggauacaagaaagcguccgaaguauacucagaaauaaguaaagcagcaucauugacuaauacuucaguaacagcagaaaaaucacaauacuuuaacacauucacacuucgcggaacauauacgggagaaaccucaaaaggugaauuuaaagauugggacgaaaugaguaaaaagcucgacggcacucuagaaucauuggcuaaaaacuccuggucaggauauaaaacacuaacagccuacuucaccaauuacagagucaccucagauaauaaaguacaauaugacguaguauuucauggagucuuaacagacaacgcugauauaaguaacaauaaagcgccuauagcgaaaguaacaggaccaucaacgggagcaguaggaagaaauauugaguucucaggaaaggauagcaaagacgaagacggaaaaauuguaucuuaugauugggauuucggagauggagcaaccucaagagggaaaaacagugugcaugccuacaagaaagcaggaacuuauaauguaacacuaaaagugacagaugacaaaggagcgacagcaacagagagcuucacgauugaaauuaaaaacgaagauacuacaacacccauaacaaaagaaauggaaccaaaugaugacauaaaagaagcaaacggaccgauaguggaaggcguaacgguaaaaggagacuuaaauggaagugaugacgccgacacauuuuacuuugauguuaaagaagacggugaugucacaauagaauuacccuacucugguaguuccaacuucacuugguuaguauacaaagaaggagaugaucaaaaucauauagcauccggaauagacaaaaacaauagcaaaguaggcacauuuaaauccacaaaaggacgucauuauguuuucauuuacaaacacgauagugcaaguaacauaaguuauucucuaaauauaaaaggacuagguaaugaaaaacuaaaagaaaaagaaaacaacgauagcagugacaaagcuacuguuaucccaaacuucaacaccacaaugcaaggcagcuuacucggagacgauucacgagauuauuacagcuucgaaguaaaagaagagggggaaguaaacauagaacuagauaagaaagacgaauuuggaguaacauggacacuacacccggaaucgaacauaaaugacagaaucacauauggacaaguagacggaaacaaaguaucaaauaaagucaaacuaagaccuggcaaauauuaccuauuaguguauaaauauucaggaucagguaauuacgaacugagagucaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1947 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt6)
gggagaaagcuuaccaugaaguggguaacuuucauaagucuucuuuuccuuuucucuucagcauacucgaugaagaaaaacauacuaaaaauacucauggauuccuauagcaaagaaaguaaaauacaaacaguacggagaguuacaucaguaagucuauuagcaguauaccuaacaaugaauacaagcuccuuaguauuagcaaagccaaucgaaaacacaaacgauacgucaauuaaaaacguagaaaaauuacgaaacgcaccuaaugaagaaaacucaaagaaagucgaagacagcaaaaacgauaaagucgagcacgugaaaaauauagaagaagcaaaaguagaacaaguagccccagaaguaaaaaguaaaucaacucuaagaucugcuucacgcagacgacguaaacgaauagccaacacaaauucagaaaaauaugauuucgaauaccuaaacggguuaucauacacagagcuaacgaaucuaaucaaaaacauaaaauggaaccaaauaaauggccuauuuaauuauagcacaggaucccaaaaauucuucggcgacaaaaaucgaguacaagcaauaauuaaugcacuacaggaaucuggcagaacauauacugcuaaugacaugaaaggaauagaaacauuuacagaaguacucagagcaggauuuuauuuagguuauuauaaugacggcuuaaguuaccuaaaugauagaaacuuucaagauaaaugcauaccugcaaugaucgcaauacagaaaaacccaaacuuuaaacuagggacagcgguacaagacgaaguaauaaccagcuuaggaaaacucaucggaaacgcuucugcaaacgcggaaguuguaaacaacugcguaccaguacuaaaacaauuccgagaaaaccuaaaucaauacgcuccagauuauguaaaaggaacggcuguaaacgaauuaauaaaagguaucgaauuugauuucagcggcgcagccuaugaaaaggacgucaaaacgaugccaugguauggaaaaauagacccauucauaaaugaacugaaagcacucggacuuuacgguaauauaacaagugcuacagaaugggcaucagacguaggaauauauuauuuaucaaaauucggauuauacucaacaaauagaaaugacauaguacaaagucuagaaaaagcggucgacauguacaaauauggcaaaauagcauuuguagcuauggaacgcauaacaugggacuaugauggaauagguucuaacgguaagaaaguugaucaugauaaauucuuagaugacgcagaaaaacacuacuuaccaaaaacauauacauucgacaacggcaccuuuauaauacgugccggagacaaaguuagugaagagaaaauuaaacgacuauacugggcuucgagagaaguaaaaucucaauuucacagagucgugggaaacgauaaagcacuagaaguuggaaacgcagaugauguccucacaaugaaaaucuuuaauuccccggaagaauacaaauuuaauacgaauaucaacggcgugucaacugauaauggaggacuguauauagaaccacgaggaacauucuacacuuaugaaagaaccccgcaacaaagcauuuucucccuagaagaacuauucaggcaugaauauacacauuaccuccaagccagauaccuaguugauggacuauggggacaaggaccguuuuacgagaaaaaucgauuaaccugguuugaugaaggaacggcagaguucuuugcaggaucaacaagaacaagcggaguacuaccaagaaaauccauacuagguuacuuagcaaaagauaaaguugaccacagauauaguuuaaagaaaacccucaacagugguuacgaugauucggauuggauguuuuacaacuacggauucgcaguugcgcacuacuuauacgaaaaagauaugccaacguucauaaaaaugaacaaagcaauacuaaauacugaugucaaaagcuacgaugaaauaauaaagaaacuaagugacgacgccaauaaaaauacagaauaccaaaaccauauacaagaacuagcugacaaauaccaaggugcgggaauaccucuaguaagugacgacuaucuaaaagaucauggauauaagaaagcaucagaaguuuacucugaaaucagcaaagccgcaucauuaacaaacaccucaguaacagcugaaaaaucacaauauuucaacacauucacacuaagggguacauauacaggcgaaaccaguaaaggagaauuuaaagauugggacgaaaugagcaagaaauuagauggaacucuagaaucuuuagccaaaaacucuuggucaggauacaaaacauuaacggcauauuucacgaacuauagaguuacaagugauaauaaagugcaauaugacguaguauuucacggaguccucacagauaacgccgauauuucaaauaauaaagcuccgauagcuaaaguaaccgguccauccacaggagcaguaggcagaaacauugaguucucugguaaagauaguaaagaugaagauggaaaaauagucucauacgacugggauuucggagauggagcaacaucaagagggaaaaacucaguacaugccuauaagaaagcgggaaccuauaacguaacccuaaaagucacagaugacaagggagcaacggcuacagaaaguuuuacaaucgaaauuaaaaaugaagacacaacaacaccaauaacgaaggaaauggaaccaaacgacgacaucaaagaagcuaacggaccaauaguugaaggaguaacaguuaaaggagauuuaaacggaucagaugaugcggacacuuuuuacuucgaugucaaagaagauggagacgucaccauugaauuaccuuauucaggaagcaguaacuucaccugguuaguauauaaagaaggagacgaucaaaaccacaucgcuagcggcauagauaaaaauaauucaaagguuggaaccuuuaagucaacaaaaggaagacacuauguauuuaucuacaaacaugauuccgccucaaacauauccuauagccugaauaucaaaggccuaggaaacgaaaaauuaaaagaaaaagaaaauaacgacagcucagauaaagcaacaguaauuccuaacuuuaacacuacaaugcaagguagccuauugggugacgauaguagagacuauuacagcuuugaagucaaagaagaaggagaaguuaauauagaacuagacaagaaagaugaguuuggaguaaccuggacauugcacccugaauccaauauaaaugacagaauuacuuauggccaagucgacggaaauaaagucucaaacaaagugaaacuaagaccggguaaauauuaccuuuugguguacaaauauaguggcucaggaaacuaugaauuaagggucaacaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1948 - RNA, 3322 nt, Artificial Sequence
  mRNA product Design1 comprising derived and/or modified sequence from Clostridium histolyticum__BAA34542.1__ColH (opt6)
gggagaaagcuuaccaugaacuuucucaaaauaauacugaaccguggcaaaacaaugaaaagaaaaugccuaaguaaaagacucaugcuggccaucacaauggcuacaauauucaccgucaacagcaccuuaccuauuuaugcagccguagacaaaaauaacgcuacugccgccguacaaaaugaaagcaaaagauacacugucucguaucuuaaaacacuaaauuacuacgaccuaguagauuuauuaguaaaaacagaaauagaaaaccuaccugaucucuuucaauacucaucagaugccaaagaauuuuacggaaacaaaacacgaaugucuuuuauaauggaugaaauaggccgcagagcuccacaauacaccgaaaucgaccacaaaggaauaccaacauuaguggaagugguaagagcaggauuuuauuuaggcuuccacaacaaagaacuaaacgaaauaaauaaaagauccuucaaggaaaggguaauacccucaauauuagcaauacagaaaaaccccaauuucaaacuaggaacagaagugcaagacaaaaucgucagcgcaacgggacuucuagccgguaacgaaacugcuccaccagaaguaguaaacaacuucaccccaauccuacaagacuguauuaaaaacauagacagauaugcauuagacgaucuaaagucaaaggcuuuauuuaacgucuuagcugcaccuacuuacgacauaacagaauaccucagggcaacaaaagaaaaaccggaaaauacaccuugguacggaaaaauagauggcuucauaaacgaacuaaagaaauuagccuuauacggaaaaauuaacgauaauaacucuuggauaauagauaaugguauuuaccacauagcuccguuagggaaacugcauaguaacaauaaaaucggaauagaaacauuaaccgaagucaugaaaguauacccauauuuaucaaugcaacacuuacaauccgccgaccaaaucaaaagacacuacgacagcaaagaugcagaaggaaauaaaauaccauuagauaaauucaagaaagaaggaaaagaaaaauacugcccaaaaaccuauacuuucgacgauggaaaaguaauaauaaaagcuggagcaagagucgaagaagaaaaaguaaaacgacucuacugggcaucaaaagaagucaacucacaauucuucagagucuauggcauagauaaaccgcuagaagagggaaaccccgaugacauccuaacaaugguaauauacaauucaccagaagaguauaaacuaaauagcguauuauacggauacgacacaaauaacggcggaauguacaucgaaccugaaggaaccuucuucaccuaugagcgagaagcccaagaaaguacauacacccuggaagaacuauucagacaugaauacacacauuaccuacaaggacgauacgccgugccaggacaaugggggcgaacgaaauuauacgacaacgacagacucacaugguaugaagaagguggagcagaauuauucgcaggcaguacccguacaucagguauccuaccaagaaaaucuaucgucaguaacauacacaacacaacuaggaauaaucgauacaaauuaucagacacaguacauuccaaauacggggccuccuucgaauuuuacaacuacgcgugcauguuuauggauuauauguauaacaaagauauggguauucuaaacaaauuaaacgaccuagccaagaauaaugacguggacggauacgacaacuauauuagggaccuaucaucaaauuaugcauuaaacgacaaauaccaagaccacaugcaagagaggauagauaauuacgaaaaccuaacaguaccauuugucgcagacgauuauuuagugcgacaugcauacaaaaauccaaacgaaaucuacagugagauuucagagguagcaaaacucaaggaugcgaaauccgaagucaagaaaagucaauacuucaguacauucacgcuaagaggaucauauacaggaggagccucaaaaggaaaauuagaagaccaaaaagcaaugaauaaauucauagacgauucauuaaagaaacuagauaccuacaguuggaguggcuauaaaacacucacugcauauuucacaaauuacaaaguagacucaucuaauaggguaaccuacgauguaguauuccacggauaccucccaaaugaaggcgacagcaaaaacucucucccauacggaaaaauaaacgggacauacaaagguacugaaaaagagaaaaucaaauucagcagcgaaggauccuucgacccagacggaaaaauuguuaguuaugaaugggacuucggagauggaaacaaaaguaaugaagaaaacccagaacauuccuaugacaaagucgggacuuacaccguaaaauuaaaaguuacagaugauaaaggcgaauccaguguaucaacaacaacagccgaaaucaaagacuuaagcgaaaauaaacuuccaguaauauauaugcacguaccaaaaucuggagcacuuaaccaaaaaguaguauucuacgguaaagguacauacgauccagacggaucaauagcuggguaucaaugggacuuuggagacgguucagauuucucaucagaacaaaaucccucccacguauacacaaagaaaggugaauacacagugacacuaagagucauggauagcagcggccaaaugucagagaaaacaaugaaaaucaaaauaacugaucccguauauccaauaggcacagaaaaagaaccaaacaacagcaaagaaacagccagcggaccaauaguaccaggcauacccgucaguggaacuauagaaaauacauccgaccaagacuacuuuuacuucgauguaauaaccccuggagaaguaaaaauagacauaaacaaauuagguuaugggggcgcaacauggguaguguacgaugaaaauaauaacgcaguaaguuaugcuacagacgacggccaaaaucuauccggaaaauucaaagcagacaaaccaggcagauacuauauucaucuauauauguuuaacgguagcuacaugccuuacaggaucaacauagaaggaagcguagguagauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1949 - RNA, 3283 nt, Artificial Sequence
  mRNA product Design1 comprising derived and/or modified sequence from Clostridium histolyticum__BAA34542.1__ColH (opt6)
gggagaaagcuuaccaugaaacguaaaugccuuucaaaacgucuaauguuggcaauuacuauggcaacaauauuuacaguuaauuccacacuaccaauauaugcagcuguagacaaaaacaaugccacagccgcaguacaaaaugaauccaaaagguacacugucaguuaucuaaaaacucuuaacuauuacgaccuaguugaccuauuaguaaaaacagaaauagaaaaccuaccagacuuauuccaauacucaucugaugcuaaagaauuuuacggaaauaaaacccgcaugaguuuuaucauggaugaaauaggaagacgagcgccucaauauacugaaaucgaucacaaaggaauaccgacgcuaguagaaguuguaagagccgguuuuuacuuaggcuuucacaacaaagaacuaaacgaaauaaauaaacgaucauuuaaagagagaguaauacccagcauccuugccauacaaaagaauccaaacuucaaauuaggaacagagguacaagacaaaauaguauccgccacaggccuauuagcaggaaaugagacagcacccccugagguagugaacaauuucacaccaauauuacaagauugcauuaaaaauauagauagauaugcucuagaugaucuaaaaucaaaagcacuauucaacguacuagcagcacccacauacgauauaacagaauacuuacgagcgaccaaagaaaaaccagaaaacacaccaugguacggaaaaauagacggcuuuauaaaugaguuaaagaaauuagcauuauaugguaaaauaaaugauaauaacagcuggauuauagacaacgggauauaucauauagcaccccuaggaaaacuacacucaaacaauaaaauaggaauagaaacauuaaccgaagucaugaaaguuuauccuuacuuauccaugcaacacuuacaaucagcagaucaaauaaaaagacauuaugauucaaaagacgcagaagguaacaaaauaccccuagacaaauuuaagaaagaaggaaaagaaaaauauugcccaaaaacauacacauuugacgacgggaaaguaaucauaaaagcaggagcgagagucgaagaagaaaaaguaaaaagacucuacugggcaucuaaagaaguaaacucccaauucuucaggguauauggaauagacaaaccauuagaagaaggaaaucccgaugacauuuugacaaugguaaucuauaauaguccggaagaauauaaacugaacagugucuuauacggauaugauaccaacaacgguggaauguauauagaaccagagggaaccuucuucaccuaugaaagggaagcccaagaaucaacauacacucucgaggaacuauuuaggcacgaauauacacacuauuuacaaggacgauacgcaguaccaggacaauggggcaggacaaaacuuuacgauaacgacagacuaacuugguaugaagaagguggcgccgaacuauucgccgguucaacucgcacaagcggaauauugccacgaaaaucaaucguaucuaacauacacaacacaacaagaaauaaccguuacaaacuaucagauacaguucacuccaaauacggagcaaguuuugaauuuuacaacuacgccuguauguuuauggacuacauguauaauaaagauaugggcauacuaaauaaacugaacgauuuagcuaaaaacaaugacguagacggcuacgacaacuacauaagagauuuaaguuccaacuaugcacuaaaugauaaauaucaagaucacaugcaagaaagaauagauaacuaugaaaauuuaacaguaccuuuuguggcagacgauuaccuuguucgacacgcauauaaaaaccccaaugagauauauucagaaauuucagaaguagcaaaauuaaaagaugcaaaaagcgaaguaaagaaaagccaauacuucuccacauuuacccuccgaggaucauacaccggcggagccuccaaaggaaaacuagaagaccaaaaagcuaugaacaaauucauagaugacucccuaaagaaauuagacacauauucaugguccggauacaaaacccuaacggcuuacuucacaaauuacaaagucgacuccucaaauaggguuacauacgacgucguauuucacggauaucuccccaaugagggagacaguaaaaauucccuaccauacgggaaaauaaacggaacauauaaagggacagaaaaagagaaaauaaaauucucgucugaaggaucuuuugaccccgacgggaaaauugugucauaugaaugggauuuuggagauggaaauaaaucaaaugaagaaaacccagaacacagcuaugacaaaguaggcacauacaccguaaaauuaaaaguaacagacgacaaaggagaaucaucaguauccaccaccacagcagaaauuaaagaucuaucugaaaacaaacucccaguaaucuauaugcacguaccuaaaaguggcgcucucaaucaaaaaguaguauuuuacggaaaaggaacauaugacccagacggaagcauagcaggguaucaaugggauuucggagauggaucugauuuuucuucagaacaaaacccaucgcacguauacaccaagaaaggagaauauacaguaacacuaagaguuauggauucaucuggacaaaugucugagaaaacuaugaaaauaaaaauaacagacccaguuuauccaauaggcacagaaaaagaaccaaacaacaguaaagaaacagcaucaggaccaaucgucccgggcauaccaguaaguggaacaauagaaaauacaagcgaccaagauuacuucuacuucgauguaauaacaccaggcgaaguuaaaauugacauaaacaaacucggauauggaggagcaacauggguaguauaugaugaaaacaauaaugccguaucuuacgccacagacgauggacaaaaccuaaguggaaaauuuaaagcugauaaacccggacgcuacuacauacaccuguauauguuuaacgguucauacaugccauacaggauaaacauagaagggagugugggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1950 - RNA, 3217 nt, Artificial Sequence
  mRNA product Design1 comprising derived and/or modified sequence from Clostridium histolyticum__BAA34542.1__HsALB(1-18)_ColH(41-1021) (opt6)
gggagaaagcuuaccaugaaauggguuacuuuuauaucauuacuauuccuauucucaucagcauacagcguacagaacgaaucaaaaagauacacaguaaguuacuuaaaaacguuaaacuacuacgaccuaguagauuuauuagucaaaaccgaaauugaaaauuuacccgaccuuuuccaauacucuuccgaugcaaaagaauuuuacggcaauaaaacacgaaugagcuucauaauggaugaaaucgguagacgagcuccccaauacacagaaauagaccacaaaggaaucccuacauuaguugaaguaguuagagcaggauucuaccuagguuuucauaacaaggaauuaaaugaaauaaauaaacgaucauucaaagaacgaguaauaccaucaauacuugcaauacagaaaaacccaaacuuuaaacuuggaacugaaguucaagacaaaauagugucagcaacaggacuccuagcuggcaaugaaacagcuccaccagaaguaguaaacaacuuuacaccaauauuacaagauugcauuaaaaauauagaccgcuacgcuuuagaugaucuaaaaaguaaagcacuauuuaacguacuggcagcaccuacuuacgacauaaccgaauaccuacgagcaacaaaagaaaaaccugaaaacacccccugguacggaaaaauagacggauuuaucaacgaacuaaagaaauuagcacuuuauggaaaaauuaacgauaauaauuccuggaucaucgacaauggcauauaccauauagcuccacuaggaaaauuacacucaaacaacaaaauaggaauagaaacacuaacggagguaaugaaaguauacccauaucuaucaaugcaacaccuacaaucagccgaucaaauaaaaagacauuaugacucaaaagaugcagaaggcaacaaaauaccacuagacaaauucaagaaagaaggaaaagaaaaauauuguccgaaaacauacaccuuugaugauggaaaaguaauuauaaaagcuggagcaagagucgaagaagaaaaaguuaaacgauuauauugggcaucaaaagaaguaaauagucaauuuuuccgcgucuauggaauagauaaaccccuugaggaaggaaauccagacgacauccuaacaaugguaauauauaauucaccugaagaauacaaauuaaauucaguacuauauggauacgacacaaacaacggaggaauguacauagaaccagaagguacauucuuuacauaugagagagaagcacaagaaagcacauacacucuagaagaacuauucagacacgaguacacccacuaccuacaaggucgauaugcuguaccaggacaauggggaaggacaaaacuauacgauaaugacagacuaaccugguacgaagaaggaggagccgaacuauucgcaggaagcacacguacaucagguauacuaccaagaaaauccauagucagcaacauacauaacacgacacguaacaacagauacaaauuaagugacacaguucauagcaaauauggagcuucauuugaguuuuauaacuacgcauguauguucauggauuacauguacaacaaagacaugggaaucuuaaauaaacuaaacgauuuagcuaaaaauaaugauguagauggauacgacaacuauauacgcgauuuaagcaguaacuacgcacuaaacgauaaauaccaagaucacaugcaagaaaggauagacaacuacgaaaauuuaacagucccauucgucgcagacgauuaccuagucagacacgccuauaaaaauccuaacgaaauauacucagagauuagcgaggucgcaaaauuaaaagacgcaaaaagugaaguaaagaaaagucaauauuucaguacauuuaccuuaagaggcucauauacaggcggagcaaguaaaggaaaauuagaagaucaaaaagcaaugaauaaauucauugaugacagccuaaagaaauuagacacauacucauggucgggcuacaaaacccuuaccgcuuacuuuacaaacuauaaagucgacaguucaaacagggucacauacgacguuguauuccacggcuacuuaccaaaugaaggagacaguaaaaacucccuaccauacggaaaaauaaauggaacguauaaaggaacagaaaaagagaaaauaaaauucucaucagaaggaucauucgacccggacggaaaaauuguuuccuacgaaugggacuucggggacgguaacaaaucgaacgaagaaaauccugaacauucauaugauaaaguaggaacauacacaguaaaacuaaaagucacagaugacaaaggagaaucguccguaucuaccacaacagcggaaauaaaagauuuaucagaaaauaaacuacccguuauuuacaugcaugucccaaaaagcggagcauuaaaccaaaaaguaguauuuuacggaaaaggcacauaugauccagacggaucaauugccgguuaucaaugggacuucggagacggaagcgacuucaguagugaacaaaaccccucccauguauacacaaagaaaggugaauacacagucaccuuaagaguaauggacucaucaggacagaugagugagaaaacaaugaaaauaaaaauaaccgaccccgucuauccaauaggaaccgaaaaagaaccaaauaauucaaaagaaacagcaucaggaccaauaguacccggcaucccaguaucuggcaccaucgaaaacaccucugaucaagacuacuucuacuucgacguaauaacaccaggugaaguaaaaauugauaucaauaaacuaggauacggcggagcaacauggguaguuuacgacgaaaacaacaacgcaguuagcuacgcuacagaugacggacaaaaccuaagugggaaauuuaaagcagacaaaccuggaagauauuauauccaucucuacauguucaacgguucuuauaugccauauagaauaaacauagaaggcucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1951 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt6)
gggagaaagcuuaccaugaaauggguuacauucaucagcuuacuauuccuauucaguagcgccuacagcaugaaaagaaaauguuuauccaaaagacuaaugcuagcuaucacaauggcuacaauuuucacagugaacucuacauuaccaauauacgcugcaguugauaaaaacaacgcaacagccgcuagaagaagaagaaaacgaguacaaaacgaaagcaaaagauacaccgucucuuacuuaaaaacacuaaauuacuacgaucugguagaccuucuaguaaaaacugaaauagaaaaucuaccagacuuauuccaauauucaagcgacgcaaaagaauuuuacggaaacaagacaagaaugaguuuuauuauggaugaaauuggacguagagcaccccaauacaccgaaauagaucacaaaggcauacccaccuuaguggaaguuguaagagccggguucuacuuaggauuucauaauaaagaauuaaaugaaauaaauaaacgauccuucaaagaaagagucauaccaagcauucucgcaauucagaaaaacccaaauuucaaacuaggaaccgaaguacaagauaaaauuguaucagcaaccggauuauuagcugguaacgaaacagcucccccugaaguaguaaauaacuuuacccccauauuacaagauugcauuaaaaauauagacagauacgccuuagacgaccuaaaaucaaaagcacuauucaauguccucgcugcuccaacauaugacauaacagaauaccuuagagcgacuaaggaaaaacccgaaaacaccccaugguaugguaaaauagaugguuucauaaacgaacuaaagaaacucgcacuauacggaaaaauaaacgacaacaauagcuggauaauagacaauggaauauaucauauagcaccauuaggaaaacuacauucaaacaauaaaaucggaauagaaacauuaacagaaguaaugaaaguauaucccuauuuaagcaugcaacaucuacagucugcggaccaaauaaaacgucauuacgacucuaaagacgcagaaggaaacaaaauuccacuagacaaauuuaagaaagaagggaaagaaaaauacugcccaaaaaccuacacuuuugaugauggaaaaguaauuauaaaagcuggagcacgcguagaagaagaaaaaguaaaacgauuauacugggccaguaaagaagugaauagucaauucuucagagucuauggaauugacaaaccucuagaagaaggcaacccagacgauauacuaaccaugguuauauauaauucuccagaagaauacaaacuaaauucaguauuauacggauaugauaccaacaacggagggauguacauagaaccugaagguacuuucuuuacauacgaaagagaagcacaagaaagcacauauaccuuagaggaacuauuuagacacgaauauacacacuaccugcaaggaagauaugcugugccaggacaauggggacguacuaaacuauacgacaacgauagacuaacaugguaugaagaaggaggagcagaacucuuugcuggcuccaccagaacaaguggaaucuuaccaagaaaaaguauaguaucaaacauacauaacacaacaagaaauaacagauacaaacucagcgacacaguacacucaaaauacggagcuagcuucgaauuuuauaauuacgcaugcauguucauggacuacauguacaacaaagauaugggaaucuuaaacaaacuaaaugaucuagcgaaaaauaaugauguugaugguuacgacaacuauauccgugaucucucaucaaacuacgcacugaacgacaaauaccaagaucauaugcaagaacguauagauaauuaugaaaauuuaacuguacccuucguagcagaugauuacuugguuaggcaugcauacaaaaauccuaaugaaauauacucagaaauaucugaaguagccaaacuaaaagaugcaaaaagugaaguuaagaaaagccaauauuuuuccacauuuacauuacgaggauccuauacuggaggggccaguaaagguaaacuagaagaccaaaaagcaaugaacaaauucaucgaugauucccuaaagaaauuagauacauauaguuggucaggcuacaaaacacuaacagccuauuuuacaaauuacaaaguagauucaagcaauagaguuacauacgacguaguauuccaugguuauuuaccaaaugaaggcgacaguaaaaauucauuaccauacggaaaaauaaauggaacauauaaaggaacggaaaaagagaaaauaaaauucuccucugaaggauccuuugacccagacggaaaaaucguuagcuacgaaugggacuucggugaugguaacaaaucaaacgaagaaaacccugaacacagcuacgacaaaguaggaaccuacacagucaaacucaaaguaacagaugauaaaggugaaucuucuguuucuacgacaacagcagaaaucaaagauuuauccgaaaacaaacucccagucauauauaugcacguaccaaaaucaggugcacuuaaucaaaagguuguauuuuauggaaaagguacauaugaucccgacggaucaaucgcaggauaccaaugggacuucggagacgggucagauuucuccucugaacaaaacccaagccacguauacaccaagaaaggagaauauaccguaaccuuacgagucauggauaguucaggucaaaugucagagaaaacaaugaaaaucaaaauaacugauccaguauacccaaucggaacagaaaaagaaccaaauaauagcaaagaaacagcaaguggacccaucgugccaggcaucccaguaucgggcacaauagaaaauacgagcgaccaagacuauuucuacuuugacgucauaacaccaggagaaguaaaaaucgauauaaauaaacuaggauacggaggagccacaugggucgucuacgaugaaaacaacaaugccgugagcuaugcaacagacgauggacagaaucuuucugggaaauucaaagcagauaaaccaggacgauacuauauacacuuauacauguuuaaugguaguuacaugccauaccgaauaaacauugaaggaagcguuggaagaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1952 - RNA, 793 nt, Artificial Sequence
  mRNA product Design1 comprising derived and/or modified sequence from Homo sapiens__NP_001133.1__HsAMELX (opt6)
gggagaaagcuuaccauggguaccuggauauuauucgcaugccuacuaggcgcagcauucgccaugccauuaccaccacacccaggacacccaggauacaucaacuucucauacgaaguacuaacaccacuaaaaugguaccaaucaauaagaccaccauacccaucauacggauacgaaccaauggguggauggcuacaccaccaaauaauaccaguacuaucacaacaacacccaccaacacacacacuacaaccacaccaucacauaccaguaguaccagcacaacaaccaguaauaccacaacaaccaaugaugccaguaccaggacaacacuccaugacaccaauacaacaucaccaaccaaaccuaccacccccagcacaacaaccauaccaaccacaaccaguacaaccacaaccacaccaaccaaugcaaccacaaccaccaguacaccccaugcaaccacucccaccacaaccaccacuaccaccaauguucccaaugcaacccuuaccaccaaugcuaccagaccuaacacuagaagcauggcccucaacagacaaaacaaaaagagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1953 - RNA, 352 nt, Artificial Sequence
  mRNA product Design1 comprising derived and/or modified sequence from Homo sapiens__NP_001133.1__HsAMELX-TRAP (opt6)
gggagaaagcuuaccaugccacuaccaccacacccaggacacccaggauacauaaacuucucauacgaaguacuaacaccacuaaaaugguaccaaucaauaagaccaccauacccaucauacggauacgaaccaaugggaggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1954 - RNA, 385 nt, Artificial Sequence
  mRNA product Design1 comprising derived and/or modified sequence from Homo sapiens__NP_001133.1__HsAMELX-LRAP (opt6)
gggagaaagcuuaccaugccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1955 - RNA, 424 nt, Artificial Sequence
  mRNA product Design1 comprising derived and/or modified sequence from Homo sapiens__NP_001133.1__HLA-A2-SP_HsAMELX(17-60) (opt6)
gggagaaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccauacccaucauacggauacgaaccaaugggaggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1956 - RNA, 457 nt, Artificial Sequence
  mRNA product Design1 comprising derived and/or modified sequence from Homo sapiens__NP_001133.1__HLA-A2-SP_HsAMELX(17-47,168-191) (opt6)
gggagaaagcuuaccauggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1957 - RNA, 796 nt, Artificial Sequence
  mRNA product Design1 comprising derived and/or modified sequence from Homo sapiens__NP_001134.1__HsAMELY (opt6)
gggagaaagcuuaccaugggaacauggauacuauucgcaugcuuaguaggagcagcauucgccaugccacuaccaccacaccccggccacccaggauacauaaacuucucauacgaaguauuaacaccacuaaaaugguaccaaucaaugauacgcccaccauacuccucauacggauacgaaccaaugggcggcugguuacaccaucaaauaauaccaguaguaucccaacaacacccacuaacacacacacuacaaucacaccaccacauaccaguaguaccagcacaacaaccacgaguacgccaacaagcacuaaugccaguaccaggacaacaaucaaugacaccaacacaacaccaccaaccaaaccuaccauuaccagcacaacaaccauuccaaccacaaccaguacaaccccaaccacaccaaccaaugcaaccacaaccaccaguacaaccaaugcaaccacuccuaccccaaccaccacuaccaccaauguucccacuaagaccacuaccaccaauacuaccagaccuacaccuagaagcauggccagcaacagacaaaacaaaacaagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1958 - RNA, 355 nt, Artificial Sequence
  mRNA product Design1 comprising derived and/or modified sequence from Homo sapiens__NP_001134.1__HsAMELY-TRAP (opt6)
gggagaaagcuuaccaugccacuaccaccacacccaggacacccaggauacauaaacuucucauacgaaguacuaacaccacuaaaaugguaccaaucaaugauaagaccaccauacucaucauacggauacgaaccaaugggaggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1959 - RNA, 388 nt, Artificial Sequence
  mRNA product Design1 comprising derived and/or modified sequence from Homo sapiens__NP_001134.1__HsAMELY-LRAP (opt6)
gggagaaagcuuaccaugccacuaccaccacacccaggacacccaggauacauaaacuucucauacgaaguauuaacaccacuaaaaugguaccaaucaaugauaagaccaccaccaauacuaccagaccuacaccuagaagcauggccagcaacagacaaaacaaaacaagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1960 - RNA, 427 nt, Artificial Sequence
  mRNA product Design1 comprising derived and/or modified sequence from Homo sapiens__NP_001134.1__HLA-A2-SP_HsAMELY(17-61) (opt6)
gggagaaagcuuaccauggcaguaauggcaccaagaacauuaguacuacuacuaucaggagcacuagcacuaacacaaacaugggcaaugccacuaccaccacauccaggacacccaggauauauaaauuucucauacgaaguauuaacaccacuaaaaugguaucaaucaaugauaagaccaccauacagcucauacggauacgaaccaaugggaggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1961 - RNA, 460 nt, Artificial Sequence
  mRNA product Design1 comprising derived and/or modified sequence from Homo sapiens__NP_001134.1__HLA-A2-SP_HsAMELY(17-48,169-192) (opt6)
gggagaaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaucaaucaaugauaagaccaccaccaauacuaccagaccuacaccuagaagcauggccagcaacagacaaaacaaaacaagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1962 - RNA, 787 nt, Artificial Sequence
  mRNA product Design1 comprising derived and/or modified sequence from Sus scrofa__NP_999071.1__SsAMELX-001-1 (opt6)
gggagaaagcuuaccaugggaaccuggauauuauucgcaugccuacuaggagccgcauucuccaugccacuaccaccacacccaggacacccaggauacauaaacuucucauacgaaguauuaaccccauuaaaaugguaucaaaacaugauaagacacccauacacaucauacggauacgaaccaaugggaggauggcuacaccaccaaauaauaccaguaguaucccaacaaacaccacaaucacacgcacuacaaccacaccaccauauaccaaugguaccagcacaacaaccaggaauaccacaacaaccaaugaugccacuaccaggacaacacucaaugacaccaacacaacaccaccaaccaaaccuaccacuaccagcccaacaaccauuccaaccacaaccaguacaaccacaaccacaccaaccacuacaaccccaauccccaaugcacccaauacaaccacuacuaccacaaccaccacuacccccaauguucucaaugcaaucacuacuaccagaccuaccacuagaagcauggccagccacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1963 - RNA, 355 nt, Artificial Sequence
  mRNA product Design1 comprising derived and/or modified sequence from Sus scrofa__NP_999071.1__SsAMELX-TRAP (opt6)
gggagaaagcuuaccaugccacuaccaccacacccaggacacccaggauacauaaacuucucauacgaaguacuaacaccacuaaaaugguaccaaaauaugauaagacacccauacacaucauacggauacgaaccaaugggaggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1964 - RNA, 388 nt, Artificial Sequence
  mRNA product Design1 comprising derived and/or modified sequence from Sus scrofa__NP_999071.1__SsAMELX-LRAP (opt6)
gggagaaagcuuaccaugccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1965 - RNA, 427 nt, Artificial Sequence
  mRNA product Design1 comprising derived and/or modified sequence from Sus scrofa__NP_999071.1__HLA-A2-SP_SsAMEL(17-61) (opt6)
gggagaaagcuuaccauggcaguaauggcaccaagaacauuaguacuacuacuaucaggagcacuagcacuaacacaaacaugggcaaugccacuaccaccacauccaggacacccaggauauauaaauuucucauacgaaguauuaacaccacuaaaaugguaucaaaauaugauaagacauccauauacaucauacggauacgaaccaaugggaggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1966 - RNA, 460 nt, Artificial Sequence
  mRNA product Design1 comprising derived and/or modified sequence from Sus scrofa__NP_999071.1__HLA-A2-SP_SsAMEL(17-49,167-189) (opt6)
gggagaaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1967 - RNA, 751 nt, Artificial Sequence
  mRNA product Design1 comprising derived and/or modified sequence from Sus scrofa__P45561-2__SsAMELX-001-2 (opt6)
gggagaaagcuuaccaugggaacauggauacuauucgcaugccuacucggugcagcauucucaaugccacuaccaccacacccaggacacccaggauacauaaacuucucauacauacgacacccauacacaucauacggauacgaaccaaugggaggauggcuacaccaccaaauaauacccguaguaucucaacaaacaccacaaucacacgcacuacaaccacaccaccacauaccaaugguaccagcacaacaaccaggaauaccacaacaaccaaugaugccauuaccaggacaacacucaaugacaccaacacaacaccaccaaccaaaccuaccacuaccagcacaacaaccuuuccaaccacaaccaguacaaccacaaccacaccaaccacuacaaccacaaucaccaaugcacccaauacaaccauuacuaccacaaccaccacuaccaccaauguucucaaugcaaucacuacuaccagaccuaccacuagaagcauggccagcaacagacaaaaccaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1968 - RNA, 787 nt, Artificial Sequence
  mRNA product Design1 comprising derived and/or modified sequence from Sus scrofa__NP_998965.1__SsAMELX-001-3 (opt6)
gggagaaagcuuaccaugggaacauggauauucuucgccugccuacuaggcgcaucacuagcaaugccacuaccaccacacccaggacacccaggauauauaaacuucucauacgaaguacuaacaccucuaaaaugguaccaaaacaugauaagacauccauacacaucauacggauacgaaccaaugggcggaugguuacaccaccaaauaauaccaguagucucccaacaaacaccacaaucacacgcauuacaaccccaccaccacauacccaugguaccagcccaacaaccaggaauaccacaacaaccaaugaugccacuaccaggacaacacucaaugacaccaacacaacaccaccaaccaaaccucccauuaccagcacaacaacccuuccaaccacaacccguacaaccacaaccacaccaaccacuacaaccacaaucaccaaugcacccaauacaaccacuacuaccccaaccaccacuaccaccaauguucucaaugcaaucacuacuacccgaccuaccauuagaagcauggccagcaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1969 - RNA, 436 nt, Artificial Sequence
  mRNA product Design1 comprising derived and/or modified sequence from Sus scrofa__K7GPB2__SsAMELX-002 (opt6)
gggagaaagcuuaccaugggaacauggauacuauucgcaugccuacuaggagcagcauucucaaugccacuaccaccacacccaggacacccaggauacauaaacuucucauacgaaguacuaacaccacuaaaaugguaucaaaacaugauaagacacccaucacuauuaccagaccuaccacuagaagcauggccagcaacagacaaaacaaaaagagaagaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1970 - RNA, 829 nt, Artificial Sequence
  mRNA product Design1 comprising derived and/or modified sequence from Sus scrofa__K7GLD0__SsAMELX-003 (opt6)
gggagaaagcuuaccaugggaacauggauacuauucgcaugccuacuaggagccgcauucucaaugccccuaccaccacacccaggacacccaggcuacauaaacuucucauacgaagaccuauaccuagaagcaauaagaauagacagaacagcauucguccuaacaccauuaaaaugguaccaaaacaugauaagacacccauacacaucauacggauacgaaccaaugggaggcuggcuacaccaccaaauaauacccguaguaucccaacaaacaccacaaucacacgcacuccaaccacaccaucacauaccuaugguaccagcacaacaacccggaauaccacaacaaccaaugaugccacuaccaggacaacacucaaugacaccuacacaacaccaccaaccaaaccuaccauuaccagcacaacaaccauuccaaccacaaccaguacaaccacaaccacaccaaccccuacaaccacaaucaccaaugcacccaauacaaccacuacucccacaaccaccccuaccacccauguucucaaugcaaucuuuacuaccagauuuaccauuagaagcauggccagcaacagacaaaacaaaaagagaagaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1971 - RNA, 715 nt, Artificial Sequence
  mRNA product Design1 comprising derived and/or modified sequence from Sus scrofa__K7GPE9__SsAMELX-004 (opt6)
gggagaaagcuuaccaugggcacauggauacuauucgcaugccuacuaggagcagcauucuccaugccacuaccaccacacccaggacacccaggauacauaaacuucucauacgaaguacucaccccacuaaaaugguaccaaaacaugauaagacacccaacaccacaaucccacgcacuccaaccacaccaccacauaccaaugguaccagcacaacaaccaggaauaccacaacaaccaaugaugccacuaccaggacaacacucaaugacaccaacacaacaccaccaacccaaccuaccacuaccagcacaacaaccauuucaaccacaaccaguacaaccacaaccacaccaaccacuacaaccacaaucaccaaugcacccaauacaaccacuacucccacaaccaccacuacccccaauguucucaaugcaaucacuauuaccagaccuaccacuagaagcauggccagcaacagacaaaacaaaacgagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1972 - RNA, 739 nt, Artificial Sequence
  mRNA product Design1 comprising derived and/or modified sequence from Sus scrofa__J9JIM4__SsAMELX-201 (opt6)
gggagaaagcuuaccaugccacuaccaccacacccaggacacccaggauacauaaacuuuucauacgaaguacuaaccccacuaaaaugguaccaaaacaugauaagacaccccuacacaucauacggcuacgaaccaaugggaggauggcuacaccaccaaauaauaccaguaguaucacaacaaacaccacaaucacacgcacuccaaccacaccaccacauaccaaugguaccagcacaacaacccggaauaccacaacaaccaaugaugccacucccaggacaacacucaaugacaccaacacaacaccaccaaccaaaccuaccacuaccagcccaacaaccauuccaaccacaaccaguacaaccacaaccacaccaaccacuacaaccacaaucaccaaugcacccaauacaaccacuacuaccacaacccccacuacccccaauguucucaaugcaaucacuacuaccagaccuaccacuagaagcauggccagcaaccgacaaaacaaaaagagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1973 - RNA, 3178 nt, Artificial Sequence
  mRNA product Design1 comprising derived and/or modified sequence from Homo sapiens__NP_006120.1__HsBMP1 (opt6)
gggagaaagcuuaccaugccagggguagcuagacuaccucuacucuuaggacuccuauuguuaccacggccaggaagaccguuagaucuagcggacuacacauaugaucucgcagaagaagacgacagugaaccgcuaaauuacaaagauccauguaaagcggccgcauuuuugggagauauagcauuagaugaagaagacuuaagagcauuucaaguacaacaagcuguugaucuaagaagacacacggcccgaaaaagcaguauaaaagcagcgguaccaggcaacacaagcacgccaucaugccaaaguacaaacggacaaccacaaagaggggcuugcgggagauggagaggaagaagcagaagcagacgcgcagcuacuucaagaccugaaagaguuuggccugacggcguaauaccauucguaauaggaggcaauuuuacaggaagucagcgcgcaguuuuucggcaagcaaugcgccacugggaaaaacauacuuguguaacauucuuagagcgaacagaugaagauuccuauauaguuuucacauacaggcccugcggauguuguucauauguaggaagacgcgggggaggaccacaagcgauaaguauaggaaaaaauugugacaaauucggaauaguuguccaugaauuaggucacguugugggauucuggcacgaacacacacgaccagauagagacagacauguaaguauaguaagggaaaauauacaaccagggcaggaauacaacuuuuuaaaaauggaaccccaagagguagaaucacuuggcgaaacuuacgauuucgauaguauaaugcauuaugcuagaaauacauuuucgagaggaauauuccuagacacuauaguaccgaaauacgaaguaaauggagugaaacccccaauaggccaaagaacuagacuaucaaaaggagacauagcacaggcaagaaaauuauauaaaugucccgcguguggugaaacauuacaagauucuacaggaaauuuuucaucuccugaauauccuaauggcuauagugcacacaugcauuguguauggcgcauuucaguaacaccaggagaaaaaauuauuuugaauuucacaagucuagacuuauacagaaguagauuauguugguaugacuauguagaagucagggauggauucuggagaaaagcuccucuaaggggaagauuuuguggaagcaaauuaccugaaccaauaguuagcacagauucaagacuuuggguagaauuuagaaguaguucaaauuggguaggaaaaggauuuuucgcaguguaugaagcaauuugcgguggagauguaaaaaaagacuaugggcacauacaaagcccaaacuauccugaugauuauagaccaucaaaaguauguauauggcgaauacaaguuagugaaggguuucacguaggauuaacuuuucaauccuucgaaauagaaagacaugacucuugcgcauaugauuauuuagaaguuagagacggacauagugagaguaguacucuaaucggaagauacugcggcuaugaaaaaccugaugacauuaaaagcacuagcucuagauuauggcuaaaauuuguaagugaugguagcauaaauaaggcagguuuugcaguaaacuuuuuuaaagagguugaugaauguucgaggccuaauagaggugguugugaacaacggugcuugaauacacuaggaagcuacaaaugcucaugcgauccaggcuacgaauuagcgccagauaaaagaagaugugaagcagcauguggaggauuuuugacuaaacuaaauggaucaauaacaaguccagguuggccgaaagaauacccuccuaauaaaaacuguauuuggcaacuuguagcaccuacucaauauagaauaucauugcaauucgauuuuuucgagacagaaggaaacgacguauguaaauaugacuuuguggaaguaagaaguggucuaaccgcugauaguaagcuacacggaaaauucugcgguagugagaaaccagaaguaauaacgucacaauacaauaauaugagaguugaauuuaagagugacaauacaguuucaaaaaaaggauuuaaagcacauuuuuucucagacaaagaugaguguaguaaagauaauggaggaugccagcaagacugcguaaauacauucggaagcuaugaaugucaaugucgauccggcuuuguauuacacgauaauaaacacgauuguaaagaagcuggaugcgaucacaaaguaacgaguacuagcggaacaauuacaagcccaaauuggccggacaaauaucccucaaaaaaagaauguacuugggcaauaucuucuacaccgggucauagagugaaauuaacauucauggaaauggacauagaaucacaaccagaaugugcauaugaucaccuugaaguauucgaugguagagaugcuaaagcuccaguacugggucgcuuuuguggaaguaaaaaacccgagccuguauuagcaacaggaucaagaauguuccuuagauucuacuccgacaauucaguacagagaaaagguuuccaagcuucucacgcaacagaauguggaggccaagugcgagcggauguaaaaacaaaagacuuauauucucacgcacaguuuggagacaauaauuauccaggagguguggauugugaauggguuauagucgcagaagaaggauacggaguagagcuagucuuucaaacauuugagguagaagaagaaacugauuguggauacgacuauauggaacucuuugauggauacgacucaacagcaccccgauuagguagauauuguggaucuggaccacccgaagaaguauauuccgcaggagacagcguauuagucaaguuccacuccgaugauaccaucacuaaaaaaggauuucaucuuagauauacaagcacaaaauuucaagacacucuucacagccgaaaauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1974 - RNA, 1408 nt, Artificial Sequence
  mRNA product Design1 comprising derived and/or modified sequence from Homo sapiens__NP_001191.1__HsBMP2 (opt6)
gggagaaagcuuaccaugguagcugguacuagaugccuacuagcauuacucuuaccacaaguauuacuaggaggagcagcaggauuagucccagaacuagguagaagaaaauucgcagcugccucaucaggaagacccagcucacaaccuucagacgaaguccuaucagaauuugaauugagauuacuaucaauguucggacuuaaacaaagaccaacaccaucaagagaugcaguaguaccaccauauaugcuagauuuauauagaagacacucaggacaaccaggaaguccagcuccagaccauagauuagaaagagcagcaaguagagcaaacacagucaggagcuuucaucacgaagaaucacuagaagaauuaccagaaacaucaggaaaaaccacaagaagauuuuucuuuaaccuuaguucaauaccaacagaagaauucaucacaagugcagaacuacaagucuucagggaacaaaugcaggacgcacuaggaaauaauucaucauuccaucauagaauaaauaucuaugaaauaauaaaaccagcaacagccaacucaaaauucccaguaacaagacuacuagacacaagacuaguaaaccaaaacgcaagcagaugggaaagcuuugauguaacaccagcaguaaugcgauggacagcacaaggucacgcaaaucacggauucguagucgaagucgcgcaucuagaagaaaaacaagguguaagcaaacgacauguaagaauaaguagaaguuuacaccaagaugaacauucauggucacaaauaagaccacuccuaguaacauucggacaugacgguaaaggacacccacuacacaaacgagaaaaaagacaagcaaaacauaaacaaagaaaaagacuaaaaucaucaugcaaaagacauccguuauauguugacuuuucagauguaggauggaacgacuggaucguagcacccccaggauaucacgcauucuauugucauggagaauguccauuuccauuagcagaucacuuaaauagcacaaaccacgccauuguacaaacucuagucaauucagucaauucaaaaaucccaaaagcaugcugcguaccuacagaacuaucagcaauuucaaugcuauaccuagacgaaaaugaaaaaguaguacuuaaaaacuaucaagacaugguuguagaaggauguggaugcagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1975 - RNA, 1444 nt, Artificial Sequence
  mRNA product Design1 comprising derived and/or modified sequence from Homo sapiens__NP_001193.2__HsBMP4 (opt6)
gggagaaagcuuaccaugauacccggaaacagaaugcuaaugguaguauuacuaugccaaguauuacuaggaggagcuagccaugccagcuuaauuccugaaacaggcaaaaagaaaguagcagaaauacaaggacacgcaggaggaagaagaucaggacaaagccaugaacuacuaagagacuucgaagcaacauuacuacaaauguuuggacuacgacgaagaccacaaccuaguaaaagcgcagucauaccagacuauaugagagaucuauaucgcuuacaaagcggagaagaagaagaagaacaaauacauucaacaggauuagaauacccagaaagacccgcaucaagagcaaauacagugaggucauuccaucaugaagaacaucuagaaaauauaccaggaacaucagaaaauucagcauucagauuuuuauucaauuuaaguucuauaccagaaaacgaaguaauaucaucugcagaacuaagauuauucagagaacaaguugaucaaggaccagacugggaaagagguuuucacagaauaaauaucuaugaaguaaugaaaccuccagcagaaguaguuccagggcaucuaaucacaagauuacucgauacaagauuaguacaccauaacguaacacgaugggaaacauuugauguaucaccagcaguucuaagauggacaagagaaaaacaaccgaauuacggauuagcaauagaaguuacucacuuacaucaaacaagaacccaccaaggacaacauguaagaauaucccgaucauuaccacaaggcucaggaaauugggcacaacuaagaccacuccucguaacauuuggacaugacggaagaggacaugcucucaccagaagaagacgagcaaaaagaucaccaaaacaccauagccaaagagcuagaaagaaaaauaaaaauugcagaagacauaguuuauacguugacuucucagauguaggauggaaugauuggauaguagcaccaccugguuaccaagcauuuuauugucacggagacuguccauuuccuuuagcagaucacuuaaacaguacaaaucacgcaauaguacaaacucuaguuaacucaguaaacagcucuauaccaaaagcaugcugugucccaacagaacuaucggcaauuucaauguuauauuuagaugaauaugauaaaguaguacuuaaaaauuaucaagaaaugguaguagaaggaugcggauguagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1976 - RNA, 1759 nt, Artificial Sequence
  mRNA product Design1 comprising derived and/or modified sequence from Homo sapiens__NP_001709.1__HsBMP6 (opt6)
gggagaaagcuuaccaugccaggauuaggucguagagcacaaugguuaugcugguggugggguuuacuauguucauguuguggcccaccaccccuaagaccaccauuacccgcagcagcggcugcagccgcaggaggacaacuauuaggagauggaggaaguccaggcagaacagaacaaccaccgccaagcccccaaagcucaucuggauuucuauacagaagauuaaaaacacaagaaaagagagaaaugcaaaaagaaauacuaucgguauuaggacugccacaucgacccagaccacuacacggauuacaacaaccccaaccacccgcacuucgacaacaagaagaacaacaacaacaacaacaacuaccaagaggcgaaccuccaccaggaagauuaaaaucagcaccacuauuuauguuagauuuauauaacgcauuaucagcagacaaugacgaagacggagcaucagaaggagaaagacaacaaucauggccccaugaagcagcaucaaguucacaacgaagacaaccaccuccaggagcugcucauccauuaaacagaaaaucacuucucgccccaggaaguggcucuggaggugcaaguccauuaacaucagcacaagauagcgcuuucuuaaaugaugcagauaugguaaugucauuuguaaaucuagucgaauacgauaaagaauuuucaccaagacaacgacaucauaaagaauuuaaauucaauuuaagucaaauaccugaaggugaaguaguuacagcugcugaauuucgaauauauaaagacuguguaaugggaucauuuaaaaaccaaacauucuuaauaucaauauaucaaguuuuacaagaacaucaacauagagauagugaucucuuuuuacuagauacaagaguaguaugggcuagugaagaagguugguuagaauuugacauaacagcuacgaguaauuuauggguuguaacaccacaacauaauaugggucuacaacuuagcguaguuacacgagaugguguacauguacacccaagagcagcaggucuaguaggaagggauggaccuuaugacaagcaaccauucaugguagcauucuuuaaaguaagcgaaguucauguaagaacuacaagaucagcuucaucaagaagaagacaacaaagucgaaacagaaguacacaaagucaagauguugcaagaguauccagugcaucugauuauaacaguagcgaacuaaaaaccgcauguagaaaacacgaauuauacgucagcuuucaagaucuaggauggcaagauuggauaaucgcaccaaaaggauaugcagccaauuauugugauggagaaugcaguuuuccuuuaaaugcacacaugaaugcaacaaaucacgcuauaguucaaacacuuguucacuuaaugaauccugaauacguaccaaaaccauguugcgcaccuacaaaauuaaacgcaauaucaguacuauacuuugaugauaauucaaacguaauacuuaaaaaguauagaaauaugguaguaagagcaugugguugucacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1977 - RNA, 1513 nt, Artificial Sequence
  mRNA product Design1 comprising derived and/or modified sequence from Homo sapiens__NP_001710.1__HsBMP7 (opt6)
gggagaaagcuuaccaugcauguaagaucacuccgagcagcagcaccacacucauuuguagcauuaugggcaccacuauucuuauuaagauccgcacucgcagacuucaguuuagacaaugaaguacacucaucauuuauacaucgaagauuacgaucccaagaaaggagagaaaugcaaagagaaauacucucaauacuagguuuaccccacagaccaagaccacaccuacaaggaaaacauaauuccgcaccaauguucaugcuagaucuauacaacgcaauggcaguagaagaaggaggaggaccaggaggccaagguuucucauacccauauaaagcaguauucaguacacaaggaccuccacuagcaucccuacaagauucucacuucuuaacugaugcagauauggucaugucauucguuaacuuaguagaacaugauaaagaauuuuuucacccaagauaucaccaucgugaauuuagauucgaccuaucaaaaauuccagaaggagaagccguaacagcagcagaauucaggauuuauaaagacuauauccgagaacgauucgacaacgaaacauucagaauaucaguauaucaagucuuacaagaacaucucggccgagaaucagacuuauucuuauuagauucgagaacucuaugggcaucugaagaaggaugguuaguauuugauauaacagcaacaagcaaucauuggguaguaaacccccgacauaaucuaggauuacaauuaucaguagaaacacuugauggccaaagcauuaacccaaaauuagcaggacuaauaggcagacaugguccacaaaacaaacaaccauucaugguagcauuuuucaaagcaacagaaguccauuucagaaguauaagaucaacaggaaguaaacaaagaucacaaaacagaucaaaaacaccaaaaaaucaagaagcacuaagaauggcuaacguagcagaaaauagcucuagugaccaaaggcaagccuguaaaaaacacgaauuauauguaucauucagagauuuaggauggcaagauuggaucauagcaccagaaggauaugcagcauauuacugugaaggagaaugugcuuucccauuaaacucauacaugaacgcaacaaaucacgcaaucguacaaacacucguacacuuuauuaauccagaaacaguaccaaaacccugcugcgcacccacacaauuaaacgcaauaucaguacuauacuuugacgauucaucaaacguaauauuaaaaaaauacagaaacauggucguaagagcaugugguugccauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1978 - RNA, 517 nt, Artificial Sequence
  mRNA product Design1 comprising derived and/or modified sequence from Homo sapiens__NP_006264.2__HsCCL7 (opt6)
gggagaaagcuuaccaugaaagcaucagcagcacuacuaugccuacuacuaacagcagcagcauucucaccacaaggacuagcacaaccaguaggaauaaacacaucaacaacaugcugcuacagauucauaaacaaaaaaauaccaaaacaaagacuagaaucauacagaagaacaacaucaucacacugcccaagagaagcaguaauauucaaaacaaaacuagacaaagaaauaugcgcagacccaacacaaaaauggguacaagacuucaugaaacaccuagacaaaaaaacacaaacaccaaaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1979 - RNA, 3841 nt, Artificial Sequence
  mRNA product Design1 comprising derived and/or modified sequence from Homo sapiens__NP_001954.2__HsEGF (opt6)
gggagaaagcuuaccauguuacuaacuuugauaauauuauuaccaguuguuucaaaauuuucuuuugugucauuaucugcaccgcaacacuggaguuguccagaaggaacucuagcuggaaauggaaauucuacauguguugggccugcaccauuucuaauauucagccauggaaacucaauuuucagaauagauacugagggaaccaacuaugagcaacucguugucgacgcuggaguaucuguaauaauggauuuucauuacaaugagaaacgcauauacuggguugacuuagaacgacaauuauuacaaagaguauuucuaaauggaagcagacaagaaaggguaugcaauauagagaaaaaugugaguggaauggcaaucaauuggauaaaugaagaagugauauggucaaaccaacaagaaggaauuauaacaguaacagauaugaaaggcaauaauagccauauacuguugagcgcccuuaaauauccagcuaacguagcaguagauccaguagaaagauuuauauuuuggaguucugaagucgcaggaucacuauaccgagcugaccuugauggaguagguguaaaggcuuuacuagaaacaucagagaaaaucacagcaguaagucuugacguacuagauaaaagauuauucuggauccaauauaaccgcgaagggucuaauucccuuauauguucaugugacuacgacggaggcucaguacauauaucaaaacauccgacccaacauaaucuauuugcuaugagccuuuucggggacagaaucuuuuauucgacauggaaaaugaaaacaauuuggauagcaaauaaacacacaggaaaagacaugguaagaauuaauuuacauagcucuuucguaccuuugggagaauuaaaaguaguacauccguuggcacagccuaaagcagaagacgauacaugggaaccugaacaaaaauugugcaaauugcgaaaaggaaacuguucaucgaccguuuguggacaagacuuacaaagucacuugugcaugugugcggaaggauaugcucuauccagagauagaaaauauugugaagaugucaacgaaugugcuuuuuggaaucauggaugcacacuaggaugcaaaaacacaccagguucuuauuacuguaccuguccaguagguuuuguuuuacuaccagacgguaaaagaugucaccagcuaguaucguguccacgcaacguaucugaauguucucacgauuguguacuuaccagcgaaggaccauuauguuuuuguccggagggaaguguacuagaacgugacgguaaaacauguucaggaugcucaucaccugauaacggugguuguagucaauuaugcgucccacuuaguccuguaaguugggaaugugacugcuucccaggauaugauuugcaauuagaugagaaaagcugugcagccagcggaccucaacccuuucuccuuuucgcaaacagccaagauauaagacauaugcauuuugauggaacugauuauggaacgcuauuaagucaacaaaugggaaugguuuacgcacuagaucaugauccuguagaaaauaaaauauauuuugcucacacagccuuaaaauggauagaacgggcaaauauggacgguagccaaagagaacgacuaaucgaagaaggaguagauguuccugaaggauuagcaguagauuggaucggaagacgauuuuauuggacggauaggggaaaaagccuaauugguagauccgaccuuaauggaaaaagaucaaaaauaauaacaaaagaaaacauaagccaaccacgcggaauugcgguacauccaauggcaaaacggcuauuuuggacagauacaggaauaaacccaagaauagaaaguucuucuuuacagggacuaggacgucuaguaauagcaagcuccgauuuaauuuggcccagugguauaacgauagacuuuuuaacugauaaacuauacuggugugaugcaaagcaaucagucauugaaauggcaaaucuagauggaucuaaaagaagaagacuaacucaaaacgauguaggacacccauuugccguagcaguauuugaagauuauguuugguucucagauugggcaaugccaagcguaaugagaguaaauaaaagaacaggaaaagauagagucagauugcaaggaagcauguuaaaaccguccagucuugucgucguucauccccuugcaaaaccaggugcggauccaugucuauaucaaaacggaggaugugaacauauuugcaagaaacgguuagguacugcauggugcagcugucgagaaggauucaugaaagcgagcgaugguaaaacauguuuagcacucgauggacaucaacuacuagcuggcggagaaguagaccugaaaaaccaagugacaccccuugauauacuuaguaaaaccagaguaagugaagauaauauaacggaaucacaacauauguuaguagcagaaaucauggugagcgaucaagaugauugugcacccguaggauguaguauguaugcaagaugcaucucagaaggagaagacgcaaccugccagugcuuaaaaggcuuugccggcgacggcaaacugugcucagauauugaugagugcgaaaugggugugcccguuuguccuccagcgucauccaaauguauaaauacagaaggagguuauguauguagaugcagcgaggguuaucaaggugauggcauacacuguuuggauaucgaugaaugucaauuaggagaacauucuuguggggaaaaugcaaguuguacaaauacagaaggagguuauacuuguaugugugcuggccguuuaagugaaccuggcuuaauauguccagacagcacuccgccuccucaccuaagagaggaugaucaccauuacagcguacgcaauagcgauucagaaugcccucuaagucacgacggguacugucuacaugacggaguauguauguacauagaggcuuuagauaaguaugcauguaacugugucguugguuacauaggagaaagaugucaauaucgagauuuaaaauggugggaauuaagacacgcgggacauggccaacaacaaaaaguaauagucguagccgucugcguaguuguucuaguaauguuacuacuacugagucuuuggggugcacacuauuauagaacacaaaaacuacuaucgaaaaaucccaaaaauccauaugaagaaagcaguagagauguaaggucaagacgaccggcugacacagaagaugggaugucaaguugcccacaaccaugguuuguaguaauaaaagagcaucaagaccuuaaaaacggaggucagccaguagcuggagaagacggucaggcugcggaugggaguaugcaaccaacaucuuggagacaagaaccucaacugugcggaauggguacggagcaaggcugcuggaucccugucagcucagacaaaggcagcuguccucaagugauggaacgaucauuccauaugccgucauacgggacacaaacguuggaaggaggaguggaaaaaccacauagucuauuauccgcaaacccauuauggcaacaacgagcauuagauccaccucaucaaauggaauuaacucaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1980 - RNA, 727 nt, Artificial Sequence
  mRNA product Design1 comprising derived and/or modified sequence from Homo sapiens__NP_001423.1__HsEREG (opt6)
gggagaaagcuuaccaugacagcagguagaagaauggaaauguuaugcgcaggaagaguacccgcacuacuacuaugccuaggauuccaccuauuacaagcaguacuaucaacaacaguaauaccaagcugcauaccaggagaaucaucagacaacugcacagcacuaguacaaacagaagacaauccaagaguagcacaaguaucaauaaccaaaugcucaucagacaugaacggauacugcuuacacggacaaugcauauaccuaguagacaugucacaaaacuacugcagaugcgaagucggauacacaggaguaagaugugaacacuuuuuucuaacaguacaucaaccacuaucaaaagaauacguagcacuaacaguaauauuaauaauacuauuucuaauaacaguagucggaucaacauacuacuucugcagaugguacagaaacagaaaaucaaaagaaccaaaaaaagaauacgaaagaguaacaucaggagacccagaacuaccacaaguauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1981 - RNA, 685 nt, Artificial Sequence
  mRNA product Design1 comprising derived and/or modified sequence from Homo sapiens__NP_000791.1__HsFGF1 (opt6)
gggagaaagcuuaccauggcagaaggagaaauaacaacauucacagcacuaacagaaaaauucaaccuaccaccaggaaacuacaaaaaaccaaaacuacuauacugcucaaacggaggacacuuccuaagaauacuaccagacggaacaguagacggaacaagagacagaagcgaccaacacauacaacuacaacuaucagcagaaucaguaggagaaguauacauaaaaucaacagaaacaggacaauaccuagcaauggacacagacggacuacuauacggaucacaaacaccaaacgaagaaugccuauucuuagaaagacuagaagaaaaccacuacaacacauacauaucaaaaaaacaugcagaaaaaaacugguucguaggacuaaaaaaaaacggaucauguaaaagaggaccaagaacacacuacggacaaaaagcaauacuauuccuaccauuaccagucucaagcgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1982 - RNA, 1084 nt, Artificial Sequence
  mRNA product Design1 comprising derived and/or modified sequence from Homo sapiens__NP_001997.5__HsFGF2 (opt6)
gggagaaagcuuaccaugguugggguaggaggaggagacguagaagauguaacaccaaggccaggaggaugucaaauaagcggaagaggagcaagaggauguaaugggauaccaggagcggcagcaugggaagcugcauuaccaagaagaagaccuaggagacauccaaguguuaauccaagaucuagagcagcggggaguccaagaacaagaggaagaagaacagaagaaagaccaagugggucaagauuaggagauagagguagggggagagcauuaccagguggaagauuaggagguagaggaagaggaagagcaccagaaagagugggaggaagaggaaggggaagaggaacagcagcaccaagagcagcaccagcugcaagaggaaguagaccagggccggcaggaacaauggcagcaggaaguauaacaacauuaccagcauuaccagaagacggaggaucaggagcauuuccaccaggacauuuuaaagacccaaaaagauuauauuguaaaaacggaggauuuuuucuaagaauacauccagauggaagagucgauggugugagggaaaaaagugauccgcauauaaaauuacaauuacaagcagaagaacgaggaguuguaaguauaaaaggaguaugugcaaauagauaucuagcaaugaaagaagauggaagauuauuagcaaguaaauguguaacagacgaauguuuuuuuuuugaaagauuagaaagcaauaauuauaauacuuauagaaguagaaaauauacaagcugguauguagcuuuaaaaagaacaggacaauauaaacuaggaaguaaaacaggaccaggacaaaaagcaauacuauuucuaccaaugagcgcaaagucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1983 - RNA, 802 nt, Artificial Sequence
  mRNA product Design1 comprising derived and/or modified sequence from Homo sapiens__NP_002000.1__HsFGF7 (opt6)
gggagaaagcuuaccaugcacaaauggauacuaacauggauacuaccaacacuacuauacagaagcugcuuccacauaauaugccuaguaggaacaauaagccuagcaugcaacgacaugacaccagaacaaauggcaacaaacguaaacugcucaucaccagaacgacacacaagaucauacgacuacauggaaggaggagacauacgaguaagaagacuauucugcagaacacaaugguaccuaagaauagacaaaagaggaaaaguaaaaggcacucaagaaaugaaaaacaacuacaacauaauggaaauaagaacaguagcagucggaaucguagcaauaaaaggaguagaaucagaauucuauuuagcaaugaacaaagaaggaaaacuauacgcaaaaaaagaaugcaacgaagacugcaacuucaaagaauuaauacuagaaaaccacuacaacacauacgcaucagccaaauggacacacaacggaggagaaauguucguagcacuaaaccaaaaaggaauaccaguaagaggaaaaaaaacaaaaaaagaacaaaaaacagcacacuuccuaccaauggcaauaacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1984 - RNA, 844 nt, Artificial Sequence
  mRNA product Design1 comprising derived and/or modified sequence from Homo sapiens__NP_001936.1__HsHBEGF (opt6)
gggagaaagcuuaccaugaaacuacuaccaucaguaguacuaaaacuauuuuuagcagcaguacuaucagcacuaguaacuggagaaucacuagaaagauuaagaagaggacuagcagcaggaaccucaaauccagacccaccaacaguaagcacagaccaauuauuaccacuaggaggaggaagagacagaaaaguaagagaccuacaagaagcagaccuagaccuauuaagaguaacacuaucaucaaaaccacaagcacuagcaacaccaaacaaagaagaacacggaaaaagaaaaaaaaaaggaaaaggacuaggaaaaaaaagagacccaugccuaagaaaauauaaagacuucugcauacacggagaaugcaaauacgucaaagaacuaagagcaccaagcugcauaugccaccccggauaccauggagaaagaugccacggacuaucacuaccaguagaaaaccgacuauacacauacgaucacacaacaauauuagcaguaguagcaguaguauuaucaucaguaugcuuacuaguaauaguaggacuauuaauguucagauaccacagacgaggaggauacgauguagaaaaugaagaaaaaguaaaacuaggaaugacaaauucacauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1985 - RNA, 2404 nt, Artificial Sequence
  mRNA product Design1 comprising derived and/or modified sequence from Homo sapiens__NP_000592.3__HsHGF (opt6)
gggagaaagcuuaccauguggguaacuaaacuuuuaccagcguuauuacuccaacacguauuacuacaccuccuauuauuaccaauagcuauaccauaugcagaaggacaaagaaaacgcagaaacaccauacaugaauuuaaaaaaucggccaaaacaacucuaaucaaaauagauccagcauuaaaaauaaaaacaaaaaaaguuaacacagccgaucaaugugcaaaccgcugcacacguaauaaaggccuaccauucacaugcaaagcauuuguauuugauaaagcacguaagcaaugucuaugguuuccauuuaauagcaugagcucuggcguaaaaaaagaauuuggacaugaauuugaccuauacgaaaauaaagacuauauuagaaacuguauuauaggaaaaggaagaucauauaagggcacaguauccauaacaaaaucaggaauuaaaugucaaccauggucauccaugauaccccacgaacauucauuuuuaccaucaaguuauagaggaaaagauuuacaagaaaacuauugccgaaacccaagaggagaagaaggcggaccuugguguuuuacaucaaacccagaagucagauaugaaguuugugauauaccccaauguucagaaguagaauguaugacauguaauggagaaucauauagaggucuaauggaucacacagaaagugguaagauaugccaaagaugggaucaucagacaccacaccgacauaaauuuuuacccgaaagauacccugauaaaggauuugaugauaauuacugucgaaacccugaugggcagccaagaccaugguguuauacuuuagacccccacacaagaugggaauauugcgcuauaaaaacaugcgcggauaauacaaugaaugauacagauguacccuuagaaacuacugaauguauacaaggacaaggugaggguuaucgcggcacugucaauacuauauggaauggcauccccugucaaagaugggauucacaauauccccaugaacaugauaugacaccagaaaacuuuaaauguaaagauuuacgagaaaauuauugccguaauccagaugguucagaaucucccuggugcuuuacaaccgauccaaauaucagagucggguacuguucacagauaccaaauugcgacaugucucauggucaagauuguuauaggggaaacggaaaaaauuauaugggaaacuuaucucaaacuagaucagguuuaacuuguaguaugugggauaaaaauauggaagauuuacacagacauauauucugggaaccugaugcaagcaaacuaaacgaaaacuacuguaggaauccagacgaugaugcacauggcccuuggugcuauacaggaaauccauuaaucccgugggauuauugucccauaucgcgaugugaaggcgacacaacgccaacuauaguaaaccuagaucauccagugauaucaugugcaaaaacuaaacaauuaagagucguaaauggaauaccaacaagaacaaacauuggauggaugguaucacuccgauacagaaauaaacauauauguggaggaucauuaauaaaagaaagcuggguuuuaaccgcaagacaauguuuuccaucucgagaccuuaaagacuaugaagcaugguuaggaauacacgacguacaugguagaggagacgaaaaauguaaacaaguacuaaauguuucccaacuuguauaugguccagaagguucagauuuaguauuaaugaaauuagcgagacccgcaguuuuagaugauuucguaagcaccauagaccuaccgaauuauggauguacuauaccagaaaaaacaaguuguaguguauacggauggggauauacaggccuaauaaauuaugacggauuacuaagagucgcacacuuauauauaaugggaaacgaaaaauguucacaacaucacagagguaaaguaacauuaaaugaaagugaaauaugugcaggagcugaaaaaauaggcucaggaccgugugaaggagauuauggaggcccacuaguaugugaacagcacaaaaugagaaugguacuaggaguaauaguaccaggccgaggaugugcaaucccaaacagaccaggaaucuuuguuagagucgcuuacuaugcuaaauggauacauaaaauaauacuaacauauaaaguaccacaaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1986 - RNA, 2143 nt, Artificial Sequence
  mRNA product Design1 comprising derived and/or modified sequence from Homo sapiens__NP_005336.3 __HsHSPA1A (opt6)
gggagaaagcuuaccauggcaaaagcagcagcaauuggaauagauuuggguacaacauacaguugcgugggcguguuucaacacggaaaaguagaaauaauagcaaacgaucaaggaaacaggacaacaccaucauacguggcauuuacagacacagaacgauuaauaggggacgcugcuaaaaaccaaguagcauuaaacccccaaaacacaguguucgaugcgaaaaggcuuauaggucggaaauuuggggaucccguaguccaaagcgauaugaaacauuggccauuccaagucauuaaugauggagauaaaccaaaagugcaaguaaguuacaagggugaaacaaaagcauuuuacccggaagaaauaucaaguaugguacuaacuaaaaugaaggaaauagcugaagcauaccuaggauacccaguaacaaaugcgguaauaacagugccagccuacuuuaacgauucgcaacgacaagcaacgaaagacgcaggggucauagccggucuaaaugucuuaagaauaauaaaugaaccaacagcagcagcgauagcuuacggacuagauagaacaggaaaaggugaaagaaacguacuaauauuugauuugggaggaggaacauuugacguaucgauauuaaccauagaugacggcauauuugaaguaaaggcaacggcaggagacacacaucugggaggagaagacuuugauaaucggcuaguaaaucacuuugucgaagaauuuaaaagaaaacacaagaaagauauaagucaaaacaaaagagcaguaagaagacuuagaaccgccugcgaaagagcaaaaagaacacuaagcucaucaacacaagcaaguuuggaaauagauucauuauuugaagguauagacuucuauacuucaauuacaagagccagauucgaagaacuauguagugauuuauuuagaaguacguuagaaccgguagaaaaagcguuaagagaugcuaaacuagauaaagcucaaauccaugaucuaguauuaguaggaggaaguacaagaauaccaaaagugcaaaaauuacuucaagauuucuuuaacggaagagaucuaaauaaaucgauaaauccagaugaagcgguagcguacggagcagcaguacaagcagcaauauugaugggagauaaaagugaaaacguucaagauuuauuauuacuagauguagccccauuaaguuuaggacucgagacagcugguggaguuaugacagcgcuaauaaaaaggaacucaacaauaccaacaaaacaaacacaaauauuuacaacauauagugauaaucaaccaggaguacuaauacaaguauaugaaggagaaagagcgaugacaaaagacaauaauuuacuuggaagauucgaacuuaguggaauaccaccagcaccacgaggaguaccacaaauagaaguaacguuugauauugacgcaaacggaauacuaaauguaaccgcuacagauaaaagcacaggaaaagcaaacaaaauaacuauaacaaaugauaaagguagauuaaguaaagaagaaauagaacguaugguacaagaagcagaaaaauacaaagcagaagacgaaguacaaagagaaagggucagcgcgaaaaaugcacuagaaaguuacgcauucaauaugaaaagugcaguagaagaugaaggacucaaaggaaaaauaagugaagcagauaaaaagaaagucuuagauaaaugucaagaagugauaagcuggcuagaugcaaauacauuagcugaaaaagacgaauuugaacauaaaagaaaagaacuagagcaaguaugcaacccaauaauaaguggcuuguaccaaggggcaggaggaccggggccaggaggcuuuggagcucaaggaccuaaaggaggaagcgguagcggaccaacaauagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1987 - RNA, 2143 nt, Artificial Sequence
  mRNA product Design1 comprising derived and/or modified sequence from Homo sapiens__NP_005337.2 __HsHSPA1B (opt6)
gggagaaagcuuaccauggcaaaagcagcagcgauaggaauagauuuagggacaacuuauaguuguguaggaguauuccaacauggaaaaguagaaauaauagcuaaugaccaaggaaauagaacaacuccuaguuauguagcauuuacagacacagaaagacuaauaggagacgccgcuaaaaaucaaguagcccucaauccacagaauacaguauucgacgcaaaaagacuuauagguaggaaauucggagauccagugguacaaagcgauaugaaacauuggccauuucaaguaauaaaugacggagauaaaccaaaaguacaaguaucauacaaaggagaaacaaaagcauuuuauccugaagaaaucucaaguaugguacuaacaaagaugaaggaaauugcagaagcauaucuuggauacccaguaacgaacgcaguaauaacaguaccugccuacuuuaacgacagccaacgucaagcaacuaaagacgcaggaguaauagcuggucuaaacguacuuagaauuaucaaugaaccaacugcagccgcaaucgcauacggacuagaccgaacgggaaaaggagaaaggaauguauuaauuuucgaccuaggaggaggaacauucgaugucucuauauuaacuauagacgauggaauuuuugaaguaaaagcaacggcaggagacacgcauuuaggaggagaagauuucgauaaccgucuaguaaaucauuucguugaagaauuuaaaagaaaacauaaaaaggacauuucgcaaaauaaaagagcagugagaagauuaagaaccgccugugaaagagcaaaaagaacauuaagcagcaguacgcaagcaagccuugaaauagauucacuauuugaaggaauagauuucuacacaucaauaacaagagcucgauuugaagaauuauguagcgacuuguucagaucaacauuagagccaguagaaaaagcacuaagagacgcaaaauuagacaaagcacaaauacaugaccuaguauuaguuggaggcaguacacgaauaccaaaaguacaaaaacuucuacaagacuucuuuaauggaagagaucuaaauaaaucaauaaauccagaugaagcaguagccuacggugcggcgguucaagcagcaauacugaugggggacaaaucagaaaauguacaagauuuauuauuauuagauguggcaccacuaucauuaggauuagaaacagcuggagguguaaugacagcacuaauuaaacgaaacagcaccauaccaacgaaacaaacacaaauauuuaccacguacucggacaaucaaccgggaguauugauacaaguauacgaaggagaaagagcaaugacuaaagacaacaaucuauuaggaagauucgaauuaucaggaauaccgccagcaccaagaggaguaccacaaauagaaguaacauucgauauagacgcaaauggcauuuuaaacguaacagcaacagacaaaucaacagguaaagcaaacaaaauaacaauaacaaaugauaaaggaagacuaucuaaagaagaaauagaaagaaugguacaagaagccgaaaaauacaaagcagaagaugaaguucaaagagaacgugugagugccaagaaugcacuugaaucguaugcguucaauaugaaaagcgcaguagaagaugagggccuaaaaggaaaaauaucagaagcagacaaaaagaaagucuuggauaagugucaagaaguaauaaguugguuagaugcaaacacacucgcagaaaaagaugaauuugaacauaaaagaaaagaacuagaacaaguaugcaauccaauaauaucaggguuauaccaaggagcaggcggaccaggacccgggggauucggugcccagggaccaaaaggcgguaguggcagcggaccaaccauugaagaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1988 - RNA, 2143 nt, Artificial Sequence
  mRNA product Design1 comprising derived and/or modified sequence from Homo sapiens__NP_005518.3 __HsHSPA1L (opt6)
gggagaaagcuuaccauggcuacagcaaaaggaauagcaauaggaauagauuuaggaacaacauauucguguguuggaguauuccaacacggaaaaguagaaaucauagcaaaugaccaaggaaacagaacaacaccaagcuauguagcauuuacggauacagaaagauuaauaggagacgcagccaaaaaccaaguagcuaugaauccacaaaauacaguauucgaugcaaaaagacuaauaggaagaaaauuuaaugacccaguaguacaagcagauaugaagcuauggcccuuccaaguuauaaaugaaggagggaaaccaaaaguucuaguaaguuauaaaggugaaaauaaagccuucuauccagaagaaauaucaagcaugguccuaacaaaacuaaaagaaaccgcagaagcauucuuaggacauccugucacuaacgcaguaauaacaguaccagcauacuucaacgauagucaacgucaagcaacaaaagaugcuggaguuauagcaggacuaaauguacuacgaauaaucaacgaaccgacagcagcagcuauagcauauggacucgacaaaggcggacaaggagaaagacacgugcucaucuucgacuuaggcgguggcacauuugauguauccauacuaaccauugacgauggaauuuucgaaguaaaagccacagccggagacacccaucuagggggagaagauuucgauaaccgguuaguaagucacuucguagaagaauuuaaaagaaaacacaagaaagauauaagucaaaauaaacgagcaguaagaagauuaagaacagcaugugaaagagccaaaagaacacuuaguaguucaacacaagcaaacuuagaaauagauucauuauacgaaggaauagauuucuauaccaguauaacaagagcaagauuugaagaacuaugcgcugauuuauuucgcggaacauuagaacccgucgaaaaagcauuaagagaugcaaaaauggauaaagcaaaaauacacgacauaguauuagugggagguagcacgcgaauaccaaagguucaacgauuauuacaagacuauuuuaauggcagagaccucaauaaaaguauaaacccugaugaagcaguugcauacggagcugcaguacaagcagcuauacugaugggagacaaaucagaaaaaguacaagaucuccuacuacuagacguagcuccacuaucacugggucuugagacagcgggaggcguaaugacagcauuaauuaaaaggaacucgaccauacccacaaaacaaacacaaauauuuaccacauauucagauaaccaaccuggagugcuuauucaaguauacgaaggagaaagagcaaugacgaaagauaauaacuugcuaggaagauuugaucuaacagggauuccaccagcaccaagaggcgugccacaaauagaagucaccuucgacauagacgcaaacggaauauuaaacgucacagcaaccgauaaaucaacagguaaggucaauaaaauuacaauaacaaacgauaaaggaagacuaucaaaagaagaaauagaaagaaugguacuagaugcagaaaaauacaaagcagaagacgaaguacaaagagagaaaauagcagcuaaaaacgcgcuagaaaguuacgcauuuaacaugaaaaguguaguaucugaugaaggauuaaaaggcaaaauuucagaaagcgauaaaaauaaaauacuagacaaaugcaaugaacuacuuaguugguuagaaguaaaucaacuagccgaaaaggaugaauuugaccauaaaagaaaagaacuggaacaaauguguaaucccaucauaacaaaacuauaucaaggaggcugcacaggaccagcauguggaaccggauauguaccaggacguccagcaacaggaccaacaauagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1989 - RNA, 2137 nt, Artificial Sequence
  mRNA product Design1 comprising derived and/or modified sequence from Homo sapiens__NP_068814.2 __HsHSPA2 (opt6)
gggagaaagcuuaccaugucagcaagaggaccagcaauugggauagaucuaggcacaacuuacucaugcguagguguauuccaacacggaaaaguagaaauuauagcaaacgaucaagggaacagaacaacaccaaguuauguagcauuuacagacacugaaagauuaauaggugacgcagcuaaaaaucaaguagcaaugaacccuacaaacacaauuuuugacgcaaaacgacuaaucggaagaaaauucgaagacgcaacaguacaaucagauaugaaacauuggccguucagaguaguaagcgaaggagggaaaccaaaaguacagguugaauacaaaggagaaacaaaaacuuucuucccagaagaaauuaguaguaugguccucacaaaaaugaaagaaauagcagaagcauaccuuggaggaaaaguucacucagcaguaauuacaguaccagcauacuucaacgauucccaaagacaagcaacgaaagacgccgguacaauaacaggauuaaacguguuaagaauuauaaacgaaccuaccgcagcagccauagcguauggauuagauaagaaaggaugugcaggaggagagaaaaauguauuaauauuugacuuaggcggugggacauuugauguaaguauacugacaauagaagaugggauauuugaagucaaaucgacagcaggagacacacauuuagggggagaagacuuugacaacagaaugguaagccaucuagcagaagaguucaaaagaaaacacaagaaagacauaggacccaauaaaagagcugucaggagacuuagaacagcaugcgaaagagcaaaaagaacauuaucaaguucaacacaagcaaguauagaaauagauucgcuauaugaaggaguugauuucuauacaaguauaacaagagcaagauuugaagaacuaaacgccgaucuauuuagaggaacauuagaaccgguugaaaaagcacuuagagacgcaaaauuggauaaaggccaaauacaagaaauuguucuaguaggaggaaguacacgcauuccaaaaauacaaaaacuauuacaagacuuuuucaauggaaaagaacucaauaaaucaauaaacccugaugaagcgguagcguauggugcagccguacaagccgcaauauuaaucggagacaaaagugaaaacguacaagaccuacuauuguuagauguaacaccauuaucacucggaauugaaacagcuggaggaguaaugacaccacucauaaaaagaaauacaaccauucccacaaaacaaacacaaacauucacaacguacagcgauaaccaaaguagcguccuaguacaaguauaugaaggcgaaagagcaaugaccaaagacaacaaucuauuaggaaaauucgacuuaacaggaauaccuccagcaccaaggggaguaccacaaauagaaguuacauuugacauagaugcuaacggaauauuaaacguaacagcagcagauaaaagcacaggaaaagagaauaaaauaacaauuacaaacgauaaaggaagacuaagcaaagacgauauagauagaaugguacaagaagcagaaagauauaaaagcgaagacgaagcuaacagggaucgagucgcagccaaaaaugcauuggaaagcuauacauacaauauaaaacaaacuguagaagaugaaaaauuaagaggaaagauaagugaacaagauaaaaauaaaauuuuagacaaaugucaagaaguuauaaacugguuagauagaaaccaaauggccgaaaaagacgaguacgaacauaaacaaaaagaacuagaaagagucuguaaucccauaauuagcaaauuauaccaaggaggacccggagguggaaguggaggaggaggaucaggagcaagcggaggcccaacaauagaagagguugauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1990 - RNA, 2740 nt, Artificial Sequence
  mRNA product Design1 comprising derived and/or modified sequence from Homo sapiens__NP_002145.3 __HsHSPA4 (opt6)
gggagaaagcuuaccaugagcgugguagguauagaucuuggauuccaaucauguuacguugccguagcaagagcaggaggaauagaaacaauagccaacgaauacagugacagauguacaccggccugcauauccuuuggaccuaaaaacagaucaaucggcgcagccgcaaaaucacaagugauuucaaaugcuaaaaacacagugcaagguuucaaaagauuccacggacgagcauuuagcgacccauuuguugaagcagaaaaaucaaacuuagcuuaugauaucguacaauuacccacaggacuaacagguauaaaagucacauauauggaagaggaaagaaacuucacaaccgaacaaguaaccgcgaugcuauuaucaaaacucaaagaaacagcagaauccgucuuaaagaaaccugucguugacuguguaguaucaguacccugcuucuacacagacgcagaaagaagauccguaauggaugccacacaaauagcuggucugaauugcuuacgacuaaugaaugaaacgacggcaguugcauuagcuuacggaauauauaaacaagacuuacccgcacuagaagaaaaaccaagaaacgucguauuuguagauaugggucacagugcauaucaaguguccguaugugcuuuuaacagagguaaacuaaaaguauuagcaacagcuuuugauacuacuuuaggcggacgaaaauuugaugaaguucuaguaaaucauuuuugcgaagaauuugguaagaaauacaaacucgauaucaaaucaaaaauacgugcauuauuacgacuuucacaagaaugugaaaaacuaaagaaauuaaugagugcaaacgcaagcgaccugccuuuaucuauagaauguuucaugaacgauguagauguaucgggcacaaugaacagagguaaauuccucgaaaugugcaacgaucuguuagcaagaguagaaccaccacuacgaaguguauuagaacaaacaaaacuaaagaaagaagacauuuaugcaguagaaauaguuggaggggcaacacgaauaccagcgguaaaagagaaaauuucaaaauucuuuggcaaagaauuaucaacuacacuuaaugcagaugaagccguaacuagaggaugugcacuccaaugugcaauauuaucaccagcuuucaaaguaagagaauuuagcauaacagauguaguaccauacccaauuucacugagauggaacucaccagcagaagaagggucauccgacugcgaaguauucaguaaaaaucaugcugccccuuuuucaaaaguacuaacauucuauagaaaagaaccuuuuacccuagaagcauacuauucaucaccccaagaucuuccauaccccgauccagcaauagcccaauuuagcgugcaaaaaguuacaccucaaagugauggaucaagcaguaaaguuaaaguaaaaguccgugugaacguucaugguauauuuaguguaucuucagccagccuaguagaaguacacaaaagcgaagaaaaugaagaaccaauggaaacggaucaaaaugcuaaagaagaagagaaaaugcaaguagaccaagaagaaccacauguagaggaacaacaacaacaaacacccgcagaaaacaaagccgaaagugaagaaauggaaacaucucaagcaggaucaaaggauaagaaaauggaucaaccuccucaagcgaagaaagcaaaaguaaaaacaucuacagucgaucuuccaauagaaaaccaacuuuuauggcaaaucgauagagaaauguuaaaccuauauauagaaaacgaaggaaaaaugauaaugcaagacaaauuagaaaaagaaagaaacgacgcuaaaaacgcaguagaagaauauguuuaugaaaugagagauaaacugagcggagaauacgaaaaauucguaagcgaagacgaucgaaauucauucacccuaaaacuugaagacacugaaaacuggcucuacgaagauggagaagaccaaccaaaacaaguauacguagauaaacuagcagaacugaaaaaccuaggacaaccaauaaaaauaagauuccaagaaagugaagaacguccuaaauuauucgaagaacuaggaaaacaaauacaacaauauaugaaaaucauaucaaguuuuaaaaacaaagaagaucaauacgaccacuuagaugccgcagacaugacaaaaguagaaaaaucuacuaacgaagccauggaauggaugaauaauaaauuaaaccuccagaacaaacaaucgcuaacaauggauccaguggucaaaucaaaagaaauagaagcaaaaauuaaagaacuaacaaguacuugcucaccaaucauaagcaaaccaaaacccaaagucgaaccaccaaaagaagaacagaaaaacgcagaacaaaauggaccaguagacggccaaggugacaacccaggaccacaagcagcggaacaagguacugacacagcaguacccucagacagugauaagaaacuaccagaaauggauauagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1991 - RNA, 2737 nt, Artificial Sequence
  mRNA product Design1 comprising derived and/or modified sequence from Homo sapiens__NP_055093.2 __HsHSPA4L (opt6)
gggagaaagcuuaccaugucaguagucggaauugaccuuggauuuuuaaacugcuacauagcaguagcuaggucaggaggaaucgaaacaauagcaaacgaauauagcgauagaugcaccccugccugcauaucauuaggaucacgcacuagagcaaucgggaacgcagccaaaucacaaauaguuacaaacguaagaaauacaauccacggauucaaaaaacuacacggcagguccuuugaugauccaauaguacaaacggaaagaauaagacuacccuacgaacugcaaaaaaugcccaauggaagugcaggcgucaaagucagauaucuagaagaagaaagaccuuuugcaauagaacaaguaaccggaauguuauuggcuaagcuaaaagaaacuucagaaaacgcauuaaagaaaccuguagcagauuguguuauaucaauaccaucguuuuucacagaugcagaacgaagaucaguaauggcagcagcacaaguagccggccuaaacugucuucgacuaaugaaugaaacaacugcaguugcccuagcuuauggaauuuauaaacaagauuuaccuccucuagacgaaaaacccaggaacguaguauucauagauaugggucauagugcauaucaaguucuagugugugcauuuaauaaaggaaaauuaaaaguccuagcaacaacauucgauccguaucuaggagggcgaaacuucgaugaggcacugguagacuacuuuugugacgaauucaaaacgaaauacaagauuaacguaaaagaaaacagcagagcucuucuaaggcuauaccaagaaugugaaaaacucaaaaaauuaauguccgcuaaugccucagaccuaccacuaaauauagaauguuucaugaaugauuuagaugugucaaguaaaaugaacagagcacaauuugaacaauuaugcgcaucauuacuagcucgaguagaaccaccauuaaaagccguaauggaacaagcuaauuuacaacgagaagauaucucaucaauagaaaucguuggaggagccaccagaauuccagcgguaaaagaacaaauuacuaaauuuuuucuuaaagacaucucaacaacacuaaaugcugacgaagcaguugcccggggaugcgcccuccaaugugcaauacuuagcccugcauuuaaaguacgagaauuuucaauaacagacuuaguuccauauucgaucacauuaagauggaaaacaucauucgaagacggcagcggcgaaugugaaguauucugcaaaaaccacccagccccuuuuagcaaaguaauaacauuucauaaaaaagaaccguuugaauuagaagcauuuuacacaaacuuacacgaaguaccauacccugaugcacgaauagguagcuuuacuauacaaaacguauucccacaauccgauggcgacagcucaaaaguuaaaguaaaagucagaguaaacauacauggaauuuucucugucgcaucagcaucuguuaucgaaaaacaaaaucuagaaggggaccauuccgacgccccaauggaaaccgaaacaagcuuuaaaaaugaaaacaaagacaauauggauaaaaugcaaguagaucaagaagaaggacaucaaaaaugccaugcugagcauacaccagaagaagagauagaccacacuggggcaaaaacaaaaucagccguuucagauaaacaagauagauuaaaucaaacacuaaaaaaaggcaagguaaaaucuauugauuuaccaauccaauccucacucugcagacaauuaggacaagaucuauuaaauagcuauauagaaaaugaaggaaaaaugaucaugcaagacaaacuagaaaaagaaagaaacgacgccaaaaaugcaguugaagaauacguauaugauuucagggaccgacuaggaaccguuuaugaaaaauuuauaacgccagaagaccuuucaaaacuaagugcaguauuagaagacacagagaacugguuauaugaagauggagaagaccaaccaaaacaaguauacguugacaaauuacaagaacuaaagaaauacggacaaccaauacaaaugaaauacauggagcacgaagaacguccaaaagcacuaaacgaccuaggcaaaaagauccaacuuguaaugaaaguaauagaagcuuauagaaauaaagaugaacgguaugaccaucuugaccccacagaaauggaaaaaguugaaaaaugcauaagcgacgcaaugagcuggcucaacagcaaaaugaacgcacaaaacaaauuaucacuaacacaagauccaguaguaaaagucagugaaauaguagcaaaaucaaaagaacuagacaauuucuguaauccaauaauauacaaacccaaaccaaaagccgaaguccccgaagacaaaccaaaagcaaacucagaacauaaugguccaauggauggacaaucuggaacagagacaaaaucagacucaacuaaagauucaucccaacauaccaagaguagcggggaaauggaagucgacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1992 - RNA, 2182 nt, Artificial Sequence
  mRNA product Design1 comprising derived and/or modified sequence from Homo sapiens__NP_005338.1__HsHSPA5 (opt6)
gggagaaagcuuaccaugaaauuaaguuugguggcagcaaugcuauuauuauuaagcgcugcaagagcagaagaagaggauaaaaaagaagauguugguacggugguuggaauugaccuuggaacaacauacagcugugucggaguauuuaaaaauggaagaguugaaauuauagcuaacgaucaggggaauagaauaacaccaaguuacguagcauucacaccagagggagaaagauuaaucggagacgcagcaaaaaaccaacuuacuaguaauccagaaaauacaguauucgaugcaaaaagauuaauaggaagaacauggaacgacccuuccguacaacaagauaucaaauuccuaccauuuaaaguuguagaaaaaaagacaaaaccauacauacaagucgauauaggaggaggacaaacaaaaacauuugcgccagaggaaaucagugcaaugguauuaacuaaaaugaaagagacagcagaagcauacuuagguaaaaaaguaacacacgcaguagucacaguaccagcauauuuuaacgacgcacaaagacaagcaacaaaggaugcaggaacaaucgcaggauuaaacguaaugagaauaauaaaugagccaacagcagcagcaauugcauauggauuagacaaacgagaaggugagaaaaacauccugguauucgacuuaggagggggcacauuugacguaaguuuauuaacuauagauaauggaguauuugaaguaguagcaacaaacggugacacacauuuaggaggagaagauuucgaucagagaguaauggaacauuuuauaaaauuauacaaaaaaaaaacaggaaaagauguaaggaaagacaauagagcagugcaaaaacuuaggagagaagucgaaaaagcaaaacgagcccuaaguagccaacaucaagcaagaauagaaauagaaagcuuuuaugaaggggaagacuucagugaaacacuuacgagagcaaaauuugaagaauuaaacauggaccuauuuagaagcacaaugaaaccuguacaaaaagugcucgaagauucagaccuaaaaaaaagcgacauagaugagauugucuuaguaggaggaaguacaagaauuccaaaaauccaacaacuaguaaaagaauuuuucaauggaaaagaaccuaguagaggaauaaacccagacgaagcaguagcauauggagcugcaguacaagcuggaguucuaaguggcgaccaagacacaggagacuuaguauuacuagacguauguccguuaacauuaggaauagaaacaguaggaggaguaaugaccaaauugauaccuaggaacacuguuguaccaacgaaaaaaucacaaauauuuaguacagcaucagauaaccaaccaacuguaacuauaaaaguauacgaaggagaaaggccucuaacaaaagacaaucaccuucugggaaccuuugaucucacaggaauaccaccagcaccacggggaguaccgcaaauagaaguaacauucgaaauagacgucaacgguauucuaagaguaacggccgaagauaaaggaacaggaaacaagaauaagauaacuauuacaaaugaccaaaaucgauuaacuccagaagaaauagaacgaauggucaacgacgcagaaaaauuugccgaagaagauaaaaaauuaaaagagagaauagauacucgaaacgaacuagaaaguuacgccuacucacucaaaaaccaaaucggggauaaagaaaaguuaggagguaaauuaucaagugaagauaaagaaacaauggaaaaagcagucgaagaaaaaauugaauggcuagaaucacaccaagacgcagauauagaagauuucaaagcaaaaaaaaaagaauuagaagaaauuguacaacccauaauuaguaaauuauauggaagugcagggccaccaccaacaggcgaagaagacacagcagaaaaagaugaauuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1993 - RNA, 2149 nt, Artificial Sequence
  mRNA product Design1 comprising derived and/or modified sequence from Homo sapiens__NP_002146.2__HsHSPA6 (opt6)
gggagaaagcuuaccaugcaagcaccaagagaacuagcgguaggaauagauuuaggaacaacuuacucauguguaggaguauuucaacaaggaagaguagaaauauuagcaaaugaccaaggaaauagaacaacacccucauacguagccuuuacagacaccgaacgauuaguaggagaugcagcaaaaagccaagcagcacucaacccacauaauacggucuuugacgcaaaaagauuaauaggccgaaaauuugcggauacuacaguacaaagugauaugaaacacuggcccuuucgaguaguaucugaaggaggaaaaccgaagguaagaguauguuaucgaggagaagacaaaacauucuauccagaagaaauaucuucuaugguauugucgaaaaugaaagaaacggcugaagcguaucuaggacaaccaguaaaacaugcaguaauaacuguaccagcuuacuuuaaugauagccagagacaagcaacaaaagaugcaggagccauagcaggauuaaauguauugaggauaauaaaugaaccaacugcagccgcaauagcauacggguuagaccgaagaggagccggugaaagaaaugucuuaauauuugauuugggcggaggaacauuugauguaaguguauuaucaauagacgcaggaguuuuugaagucaaagcaacggcaggagacacacauuuaggaggggaagacuuugauaauaggcuaguaaaucauuucauggaagaauuucgaagaaaacacggaaaagauuuaucuggaaauaaacgagcuuuaagaagguuaagaacagccugugaaagagcaaaaagaacauuaucaucaaguacacaagcaacauuagaaauugacucacucuucgaaggagucgacuucuauacaucaauaacacgagcaagauuugaagaacuaugcucagaucuauuucgaucaacauuagaaccaguggaaaaagcauugcgggaugcgaaauuagacaaagcacaaauacaugacguaguuuuaguaggcggcucaacaagaauaccaaaagugcaaaaacuauuacaagauuucuucaacgggaaagaauuaaacaaaucaauuaauccggaugaagcuguagcuuauggagcagcaguucaagccgccgucuuaaugggagacaaaugcgaaaaaguucaagauuuauuacuacuagauguggcaccacucucucuuggucucgaaacagcgggaggaguuaugacuacguuaauccaaagaaaugcaacaauuccaacaaaacaaacccagacauucacaacauacucugauaaucaaccaggagucuuuauacaaguuuacgaaggcgaacgagcaaugacaaaagauaauaauuuauugggaagauuugaacuuucaggaauacccccagcaccuagaggaguaccucaaauagaaguaaccuucgacauagacgcuaauggaauacuuagcguaacugcaacugauagaaguacaggaaaagcaaacaaaauaacaauaacaaacgauaaaggccgacuaagcaaagaagaaguagaaagaaugguacaugaagcugaacaauacaaagccgaagaugaagcacaacgagauagaguugcagcuaaaaauagucuagaggcacauguauuucauguaaaaggcagccuacaagaagagagcuuaagagacaaaauaccagaagaagacagaagaaaaaugcaagauaaguguagagaaguauuggcaugguuagaacauaaucaauuagcagaaaaagaagaauaugaacaucaaaaacgagaauuagaacaaauaugucgaccaauauuuucaagguuauauggaggcccaggaguaccagggggaaguucaugugguacacaagcaagacaaggugauccgucaacaggaccaaucaucgaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1994 - RNA, 1321 nt, Artificial Sequence
  mRNA product Design1 comprising derived and/or modified sequence from Homo sapiens__P48741__HsHSPA7 (opt6)
gggagaaagcuuaccaugcaagcaccaagagaauuagcuguaggaauagacuuaggaacaacauauuccuguguaggaguauuucaacaaggaagaguagaaauuuuagcaaaugaucaaggaaauagaacaacaccaucauauguagcauuuacugauaccgaaagauuagucggagaugcagcaaagucacaagcagcauuaaauccucacaauacaguuuuugaugcaaaaagauuaauaggaagaaaauucgcugauacaacaguacaaagcgacaugaaacauuggccauuccaaguuguaagcgaagguggaaaaccaaaaguacgaguauguuauagaggagaagacaaaacauucuaccccgaagaaauaucaaguaugguucuaucaaaaaugaaagaaacagcagaagcauauuuaggacaaccaguuaaacaugcaguaauaaccguuccaacauauuuuagcaauagucaaagacaagcaacuaaagaugcaggagcaauagcaggacuuaaaguacugccaauaauaaaugaagcaacagcagcagcaauagccuauggccuagacagaagaggagcuggaaaaagaaacguauuaauauuugauuuaggaggaggaacuuuugauguaaguguauuaaguauugacgcaggcguuuuugaaguaaaagcaacugcuggugauacucacuuggguggagaagauuuugauaauagauuaguaaaucauuuuauggaagaauuuagaagaaaacacggaaaagaucuaaguggaaauaaaagggcauugagaagauuaagaacagcaugugaaagagcaaaaagaacaccuagcucaaguacacaagcaacgcuagaaauagauucauuauucgaaggaguagauuuuuauaaaucaaucacaagggcaagauuugaagaauuaugcagugacuuauucaggagcacauuagaaccaguagaaaaagcauuaagagaugcaaaauuagauaaagcacaaauacaugauuuugugcuaggagggggauuacauucacauccacaaggagcagaaguugcagcaggauuauuacaaagacaaggagcagaacaagaacaccaaccauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1995 - RNA, 2158 nt, Artificial Sequence
  mRNA product Design1 comprising derived and/or modified sequence from Homo sapiens__NP_006588.1 __HsHSPA8 (opt6)
gggagaaagcuuaccaugagcaaagggccagcaguaggaauagauuuagguaccaccuacagcuguguaggaguauuccaacacggaaaaguggaaauaauagcaaaugaccaaggcaauaggacaacaccaucauacguugcauucacagauaccgagcgacuaauuggagaugcagcuaaaaaucaaguagcaaugaauccaacaaauacgguauuugacgcaaaaagacuaauaggcaggagguuugaugacgcaguuguacaaagcgauaugaaacacuggccauuuaugguaguaaaugaugcuggaagaccaaaaguacaaguagaauacaaaggcgaaacuaaaaguuucuaccccgaagaaguaucuucaaugguauuaacaaaaaugaaagaaaucgcagaagcauacuuaggaaaaacgguuacaaacgcaguaguaacaguaccagcauauuuuaacgacucccaaaggcaagcaacaaaagacgcugggacaauugccgggcuuaauguauuaagaaucauaaaugaaccaacagcagcagcaauagccuacggauuagauaagaaaguaggugcagaaagaaacguauuaauauuugacuuaggcgguggaacauuugauguaucaauauuaacaauagaagacggaauauuugaaguaaaaucuacagcuggagacacacaccuaggaggagaagauuucgauaacagaaugguaaaucauuuuauagccgaauuuaaaaggaaacauaagaaagauauaagugaaaauaaaagagcaguaagaagauuaagaacagcaugcgagcgagcgaaaaggacuuuaucaucgagcacacaagcaagcauagaaauugauagccuauaugaagguauagacuuuuacacaucaauaacaagagcccgauucgaagaauuaaacgcagaucuauuuagaggaacguuagacccaguagaaaaagcauuaagagaugcaaaauuagauaaaagccaaauacaugacaucguauugguuggaggaucuacaagaauaccuaaaauacaaaaauuacuacaagacuucuuuaacggcaaagaauuaaacaaaucaauaaauccagacgaagcaguagcguauggugcggcgguacaagccgcuauauuauccggagacaaaagugaaaacguacaagaucuacuauuacuagacguaacaccccuaucauuaggaauugaaacagcaggaggaguaaugacaguuuuaauaaaaagaaauacaacaauaccaacuaaacaaacccaaacauuuacaacuuacagugacaaucaaccaggagugcucauacaaguuuacgaaggagaacgagcaaugacaaaagacaacaaucuauuaggaaaauuugaacuaaccggaauaccaccagcaccuagaggcgugccacaaauagaagucacauuugacauagaugcaaauggaauacuaaacgucagcgcagucgauaaaucaacaggaaaagaaaacaaaauaaccauaacaaacgacaaaggacgccugagcaaagaagauaucgaacgaaugguacaagaagcagaaaaauauaaagcggaggacgaaaaacaacgagacaaaguaagcaguaaaaacagcuuagaaucauaugcauuuaauaugaaagcaacuguagaagacgaaaaauuacaaggaaaaauaaacgaugaagauaaacagaaaauacuagacaaauguaacgagauaauaaauuggcuggacaaaaaucaaacggcagaaaaagaagaauuugaacaucaacaaaaagagcuugaaaaaguuuguaauccaauaauaacaaaacuauaucaaagugcaggaggaaugccaggaggaaugcccggaggauucccuggaggaggcgcacccccaaguggaggagccaguucaggcccaacaauagaagaaguagauuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1996 - RNA, 2257 nt, Artificial Sequence
  mRNA product Design1 comprising derived and/or modified sequence from Homo sapiens__NP_004125.3 __HsHSPA9 (opt6)
gggagaaagcuuaccaugauaucagcaagcagagcagcagcagcaagacuugugggagcagcagcaucaagaggaccuacagcagcaaggcaucaagauucguggaauggguuaagccaugaggcguuuagacuugugucuaggagagauuacgccagcgaagcaauuaaaggugcgguuguaggaauagaucuaggaacgacaaacucauguguagcagucauggaaggaaaacaagcaaaagugcuagaaaaugcagaaggcgcaagaacaacaccaucaguaguugcauuuacagcagauggagaaagguuaguugguaugccagcaaaaagacaagcaguaacaaauccgaacaauacauuuuacgcuacaaaaagguuaauaggaagaagauacgaugacccagaagugcaaaaagauauuaaaaauguaccuuuuaaaauagucagagcaucuaauggugaugcauggguagaggcccacggaaaacucuacucuccaagucaaauaggagccuucguauuaaugaagaugaaagaaacagcugaaaauuauuuaggacacacagcgaaaaaugcaguaauaacgguaccagcauacuucaacgacagucaaagacaggcaacaaaagacgcaggacaaauaaguggauuaaacguauuaagaguaauaaaugaaccuacagcagcagcauuagcauauggccuagauaaaucagaagacaaaguaauagcgguauaugauuuaggcggaggaacauuugacauuucaauauuagagauacaaaaagguguauuugaaguuaaaaguacaaauggugacacauuuuugggaggagaagauuucgaucaagcacuacuucgacauauaguuaaagaguuuaaaagagaaacagggguagaucucacuaaagauaauauggcauugcaaaggguaagggaagcagcugaaaaagcaaagugcgagcuaagcucaucuguacaaacggauauuaaucuaccauauuuaacaauggacagcucagguccaaaacaucucaauaugaaauuaacaagagcucaauucgaaggaauaguaacggacuuaauaagaagaacuauagcaccaugucaaaaagcuaugcaggaugcggaagugagcaagagugacauaggagaaguuaucuugguagguggaaugacaagaaugccaaaaguucaacagacaguacaagaucuauucgggagagcuccuaguaaagcuguuaauccagacgaagccguagccauaggagcagcaauacaaggaggaguauuagcaggagauguaacugauguacuacuauuagauguaacaccguugagccuuggaauagaaacuuuaggaggaguguucacuaaauuaaucaauagaaauacaacgauaccuacgaagaaaucacaaguauucaguacagcagccgaugggcaaacacaaguagaaauaaaagucugccaaggagaaagagagauggcaggagauaauaaauuguuagggcaauuuacauuaauagguauaccuccagcaccgagaggaguaccucagauagaaguuacauucgauauagaugcaaaugguauaguucauguaucagcaaaagacaaaggaacuggaagagaacaacaaauagugauacaaagcaguggaggacuaaguaaagaugauauagaaaacaugguuaaaaacgcggaaaaauaugcagaagaagauagaagaaagaaagagagaguagaagcaguuaacauggcugaaggaauaauacaugacacugaaacaaaaauggaagaauuuaaagaucagcuaccagcagaugaauguaauaaacuaaaagaggaaauaaguaaaaugagagaauuguuagcuagaaaagacagugagacuggagaaaauauuagacaagcagcaagcucauuacaacaagcaagccucaaauuauuugagauggcauauaagaaaauggcaucagaaagggaaggauccggaucaagcggaacgggagaacaaaaagaagaucaaaaagaagaaaaacaauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1997 - RNA, 2245 nt, Artificial Sequence
  mRNA product Design1 comprising derived and/or modified sequence from Homo sapiens__NP_079291.2__HsHSPA12A (opt6)
gggagaaagcuuaccauggcagacaaagaagcaggcggaagugaugggccaagagaaacagcaccaacaucagcauacaguucaccagcaagaagccuaggagacacaggaauaaccccauuaaguccaucgcacauuguaaacgacacagacuccaacguaagcgaacaacaaaguuuccuaguaguaguagcuguagauuuuggaaccacaucaucaggauacgcauacucauuuacaaaagaaccugaauguauacaugucaugagaagaugggaaggcggagauccuggaguaaguaaucaaaaaacuccaacaacaauacuucucacaccagaacgaaaauuccacucauuuggauaugcagccagagacuuuuaccacgauuuagauccaaaugaagcaaaacaaugguuauaccuagaaaaauucaaaaugaaacuucauaccacuggagauuuaacaauggacacagaccuaacagcagccaauggaaaaaaaguaaaagcacuagagauauuugcauacgcacuacaauacuuuaaagaacaagcacuaaaagaauuaagcgaccaagcagguuccgaauuugaaaauucagacguaagauggguaauaacaguccccgcaauauggaaacaacccgccaagcaauuuaugagacaggcagcauaccaagcgggacuagccuccccagaaaacucagaacaacuaauuauagcacuugaaccagaggcagcgucaauauauuguagaaaacuacgauuacaucaaaugauagaauuaaguucaaaagcagcaguaaauggauacucaggaucagauacagugggagcaggauuuacacaagcuaaagaacauauuagaagaaacagacaaagcagaacauuucuuguagaaaacgucauaggagaaauaugguccgaacuagaagaaggagauaaauauguaguaguugacagcggaggaggaacaguagaucuaacuguccaucaaaucagacuacccgaagggcacuuaaaggaacuauacaaagcaacgggaggcccauacggcucauuaggaguugacuacgaauucgaaaaauuauuauacaaaauauucggagaagauuuuauagaacaauuuaaaaucaaaaggccugcagcauggguagauuuaaugauagcauuugaaagcagaaaaagagccgcagcacccgauagaacaaacccacuaaauauaacacuaccguucucauuuauagauuacuauaaaaaauuuagaggacauucgguagaacaugcacuaagaaaaagcaacguugacuuugucaaauggagcagucaaggaauguuacggaugagcccagaugcaaugaaugcacuauucaaaccaacaauagauaguaucauagaacauuuaagagauuuauuucaaaaaccagaagucaguacaguaaaauuccuauucuuaguaggcggauucgcagaagcaccccuauuacaacaagccguacaagcagcauucggagaucaauguagaauaauaaucccacaagaugucggacucacaauacucaaaggagcaguucuauucggacucgacccagcaguaauuaaaguaagaagaucaccacuuaccuaugguguugguguauuaaauagauauguagaaggaaaacacccuccagaaaaauuauuaguaaaagauggaacaagauggugcacugacguauuugauaaauuuauuucggcagaccaaucaguagcucuaggugaacuuguaaaacgauccuauacaccugcaaaaccaucacaacuagucauaguaauaaauauauacuccucagaacacgauaaugucucauuuaucacugacccaggaguaaaaaaauguggcacauuaagauuagauuugacagguacaagugguacugcaguacccgcacgaagagaaauccagacauuaaugcaauuuggcgacacagaaaucaaagccacagcaauagacauagccacaucuaaaucaguaaaaguaggaauagacuucuuaaauuauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1998 - RNA, 2278 nt, Artificial Sequence
  mRNA product Design1 comprising derived and/or modified sequence from Homo sapiens__NP_443202.3 __HsHSPA12B (opt6)
gggagaaagcuuaccaugcuugcaguuccagaaaugggacuacaaggacuauauauaggcaguucaccagaacgaaguccgguacccaguccaccgggaucaccaaggacacaagaaaguugcggaauagcaccucuaacaccuagccaaucaccuaaaccugaagugagagcaccacaacaagcgaguuucucgguuguaguagcaauagauuucggaacaacaucaagugguuaugcauuuucauuugcuucagauccagaagcuauacauaugaugcgaaaaugggaaggaggcgauccuggcguagcacaucagaaaaccccuacuugucuauugcuaacaccagaaggagcauuucauaguuuuggauauaccgcucgagauuacuaucaugacuuagauccagaagaagcaagggauugguuauacuuugaaaaauuuaaaaugaaaauacauagugccacggaucuaacauuaaaaacacaauuagaagcaguaaauggaaaaacaaugccagcauuagaaguauuugcacacgcauugagauucuuucgcgaacaugccuuacaagaacuacgcgaacaauccccuuccuuaccagaaaaggauacuguacgauggguauuaacaguccccgcuauauggaaacaaccggcuaaacaauuuaugagagaagcagcauauuuggcuggccuagucagccgggaaaacgcugaacaauuacuaauagcauuagaaccagaagcugcaagcguauacuguagaaaacuaagacuucaucaauuacuagaucuaagcggaagggcaccuggaggagggcgauuaggagaaagaagaucuauagauucaucauuuagacaagcuagagaacaauuaagaagaucacgucacucaagaacauuucuaguugaaucagguguaggcgaacuuugggcagaaaugcaagcaggagacagauauguaguggcugacugcggaggggguacaguugaccuaacaguacaucaauuagaacaaccacacggaacacuaaaagaauuauauaaggcuucaggaggaccauacggggcaguaggaguugaucuagcuuuugaacaacuacuuugucgaauauucggugaagauuuuauagcaacauuuaaaaggcaaagaccugcugcauggguagaucuaacuauagcauucgaggcaagaaaacgaacagcaggaccacauagagcuggugcuuuaaacauuucauuaccauuuucauucauagauuuuuacagaaaacaaagaggacauaauguagaaacagcauuaagaagaaguucaguaaauuuuguaaaauggucuagucaaggaaugcuaagaaugucaugcgaagcuaugaacgaacuauuucaacccacaguauccgguauaauacaacauauagaagcacuauuagcuagaccugaaguacaaggaguaaaauuauuauuuuuaguaggaggauucgcagaaucagcuguguuacaacaugcugugcaagcagcguugggcgcuagaggucuaagaguaguaguuccucacgauguaggacuaacaauacuaaaaggagcaguauuauucggccaagcgccuggaguaguucgaguaagaagaucuccauuaacauauggugugggaguauuaaauagauucgugccagguagacauccaccagagaagcuauuaguaagagauggcaggaggugguguacugaugucuucgaaagguuuguugcagccgaacaaagcguugcacuaggagaagaaguuagaagaucauacuguccagcacggccaggacaaagaagagugcuaauuaacuuauauuguugcgcagcagaagaugcaagauuuauuacagacccagguguaagaaaguguggagcccucaguuuagaacuugaaccagcugauugcggccaagauacagcaggcgcacccccaggcagacgagaaauaagagcggcaaugcaauuuggagauacagaaauaaaaguuacagcuguagauguaagcacaaacagaaguguuagagcaucaauagacuuucuaaguaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 1999 - RNA, 1633 nt, Artificial Sequence
  mRNA product Design1 comprising derived and/or modified sequence from Homo sapiens__NP_008879.3__HsHSPA13 (opt6)
gggagaaagcuuaccauggcuagagaaaugacaauacucggcucugcaguauuaaccuuacuauuagcaggauauuuagcacaacaauaccuucccuuaccaacaccaaaaguaauagguauagaucucgguacaacauauuguuccgucggaguuuucuuuccaggaaccggaaaaguuaaaguuauaccagacgaaaauggacacauauccauaccaaguaugguaaguuuuaccgacaacgauguauaugucgguuacgaaagcguagaauuagcagauaguaauccacaaaacacaauauaugacgcaaaaagauucauaggaaaaaucuucaccgcagaagaacuggaagcagaaauaggaagauauccauucaaaguacuaaauaaaaauggaaugguagaauucucaguaacuuccaaugaaacaauaacaguaucaccagaauaugucggcucaagauuauuauuaaaauuaaaagaaauggcagaagcauacuuaggaaugccaguagcaaacgcaguaaucucaguaccagccgaauucgauuuaaaacaaagaaauuccacuauagaagcagcaaaucuagcaggucuuaaaauauuaagaguaauaaaugaacccacagcagcagcaauggcauauggacuacacaaagcagauguuuuucacguacuagugauagauuuaggaggcggcacauuagacguaagucuacucaauaaacaaggcgguauguuucuaacaagagccaugaguggaaacaacaaauuaggaggacaagacuuuaaccaaagacuacuacaauauuuauacaaacaaauuuaccaaacauauggauucgucccaucaagaaaagaggaaauccacagacuaaggcaagcaguagagauggucaaacuaaacuuaacauuacaucaaucagcacaacuaucagucuuauuaacaguagaagagcaagauagaaaagaaccucacuccagugacacagaacucccuaaagauaaacuaucaucagcagaugaccaccgagucaacaguggauucggaagaggccuaagugacaaaaaaagcggagaaucacaaguauuauuugaaacugaaauuagcagaaaacuauuugauacauuaaaugaagaccuauuucaaaaaauacuaguaccaauacaacaaguacucaaagaaggacauuuagaaaaaacagaaauagacgaaguaguacuaguaggaggaagcacacgaauuccuagaauaagacaaguaauacaagaauuuuucggcaaagacccuaauacaucaguagacccagaucuagccgucguaacaggaguagcaauacaggcaggaauagauggaggaagcuggccacuucaagucagugccuuagaaaucccaaacaaacauuuacaaaaaaccaauuucaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2000 - RNA, 1747 nt, Artificial Sequence
  mRNA product Design1 comprising derived and/or modified sequence from Homo sapiens__NP_057383.2__HsHSPA14 (opt6)
gggagaaagcuuaccauggcagcaauaggaguacaccuaggauguacaucagcauguguagccguauauaaagaugguagagcaggaguuguggccaaugaugccggagauagaguaacuccugcaguaguugcauacagcgaaaaugaagagauaguuggacuagcugcaaaacaaagcagaauaagaaauauaaguaauacaguaaugaaagucaaacaaauauuaggaagaucaaguucagacccucaagcucaaaaauacauugcugaaagcaaaugucuaguaauagagaaaaauggaaaacuaagauaugaaauugauacgggugaagaaacuaaauucguaaacccagaagauguagcaagacuaauauuuaguaaaaugaaagaaacagcucauucaguauuaggaucagacgcaaaugacguaguaauaacuguaccauucgauuuuggagaaaaacaaaagaacgcuuuaggagaagcggcuagagcagcagguuuuaauguauuaagacuaauacaugaaccauccgcugcacuauuagcauacggaauaggacaagauaguccaacagguaaaucaaauauccuaguauucaaauuaggaggaacaucauuaucguuaucaguaauggaaguaaauagugggauauauagaguauugagcacaaauacagaugauaauauaggcggagcacauuuuacagaaacucuagcacaauaucuagcaagugaauuucaaagaaguuuuaaacaugauguucgaggaaaugcaagagcaaugaugaaauuaacaaauucagcggaaguagcaaaacacucauuaagcacguuagguagugcaaauuguuucuuagauaguuuauaugaaggacaagauuuugauuguaauguaucacgagcccgauuugaauuauuauguagcccucuauuuaauaaauguauagaagcaauaaggggauuacucgaucaaaauggauucacagcugaugauauaaauaaaguaguauuauguggagguucaaguagaauaccuaaauuacaacaacuaauaaaagacuuauuuccagcaguagaacugcuaaauaguauaccgccagacgaaguaauaccaauaggagcagcaauugaagccggaauacuaauuggaaaagaaaaucuauuaguagaagacagccuuaugauagaauguagugcaagagacauacucgucaaaggcguagaugaauccggagcaaguagauucacuguauuauucccaucaggaacgccacuaccagcaagaagacaacauacacuacaagcaccaggaagcauaucaaguguaugucuagaacuauaugaaucagacgggaaaaauagcgcaaaagaagaaacaaaauuugcacaaguaguauuacaagauuuagacaagaaagaaaauggauuaagagauauauuagcaguauuaacuaugaaacgagacggaagucuacauguaacauguacagaucaagagacaggaaaaugugaagcgauaucaauagaaauugcuagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2001 - RNA, 2794 nt, Artificial Sequence
  mRNA product Design1 comprising derived and/or modified sequence from Homo sapiens__NP_006635.2 __HsHSPH1 (opt6)
gggagaaagcuuaccaugucaguaguaggacuugauguaggaucacaaucauguuauauagcaguagcacgagcaggagguauagaaacaauagcaaaugaauucagcgauagauguacaccuucagucauaucuuucggaucaaagaaucgaaccauuggcguagccgcaaaaaaccaacaaaucacgcacgcuaacaauacaguaucaaacuuuaaaagauuucacggucgagcguuuaaugaccccuucauucaaaaagaaaaagaaaacuuaagcuaugaccuuguaccacuuaaaaauggaggaguaggcauuaaaguaauguacaugggagaagaacaccuauuuaguguagaacaaaucaccgcgaugcuacuaacaaaacuaaaagaaacagcagagaauagccuaaaaaaaccaguuacugacugcguaauaaguguaccaucuuucuuuaccgacgcagaaagacgguccguucuagaugcagcccaaauaguaggauuaaacugucucagacuaaugaaugauaugacugcaguggcucuaaauuauggaauauauaaacaagacuugccaucacuagaugaaaaaccaagaaucguagucuucgucgauaugggccauagcgcauuucaaguuucagcaugugcuuucaacaaaggaaaacugaaaguucuaggaacggcauucgauccauuucuagggggaaaaaauuuugacgaaaaauuaguagaacacuuuugcgccgaauucaaaacaaaauacaaacuagacgcaaaaaguaaaauaagagcauuauugagauuauaccaagaaugcgaaaaacuaaaaaaauuaaugagcuccaacucaacagacuugccauuaaacauagaaugcuucaugaaugauaaagacguauccgguaaaaugaauagaucccaguucgaggaacuaugugccgaacuacuucaaaaaauagaaguaccauuauacucacuauuagaacaaacucaccuaaaagucgaagacguaagugcaguagaaauuguagguggagcaacaagaauaccggcuguaaaagaaagaauagcaaaauucuuuggaaaagauauaucaacaacauuaaacgccgaugaagccguagcuagagggugcgcacuucaaugcgccauauuaucaccagcguuuaaagucagagaauucaguguuaccgaugcaguaccauucccaauaaguuuaauauggaaccaugacucagaagacaccgaaggaguucaugaaguauuuagccgaaaccacgccgcaccauuuaguaaaguauuaacauuucuaagacgugguccauuugagcuugaagcauuuuauucugauccacaaggaguaccauacccagaagcaaaaauaggcagauuugucguacaaaacguaucggcacaaaaagauggagaaaaaucacgagucaaaguaaaggugagaguaaacacacauggaauauucacaauaaguacagccagcaugguggaaaaaguuccaacagaagaaaacgaaaugagcagcgaagcagauauggaaugucuaaaccaaagaccgccagaaaacccagacacagauaagaauguccaacaagacaacucugaagcaggcacucaaccacaaguucaaacagaugcacaacaaacuucacaaucaccaccgucuccagaauuaaccagugaagaaaacaaaauacccgacgcagauaaagcaaacgaaaaaaaaguagaccaaccaccagaagcaaagaaaccaaaaauuaaagucgugaacguagaauuaccaauagaagcaaaucuaguauggcaauuaggcaaagaccuauuaaauauguauaucgagaccgaagguaaaaugauaaugcaagacaaauuagagaaagaacgaaaugaugcaaaaaaugcaguagaagaauauguauaugaauuuagagauaaacuauguggaccguacgaaaaauuuauaugugaacaagaccaucaaaauuuucuacgacuucuaacugagacagaagacuggcuauacgaagaaggagaagaucaagcaaaacaagcguauguagacaaacuagaagaauuaaugaagauagguacaccaguaaaaguacgauuccaagaagcagaagagagaccaaaaauguuugaagaacugggucaaagauuacaacacuaugcaaaaaucgccgcagacuuucgaaacaaagacgaaaaguauaaucauauagaugaaucagaaaugaaaaaagucgaaaaaagugucaacgaagugauggaguggaugaauaacguuaugaaugcacaagccaaaaaaagccuagaucaagauccuguaguaagagcacaagagaucaaaaccaaaauaaaagaacuaaauaacaccugcgagccagugguuacccagccaaaaccaaaaauagaaagucccaaauuagagagaacccccaauggaccaaauauagauaaaaaagaagaagaccuagaggauaaaaauaacuucggagccgaaccaccacaccaaaauggggaauguuaccccaacgaaaaaaauaguguaaacauggauuuagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2002 - RNA, 3217 nt, Artificial Sequence
  mRNA product Design1 comprising derived and/or modified sequence from Homo sapiens__NP_006380.1 __HsHYOU1 (opt6)
gggagaaagcuuaccauggcugauaaagucagacgacaacggccaagaagaaggguaugcugggcacugguagcaguucugcuagccgauuuauuagcguuaucagauacccuagcuguaaugagcguagacuuaggcagugaaaguaugaaaguggcaauaguaaaaccaggaguacccauggagauuguuuuaaauaaagaaucaagaagaaagacgccaguaauaguaacgcuaaaagagaacgaaagauucuuuggagacucagcagcaaguauggcaauuaaaaacccaaaagcaacccugagauacuuucaacaucuguugggcaaacaagcagacaacccacauguagcgcuauaccaagcgagguuuccugaacacgaacuaacauucgacccacaaagacaaacaguacacuuccaaauaucuucacaacuccaauuuucaccugaggaaguacuuggaauggucuuaaacuacagucgaaguuuggcggaagauuuugccgaacaaccuauaaaagaugcaguaauaacaguaccuguauucuuuaaucaagccgagaggagagcuguauuacaagcugcaagaauggcuggacuuaaaguacuacaacucauaaaugacaauacagcuacugcacuaucauaugguguuuuuagaagaaaagacauaaacacaacugcacaaaauaucauguuuuacgauaugggaagcggaagcacagucugcacuauagucaccuaucagauggugaaaacaaaagaagcaggaaugcagccucaauuacaaauaagaggaguagguuuugacagaacgcuggguggauuagaaauggaacugagauuaagagaacgauuggcaggacuauucaaugagcaacgaaagggucagagagcuaaagacguuagagaaaauccucgcgcaauggcuaaacuuuuacgcgaagcaaauagauuaaagacaguacuuagugcaaacgcagaccauauggcucaaauagaaggacuaauggaugacguagacuuuaaagcaaaaguaacacgaguagaguucgaagaacuaugugcagaucucuuugaaagaguaccugguccaguacaacaagcucuacaaagugcugaaaugucuuuagacgaaauugaacaaguaauauuggucggcggagcaacacgaguuccuagaguacaagaaguauugcuuaaggcaguaggaaaagaagaacuagggaaaaauauaaacgcugacgaagcagcagcaaugggagccguuuaccaagcggcagcacuaagcaaggcuuuuaaaguuaaaccauuuguaguaagagaugcaguuguauauccaauuuuaguagaauuuacucgagaaguagaagaagaaccagggauacacucacuaaaacacaacaaaagaguacucuuuagcaggaugggaccguauccacaacguaaagucauaacauuuaacagauauucucaugauuuuaauuuccauauaaacuacggagacuuaggcuuuuuagguccagaagaucuaaggguauuugguucacaaaaucucacaacgguuaaacuaaaagggguaggagauaguuucaagaaauacccagacuaugaaucuaaaggaauaaaagcacauuuuaaucuagaugaaagugggguauugagucuagaccgagucgagagcguauucgaaacucugguugaagauagugccgaagaggaaucaaccuugacuaaacuagguaauacgauaagcagcuuauucggagguggcacaacaccagaugcaaaagaaaauggaacagacacaguacaggaagaagaagaaagcccggcagagggcucaaaagaugaaccuggggaacaaguagaguuaaaagaagaagcagaagcaccaguggaagacgguucgcaaccaccucccccagagccaaaaggugaugcaacaccagaaggcgaaaaagcaacagaaaaagaaaauggggauaaaucagaagcacaaaagccaagugaaaaagcagaagcuggaccagaaggaguugcuccugcaccagaaggagaaaagaaacaaaaacccgcacgcaaaagaagaaugguagaggaaauaggugucgagcuaguaguauuagaucuaccagaucucccagaagacaaauuggcacaaaguguacaaaaacugcaggacuuaaccuuaagagacuuagaaaaacaagaaagggaaaaagcugcaaauucuuuggaagcauucauauucgaaacacaggacaaauuauaucaacccgaauaucaggaaguauccacagaagaacaaagagaagaaauaucaggaaaacucucagcagcaucaacgugguuggaagaugaaggaguaggugcaacaacaguaauguuaaaagaaaaauuagcagaacuaaggaaacugugccaaggauuauuuuucagagucgaagaaagaaagaaauggccagaacgguuaucugcauuagauaauuuacuaaaccacucuaguauguuucuaaaaggggccagauuaauaccagaaauggaucaaauuuuuacugaaguagaaaugacaacacuagaaaaaguaaucaacgaaacaugggcauggaaaaaugcaacuuuagcagaacaagcaaaauuaccggcaacagaaaaaccagucuuacuaucaaaagacauagaagcgaaaaugauggcauuagacagagaaguccaauaccuacuaaacaaagcaaaguucacaaaacccagaccgcggccaaaagauaaaaacggaacccgagccgagccaccacuaaaugcaagcgcaagugaucaaggggagaagguaauaccgccugcaggacaaacagaagacgcagaaccaaucuccgaaccagaaaaaguagaaacaggaucggaaccuggagauacagaaccccuagaauuaggaggaccuggagcugagccagaacaaaaagaacaaaguacaggacaaaaacgaccucuuaaaaaugacgaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2003 - RNA, 2416 nt, Artificial Sequence
  mRNA product Design1 comprising derived and/or modified sequence from Homo sapiens__NP_005339.3 __HsHSP90AA1 (opt6)
gggagaaagcuuaccaugccagaagaaacccaaacacaagaccaacccauggaagaagaggaaguagaaacauucgcuuuccaagcagaaauugcacaauuaaugagucuaauuauaaacacauucuacucaaacaaagaaauauuuuuacgcgaacuaauaagcaacucaagcgaugcauuagauaaaauuagauaugaaucguuaacagauccaagcaaauuagacucaggaaaagaauuacacauaaaucuuaucccaaacaaacaagauagaacacuuaccauagucgacaccggaauaggaaugacaaaagcugaccuaauaaacaauuuagguacaauagcaaaaucggguaccaaagcauucauggaagcacuacaagcaggugccgacaucucgaugauaggacaauuuggaguaggauucuacagcgcauaccuaguagcagagaaaguaacaguuauaacaaagcacaacgacgacgaacaauacgccugggaaucaagugcaggaggaucauucacaguaagaacagacacaggugaaccaaugggcagagguacgaaaguaauacuucaucuuaaagaagaccaaacagaauaccuagaggaaagaagaaucaaagaaauaguaaaaaaacacucacaauucauaggauauccaauaacacucuuuguagagaaagaaagagacaaagaagucagugacgaugaagcagaggaaaaagaagauaaagaagaagaaaaagaaaaagaagaaaaagaaagugaagacaaaccagaaauagaagacguaggaucggaugaggaggaagaaaaaaaagauggagacaaaaaaaaaaagaaaaaaauaaaagaaaaauacauagaucaagaagaacugaacaaaaccaaaccaauauggacaaggaaccccgacgacaucacaaacgaagaauacggagaauuuuacaaaucacuuacaaaugacugggaagaccaccucgccgucaaacacuuuagcguagaaggucaauuagaauucagagcccuacuguuuguaccuagaagagcaccauucgauuuguuugagaauagaaaaaaaaaaaauaauaucaaacuauacguaagaagaguauuuauaauggacaauugcgaagaauuaauaccagaauaucuaaauuuuaucaggggaguagucgacagcgaagauuuaccauuaaacauaucgcgagagauguuacaacaaucaaaaauucugaaaguaauaagaaaaaaucuagucaaaaaaugucuagaacuauucacagaacuagcagaagacaaagaaaacuacaaaaaauucuaugaacaauucucaaaaaauauaaaauugggcauacacgaagacucucagaauagaaaaaaacuaucagaauuacuaagauauuauacgucagcuaguggagacgagaugguaucccuaaaagacuacugcacaaggaugaaagaaaaucaaaaacauauauacuacauaacuggagaaaccaaggaccaagucgcaaacucagcauucguagaaagauuacgaaagcauggacuggaaguaauauacaugauagaacccauagaugaauauugcguacaacaauuaaaagaauucgaaggaaaaacuuuaguaagcguaacgaaagaaggacuagaauuacccgaagaugaagaagagaaaaaaaaacaagaagagaaaaaaaccaaauucgaaaacuuauguaaaauaaugaaagacauauuagaaaaaaaaguagaaaaaguuguaguaucaaacagacuaguaacaagcccauguugcauaguaacaaguaccuacggguggacggcaaacauggaaagaauaaugaaagcccaagcuuuacgagacaauaguacgaugggauacauggcagccaaaaagcauuuagaaauaaacccagaccacagcauaaucgaaacacuuagacaaaaagccgaagcugauaaaaacgacaaauccgugaaagaccucgucaucuuacuuuaugaaacagcauuauuaaguaguggauucucccuagaagacccgcaaacacacgcuaaucgaauauaccgaaugauuaagcucggauuaggaauagacgaagaugacccaacagcggaugauacaagcgcagcaguaacugaagagaugccaccauuagaaggagaugaugauacgucaaggauggaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2004 - RNA, 556 nt, Artificial Sequence
  mRNA product Design1 comprising derived and/or modified sequence from Homo sapiens__NG_005218__HsHSP90AA3P (opt6)
gggagaaagcuuaccauggacucaagcaaacuagacagcggaaaaggacuacacauaaacuuaguaccaaacaaacaaaaccaaacacuaacaauaguagacacaagaauaggaaugacaaaaacagacuuaauaaacaaccuaggaacaguaacaaaaucaggaacaaaagcauucauggaagcacuacaagcagacgcagacauaucaaugauaggacacuucggaguaggauucuacucagcauaccuaguagcaaaaaaaguaacaguaauaucaaaacacaacaacgacgaacaauacacaugggaaucaucagcaggaggaucauucacaguaagaacagacgaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2005 - RNA, 2392 nt, Artificial Sequence
  mRNA product Design1 comprising derived and/or modified sequence from Homo sapiens__NP_031381.2__HsHSP90AB1 (opt6)
gggagaaagcuuaccaugcccgaagaagugcaucauggcgaagaggagguagaaacauucgcuuuucaagcugaaauagcucagcuaaugagccuaauaauaaacacuuuuuacagcaacaaagaaauauuucuccgcgaguuaauaucaaacgcuucagaugcacuugauaaaauaagauacgagagccuaacagacccuaguaaacuagauagcgguaaagaacuaaaaauagacauaauacccaacccgcaagaaagaacacuuacacuugucgauacuggaauaggaaugacaaaagcagaucuaauaaauaacuuaggaacaauagcaaaaucagggacgaaagcguuuauggaagcauuacaagcaggagcagauauuaguaugauaggacaauuuggaguaggauucuacagugcuuaucuuguagcagaaaaaguaguaguaauaacaaaacacaaugacgacgaacaauaugcuugggaaucuucagccggagggucauucacgguuagagcagaccacggagaaccaauaggaagaggcacuaagguaauacuacauuuaaaggaagaucagacagaauaccuugaagaacgaagaguaaaagaaguaguaaaaaaacauucacaauuuauaggauaccccauaacauuauaccuggaaaaagaaagagaaaaagaaauaucugacgacgaagccgaagaagaaaaaggagaaaaagaagaagaagacaaagaugaugaagaaaaaccgaaaaucgaagacguaggaucagacgaagaagacgacucaggaaaagacaaaaaaaaaaaaacaaaaaaaauaaaagaaaaauacauagaucaagaagaauugaacaaaacaaaaccaauauggacaagaaauccagaugauauaacacaagaagaauauggagaauucuacaaaagucuuacaaaugacugggaagaccaucuagcagucaaacauuuuucaguagaaggacaacuagaauucagagcguuauuauuuauaccaagaagagcgccauucgaccuauuugaaaacaaaaaaaaaaaaaacaauauaaaacuauacguaagaagagucuucauaauggacucgugcgaugaauuaauaccagaauacuuaaauuucauaagaggaguagucgauuccgaagacuuaccacuaaauauaucucgagaaauguuacaacaauccaaaauacuaaaagugauaagaaaaaauaucguaaaaaaaugucuugaacuauuuucggaacuugcggaagacaaggaaaauuauaaaaaauuuuaugaagcguucaguaaaaacuuaaagcuaggcauacaugaagacuccacaaauagaagaagacuaagcgaacuauuaagauaccauacaucacaaucaggagacgaaaugacaucucuaagugaauaugugagcaggaugaaagaaacccaaaaaucaauauacuacauaacaggagaaucgaaagaacagguagcaaauucagcauucgucgaacguguacgcaaaagaggauuugaaguaguauacaugacugagccaauagacgaauauuguguacaacaacuaaaagaauucgacggaaaaagucuagucaguguaacaaaagaaggacuagaacuaccagaagaugaagaagaaaaaaaaaaaauggaagaaagcaaagcaaaguucgaaaauuuaugcaaauuaaugaaagaaauacuagauaaaaaagucgaaaaaguuacaauuucaaauagacuagucucaucaccaugcugcauagucacaagcacauacggauggaccgccaauauggaaagaauaaugaaggcacaagcauuaagagauaacagcacgaugggauacaugauggcaaaaaaacaucuugaaauaaauccagaccacccaauagucgaaacacuaagacagaaagcagaagcagauaaaaacgacaaagcuguaaaagaccucgugguccugcucuucgaaacagcauuacugaguucaggauucucgcuggaagacccacagacucauucaaauagaauuuacagaaugauaaaacuaggauuaggaaucgaugaagacgaaguggcagcagaagaaccaaacgccgcggucccagacgaaauaccuccauuagaaggagacgaggaugcaagccgaauggaagaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2006 - RNA, 2629 nt, Artificial Sequence
  mRNA product Design1 comprising derived and/or modified sequence from Homo sapiens__NP_003290.1__HsHSP90B1 (opt6)
gggagaaagcuuaccaugcgagcuuuauggguacuaggcuuauguugcguauuacuuacauucggaucaguacgugcagacgaugaaguagauguagaugguacaguagaagaagauuuaggcaaaucaagagaaggaaguaggacagacgaugagguaguacaaagagaagaagaagcaauucaacuagacggacuuaacgcaucucaaauaagagaauuacgagaaaaaucagaaaaauuugcauuccaggcagaaguaaauagaaugaugaaacuaaucauaaauagucucuauaaaaacaaagaaauauucuuacgagaacuaauaucaaaugcaagugaugcuuuagacaaaauacgacuuaucagucuaacagaugaaaaugcacucaguggcaaugaagaacuaacaguuaaaauaaaaugcgauaaagagaaaaauuuacuacauguuacagacaccgguguaggaaugacaagagaagaauuaguuaaaaauuuaggaacaauagcaaaaaguggaacaagugaauuucuaaauaaaaugacugaagcucaggaagauggacaaagcacuucagaacuaauuggacaauucggaguaggauucuacucagcauuccuuguagcugauaaaguaaucguaacuagcaaacacaauaacgacacacaacauauaugggaaucagauucaaacgaauuuagcguaauugcagauccaagaggaaauacacuaggaagagggaccacaauaacauuaguacuaaaagaggaagcaagcgacuacuuagaacucgauacgauuaaaaauuuaguaaagaaauacucacaguuuauaaauuucccaauauacgucuggaguaguaaaacagaaacaguagaagaaccaauggaggaagaagaagcagccaaagaagaaaaagaagaaucggacgacgaagcugcugucgaagaagaagaagaagaaaagaaaccaaaaacaaagaaaguagagaaaacuguuugggauugggaauuaaugaacgauaucaaaccaauauggcaaagacccucaaaagaagucgaagaagacgaauauaaagccuuuuacaagucauuuuccaaagaaucggaugacccaauggcauauauucacuuuacagcagagggagaagucacauuuaaaucuauacuuuuugucccaacaagugcaccgagaggauuauuugaugaauacgguucaaagaaaucagacuauauaaaauuauauguaagaagaguguucauaacagacgacuuucacgauaugaugccgaaauacuuaaacuuuguuaaaggagucguugacagcgaugaccuaccacucaacguaaguagagaaacacuacaacaacauaaacuauugaaaguuauaagaaagaaacucguaagaaaaacuuuagacaugauuaagaaaauagcagacgacaaauauaacgauacauuuuggaaagaguucgguacaaauauaaaacuaggaguaauagaagaccacaguaauagaacccgauuagccaaauuacucagguuccaaucaucgcaucacccaacagacaucacgagcuuagaucaauauguagaaagaaugaaagaaaaacaagauaaaauauacuuuauggcgggaucaucaagaaaagaagccgaaucuucuccauucguugaacgacuauuaaagaaaggauaugaaguaauauaccuaacagaaccuguagaugaauauuguauacaagcacuaccagaauuugauggcaaacgcuuccaaaauguagcaaaagaaggcguuaaauuugaugaaagcgaaaagacaaaagaaaguagagaagcgguugaaaaagaguucgaaccauuauuaaauuggaugaaagacaaagcacuaaaagauaaaauagaaaaagcuguaguaucucaaagauuaaccgaauccccgugcgcacucguagccagucaauauggcuggucagguaacauggaaagaauaaugaaagcucaagcauaucaaacaggaaaagauauaaguacgaacuauuacgcaucucaaaagaaaacauucgaaauaaauccaagacacccacugauaagagauauguuaaggcgaauaaaagaagaugaagacgacaaaacaguucuagacuuagcugucguacuauucgaaacagcaacauuaagaagcggauacuuacuaccagacacaaaagcauauggagauaggauagaacggauguuacgacuaagucucaacauagauccagaugccaaaguugaagaagaaccagaagaggaaccagaagagaccgcagaagacacaacagaagacacagaacaggacgaagacgaagaaauggacguaggaacugacgaagaagaagaaacagcaaaagaaucuacagcagaaaaagacgagcuguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2007 - RNA, 2332 nt, Artificial Sequence
  mRNA product Design1 comprising derived and/or modified sequence from Homo sapiens__NP_057376.2__HsTRAP1 (opt6)
gggagaaagcuuaccauggcacgagaauuaagagcucuuuuacuaugggguagacgacugagaccauuauuaagggcgccagcccucgcagcaguaccaggaggaaaaccaauacucugcccaagaagaacaaccgcacaauuaggcccaagaagaaauccagcauggucauuacaagcuggaagacuauuuuccacccaaacagcagaagauaaagaagaacccuuacauucaauaauaucaagcacagaaucaguccaaggaucaacaucaaaacaugaauuucaagcagaaacaaagaaacuauuagauauuguugcuagaagccuuuauucugaaaaagaaguauuuauaagagaacuaauuaguaacgcuagcgacgccuuagaaaagcuaagacacaaguuaguaagugauggacaagcauuaccagaaauggaaauacaccugcaaaccaaugcagaaaaaggaacaauaaccauacaagauaccggcauaggaaugacacaagaagaauuaguaaguaaccuuggaacaauagcuagaagcggaucaaaagcauuccucgacgcacuacaaaaccaagcagaagcaucauccaaaauaauuggacaauuuggcguaggauucuauagugccuuuaugguagcagaucgugucgaagucuauucacgaucagcagcaccaggaucacuaggguaucaaugguuaucagacggauccgguguauucgaaauugccgaagccucgggcguaagaacggguacuaaaauaauaauacauuuaaaaucagauugcaaagaauucucuucagaagcacgaguccgagauguaguaacgaaauauucaaacuuuguuaguuuucccuuauauuuaaauggucguagaaugaauaccuuacaagcaauauggaugauggauccaaaagauguuagagaauggcaacaugaagaauuuuauagauauguugcucaagcucaugacaaaccccgauauacuuuacacuacaaaacagacgcaccauuaaauaucaggaguauauuuuaugugccagauaugaaacccucgauguuugaugucaguagagaauuaggaagcaguguggcucuauauucuagaaaaguacucauacaaaccaaagcaacggauauauuaccaaaauggcucagauuuauaagaggaguuguugauucagaagacauacccuuaaaucuuaguagagaacuacuucaagaaucagcauuaauaagaaaauuaagagacguccuucaacaaagauuaauuaaauucuuuauagaccaaucaaaaaaagaugcagaaaaauaugcaaaauucuucgaagacuauggauuauuuaugagagaaggaauaguaacagcaacagaacaagaaguaaaagaggauauagcaaaauuauuacgguacgaaucaucagcauuaccaucaggacaacuuacaucauuauccgaauacgccagucgaaugagagcaggcacaagaaacauauauuaccuaugugcaccaaacagacaucuagcagagcacucaccuuauuacgaagcaaugaaaaaaaaagauacagaaguucuauuuugcuuugaacaauuugacgagcuuaccuuacuccaucuaagagaauuugacaaaaaaaaauuaauaaguguugaaacagacauaguaguugaucauuauaaagaagaaaaauuugaagaucgaagcccagcagcagaaugccuaucagaaaaagaaaccgaagaauuaauggccuggaugcguaauguucuaggaagcagaguuacaaacguaaaaguaacgcuaagauuagauacucauccagccaugguaacugugcuagaaaugggcgcagccaggcacuuccuaagaaugcaacaauuagcaaaaacacaagaagaaagagcacaauuacuucaaccaacacuugagauaaaucccagacaugcauuaaucaaaaaacuaaaccaacuucgugcaagcgaaccaggauuagcacaacuuuuaguugaucaaauauaugaaaacgcaaugauagcagcuggacucgucgaugauccaagagcaauggugggacgccuuaaugaauuauugguaaaagcauuggaacgacauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2008 - RNA, 679 nt, Artificial Sequence
  mRNA product Design1 comprising derived and/or modified sequence from Homo sapiens__NP_000609.1__HsIGF1 (opt6)
gggagaaagcuuaccaugggaaaaauaucaucacuaccaacacaacuauucaaaugcugcuucugcgacuuccuaaaaguaaaaaugcacacaaugucaucaucacaccuauucuaccuagcacuaugccuacuaacauucacaucaucagcaacagcaggaccagaaacacuaugcggcgcagaacuaguagacgcauuacaauucguaugcggagacagaggauucuacuucaacaaaccaacaggauacggaucaucaucaagaagagcaccacaaacaggcauaguagacgaaugcugcuuccgaucaugcgaccuaagaagacuagaaauguacugcgcaccacuaaaaccagcaaaaucagcaagaucaguaagagcacaaagacacacagacaugcccaaaacacaaaaagaaguacaccuaaaaaacgcauccagaggaucagcaggaaacaaaaacuacagaauguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2009 - RNA, 760 nt, Artificial Sequence
  mRNA product Design1 comprising derived and/or modified sequence from Homo sapiens__NP_000603.1__HsIGF2 (opt6)
gggagaaagcuuaccaugggaauaccaaugggaaaaucaaugcuaguacuauuaacauuucuagcauuugcaagcuguugcauugcagcauacagaccaucagaaacacuauguggaggagaauuaguagauacauuacaauuuguauguggagauagaggauucuauuucucaagaccagcaucaagaguuagcagaagaaguagaggaauaguagaagaaugcuguuucagaagcugugauuuagcauuacuagaaacauauugcgcaacaccagcaaaaagugaaagagauguaucaacaccaccaacuguauuaccagauaacuuuccaagauacccaguaggaaaauucuuucaauacgauacauggaaacaaagcacacaaagacuaagaagaggacuaccagcauuauuaagagcaagaagaggacacguucuagcaaaagaacuagaagcauuuagagaagcaaaaagacauagaccacuaauagcauuaccaacacaagauccagcacacggaggagcaccaccagaaauggcaucaaacagaaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2010 - RNA, 856 nt, Artificial Sequence
  mRNA product Design1 comprising derived and/or modified sequence from Homo sapiens__NP_000591.1__HsIL6 (opt6)
gggagaaagcuuaccaugaauuccuucucaacaucagccuucggaccaguagccuucucacuaggacuacuacuaguacuacccgcagcauucccagcaccagucccaccaggagaagacucaaaagacguagcagcaccacacagacaaccauuaacaucaucagaacgaauagacaaacaaauaagauacauauuagacggaauaucagcacuaagaaaagaaacaugcaacaaaucaaacaugugcgaaucaucaaaagaagcccuagcagaaaacaaccuuaaucuaccaaaaauggcagaaaaagacggaugcuuccaaucaggauucaacgaagaaacaugccuaguaaaaauaauaacaggacuacuagaauucgaaguauaccucgaauaccuacaaaacagauucgaauccucagaagaacaagcccgagcaguccaaaugucaacaaaaguacuaauacaauucuuacaaaaaaaagcaaaaaaucuagacgcaauaacaacaccagacccaacaacaaacgccuccuuacuaacaaaacuacaagcacaaaaccaaugguuacaagacaugacaacacaccucauacuaagaucauucaaagaauuccuacaauccucacuaagagcacuuagacaaauguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2011 - RNA, 1498 nt, Artificial Sequence
  mRNA product Design1 comprising derived and/or modified sequence from Homo sapiens__NP_002183.1__HsINHBA (opt6)
gggagaaagcuuaccaugccacuacugugguuaagagguuuccuauuagcaagcugcuggauaauaguaagaagcaguccaacaccagggagcgaaggacacagugcggcaccagacugcccaucaugugcgcuagcagcauuaccaaaagacguuccaaauagucaaccagaaaugguugaagcaguaaaaaaacauauauuaaauaugcuacaucuaaaaaaaagaccagauguaacacaaccaguaccgaaagcagcauuauuaaaugcaauacgaaaauuacaugucggaaaaguaggagaaaacggauauguagaaauagaagacgacauuggaagaagagcagaaaugaacgaauuaauggaacaaacaagugaaauuauaacguuugcagaaucaggaacagccagaaaaacacuacacuuugaaauaucaaaagaaggcucagaccuaucaguuguagaaagagcggaaguaugguuauuucuaaaaguaccuaaagcaaacagaacaagaacaaaaguaacaauuagacuauuucaacaacaaaaacacccacaaggaagucuagauacaggagaagaagcagaagaaguaggauuaaaaggagaaaggagugaauuacuauuaagugaaaaaguaguagacgcaagaaaaucaacauggcacguauuuccaguaucaucaagcauacaacgacuacuagaccaaggaaaauccucauuagauguaagaaucgcaugcgaacaaugucaagaaaguggugcaucauuaguacuauuaggaaaaaaaaaaaaaaaagaagaagaaggagaaggaaaaaaaaaaggaggaggagaaggaggugcaggagcagacgaagaaaaagaacaaagccauagaccauucuuaauguuacaagcaagacaaagugaagaccauccucauaggagaagaagaagaggacuugaaugcgacggaaaaguaaauauauguuguaaaaaacaauucuuuguaagcuuuaaagauauaggauggaacgauuggauaauagcuccaaguggauaucacgcaaauuacugcgaaggagaaugcccaucacacauagcgggaacaagcggaagcucacuaucauuccauagcacaguaauaaaccauuacagaaugagaggacauaguccauucgcaaacuuaaaaucaugcugugucccaacaaaacuaagaccaauguccauguuauauuaugaugacggucaaaauauaauaaaaaaagauauacaaaacaugauaguagaagaauguggcuguagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2012 - RNA, 1441 nt, Artificial Sequence
  mRNA product Design1 comprising derived and/or modified sequence from Homo sapiens__NP_002184.2__HsINHBB (opt6)
gggagaaagcuuaccauggauggauuacccgggagggcacuaggugcagcuugccuauuacuacuagcagcaggauggcuaggaccagaagcauggggaagcccgacaccaccuccuacaccagcagcaccaccaccaccuccuccaccaggaucaccaggaggaagucaagacacauguacaucaugcggaggauuccgaagaccagaagaacuaggaagaguagauggagauuuucuagaagcaguuaaacgacauauacuaucuagacuacaaaugcgaggaagaccaaauauaacacacgcaguuccaaaagcagcaaugguaacagcacuuagaaaauuacaugcagguaaaguacgugaagauggaagaguagaaauaccacaucuagacggucacgcuucaccaggagcugacggucaagaaagaguaucagaaaucaucagcuuugccgaaacugauggacuagcaucaucacgaguuagauuauauuuuuuuauuaguaaugaaggaaaucaaaauuuauucguuguccaagcuucauuauggcuuuauuuaaaauuacuaccuuauguauuagaaaaaggaucaagaagaaaaguaagaguuaaagucuauuuccaagaacaaggucauggagauagauggaauaugguagaaaaaagaguagaccuaaaaagaucaggauggcacacuuucccauuaacagaagcaauacaagcauuauucgaaagaggagaaagaagacuaaauuuagacguucaaugugacucaugucaagaauuagcaguaguaccaguuuuugucgauccaggagaagaaagucauagaccuuuuguaguaguacaagcgagauuaggagauucaagacacagaauaaggaaaagaggauuagaaugugacgggagaacaaacuuauguuguagacaacaauuuuuuauagauuuucgacuaauaggauggaaugauuggauaauagcaccuacaggauauuauggaaauuauugugaaggaaguuguccagcauauuuagcaggaguaccaggaucagcaagcaguuuucauacagcaguaguuaaucaauauagaaugagaggacuaaauccuggaacgguaaauucguguugcauuccuacaaaacuaucaacaaugagcauguuauacuucgaugacgaauauaauauaguuaaaagagacguaccaaacaugauuguagaagaauguggaugugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2013 - RNA, 3676 nt, Artificial Sequence
  mRNA product Design1 comprising derived and/or modified sequence from Homo sapiens__NP_000623.2__HsITGAM (opt6)
gggagaaagcuuaccauggcucucagaguacuacuacuaacugcacuaacuuuaugccacggcuucaacuuagauaccgaaaacgccaugacuuuucaagaaaaugcaagagguuucggacaaucuguaguacaacuacaaggcucaaggguaguuguaggcgccccucaagaaaucguagccgcuaaucagcgagguucucuuuaucaaugugauuauucaacuggauccugugaacccauccgauuacaaguaccuguagaagcuguaaauaugucacuuggacuaagucucgcugcaacaacaucacccccgcaacuacucgcauguggcccaaccguacaucagacauguucugaaaacacauacguaaaaggauuauguuuccuauuuggcaguaacuuacgacaacaaccacaaaaauucccagaagccuuaagaggauguccucaagaagauagcgauauugcauuccucauagauggaucugguuccauuauaccucaugauuuccggcgaaugaaagaauuuguuucaacagucauggaacaacuaaagaaaucaaaaacauuauuuuccuuaaugcaauauagugaagaguuccgaauacauuuuaccuucaaagaauuucaaaauaacccaaacccgcgaagucucguaaaacccauuacccaacuucuagguagaacucacacagcaacagguauuagaaaaguuguucgagaguuauuuaauauuacaaacggagcacguaaaaacgcuuucaaaauccuaguuguaauaacagacggagaaaaauuuggugacccacuagguuaugaagauguuaucccagaggcugacagagaaggagucauuagauaugucauaggaguaggagaugcauuccgcagugagaaaaguagacaggaacuuaacacgauagccucuaaacccccaagggaucacgucuuccaaguaaacaacuuugaggcuuuaaaaaccauacaaaaccaauugcgugagaaaauuuuugcuauagaagggacacaaacuggauccucaucuucauuugaacaugaaaugucucaagaaggauuuucagcagccaucacaucaaacggaccuuuacuaucaaccguuggcuccuaugauugggcuggaggagucuuccuuuauacuucuaaagaaaaauccacuuuuauaaauaugacccggguugauagcgacaugaaugacgccuauuuggguuaugcagcugcuauaauacuacgaaaucguguccaaaguuuaguccuaggagcucccagauaucagcauauugguuuaguugcgauguuuagacaaaacacagguaugugggaaucaaaugcaaauguuaaaggaacacaaauuggggcauauuucggcgcuucccuauguucaguagacgucgauucaaauggauccacggauuuaguucucauaggugcaccacacuauuaugaacaaacccgagguggccaagucuccguaugcccccuaccacgcggccgugcacguuggcagugcgacgcuguacuuuauggugaacaaggacaaccuuggggacguuuuggagcagcccuaacuguacuuggagacguuaauggcgacaaauuaacggauguugcgaucggggcaccaggcgaagaagauaauagaggagccguauacuuauuucauggcacaagcggcucaggaauaucaccuucacauagucaaagaauagcaggaucaaaacuaucuccaagauuacaauacuuugggcaaagucuaagcggcggacaagaccuuacaauggauggauuaguagaucuaaccguuggagcacaaggacauguauuauuauuaagaucccaaccuguucuuagagucaaagcuauuauggaauuuaacccuagagaaguagcucgcaauguuuuugaauguaaugaucagguuguuaaagguaaagaagcaggagaaguccguguuugucuucacguacagaaaucaacuagggauagacuaagagaaggacaaauacaaaguguuguuacauaugauuuagcacuagacucuggucgaccacauucaagagcaguuuucaacgagacuaaaaacucaacacgaagacaaacccagguauuagguuuaacacaaacuugcgaaacacuuaaacuacaauuaccuaauugcauagaagauccaguuucaccaauaguccuacgauuaaacuucucauuaguuggcaccccacuguccgcuuucggaaaccuacgucccguccucgcagaagacgcacaaagacuauuuacagcuuuauucccuuuugaaaagaauugcggcaaugauaauauaugucaagacgaucuuucaauuacuuuuaguuuuaugucacuagauugccuaguaguaggaggaccaagagaauuuaauguaacaguuacaguacgcaacgacggagaagacucuuaucgaacacaaguuacauuuuucuuuccauuagacuuaaguuaccgaaaaguaucaacccuucaaaaucaacgaucacaaagaucauggagguuagccugcgaaucggcaucauccacugaaguaucuggugcacucaaaaguacuucauguuccauuaaucauccuauauuuccugaaaauuccgaaguaaccuuuaacauaacauuugauguugauucaaaagccucucucgguaauaaauuacuacuuaaagcaaacgugacauccgaaaauaacaugccaagaacuaauaaaacggaauuucaauuagaauuaccuguuaaguacgcagucuacaugguugugacaagucauggcguuuccacaaaauaucuuaacuuuacagcaagugaaaacacaucaaggguuaugcaacaucaauaucaagucaguaaccuuggucaacgaagccuaccaaucucauuggucuuucucgucccaguaagacuaaaucaaaccguaauaugggaucgaccgcaaguuacuuucagugaaaacuuaaguucuacaugccacacaaaagaaagacuuccaucucacucugacuuucuagcugaacuacgaaaagcucccguuguaaacuguucuauagcaguuugucaacguauacaaugugauauuccauucuuuggaauacaagaagaguucaaugcuacauuaaaagguaauuuaucguuugauugguacauuaaaacuagccauaaucauuuauuaauaguuucuacugcagaaauccuguuuaaugauuccguauucacucuauuacccggacaaggagcauuuguaagaucccaaaccgaaacaaaaguagaaccuuuugaaguccccaacccucuuccuuuaaucguuggaucaagcguuggcggacuauuacuuuuagccuuaauaacggcggcauuauauaaauuaggauucuucaaacgccaauauaaagauaugaugucugaagguggaccuccuggagcagaaccacaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2014 - RNA, 1621 nt, Artificial Sequence
  mRNA product Design1 comprising derived and/or modified sequence from Homo sapiens__NP_002415.1__HsMMP8 (opt6)
gggagaaagcuuaccauguuuucacuaaaaacauuaccuuuccuacuucuacuacacguacaaauaucaaaagcauuuccagucucaucaaaagaaaaaaacacaaaaacaguacaagauuaucucgaaaaauuuuaccaauuaccaucaaaucaauaucaaucaacacgaaaaaauggaacaaacguaauaguugaaaaauuaaaagaaaugcaaagauucuuuggacucaaugucacaggcaaaccuaacgaagaaacacuagacaugaugaaaaaaccaagaugcggaguaccagacucaggaggauucauguuaaccccaggcaacccuaaaugggaaagaacaaaucuaacauacagaauacgaaacuauacaccacaacuauccgaagcagaagucgaaagagcaauaaaagacgcuuuugaacuuuggucaguagccuccccacuaauauucacacgaauaucacaaggagaagccgacaucaacauagcauuuuaucaacgagaccacggagacaauucccccuucgacggaccaaauggaauacuagcacacgcauuccaaccuggacaaggaauaggaggagaugcacauuucgacgcagaagaaacauggacaaacacaucagcaaacuacaaccuauucuuagucgcagcacacgaauucggacauucucuaggacuagcccauucaucugaccccggcgcacuaauguauccaaacuacgcauuuagagaaacauccaacuacucccuaccccaagacgauauagaugguauccaagcaauauacggacuauccucaaauccaauacaaccaacaggccccucuacaccaaaaccaugcgacccaucccuuacauucgacgcaauaacaacccuccgaggagaaauauuauucuuuaaagacagauacuucuggagaagacacccucaacuccaacgaguugaaaugaacuucauaucuuuauuuuggccaucucuaccaacagggauccaagcagcuuacgaagauuuugaucgcgacuuaauauuuuuauucaaaggaaaucaauacugggcauuaucaggauaugauauacuacaaggauaccccaaagacauaucaaauuauggauuccccuccucaguccaagccaucgacgcugcaguauucuaccgaucaaaaaccuacuucuuuguaaaugaccaauuuuggagauacgauaaucaacgucaauucauggaaccugguuauccaaaaucaauaucuggcgcauuucccggaauagaaagcaaaguagacgcagucuuucaacaagaacacuucuuccacguauuuagcggaccaagauacuacgccuuugacuuaauagcacaaagaguaacacgaguugcaagaggaaacaaauggcuaaacuguagauacggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2015 - RNA, 2341 nt, Artificial Sequence
  mRNA product Design1 comprising derived and/or modified sequence from Homo sapiens__NP_004985.2__HsMMP9 (opt6)
gggagaaagcuuaccaugagucuauggcaaccauuaguauuaguuuuacuuguacucgguuguugcuucgcugcaccuagacaacgucaaucaacccucgugcucuuuccaggagaucuucgaacuaauuuaacagauagacaauuagcagaagaauauuuauauagguauggcuauacacgaguagcugaaaugcgaggagaaaguaaaagccuaggaccugccuuauuacuacuacaaaaacaacuaucauuaccagaaacuggagaauuagacuccgcuacucuaaaagcaaugcgcaccccacguugcggaguaccagauuuaggacgauuucaaacauuugaaggagauuuaaaauggcaucaucacaauauaacauacuggauucaaaacuacagugaagauuuacccagggcaguaauagacgaugcauuugcaagggcauuugcauuauggucagcuguuacuccacucacuuucacuagaguuuacaguagagaugcagauaucguaauacaauuuggaguagcagaacacggcgacggauacccauucgacgguaaagauggacuacuagcucaugccuucccaccagguccagguauacaaggagacgcacauuuugaugaugaugaauuauggaguuuaggcaagggaguugucguaccaacucgauuuggaaaugcugauggugcagcuugccauuuucccuuuauuuucgaagggagaucguauucagcuugcacaacagacggaagauccgauggucuaccauggugcucuacaacagcuaacuaugacacagacgauagauucggauucugcccauccgaacgauuauauacucaagauggaaaugcagacgguaaaccaugucaauucccauuuauauuccaaggacaaucauauagcgcuugcacaacagauggaagaagcgauggauacagauggugcgcaacaacagcuaacuaugaucgagacaaacuauuuggauuuuguccaacacgugcugauuccacaguaaugggaggaaauucugcuggugaacuauguguauucccauuuacauuccuugguaaagaauacucuacauguacaagcgaaggcagaggcgacggaagacuuuggugugcuacaacaucuaauuuugauagugauaaaaaauggggauucuguccagaccaaggauacucauuauuucuaguagcugcacaugaauuuggacaugccuuaggauuagaucauaguucuguaccagaagcucugauguauccuauguaccgauucacugaaggaccaccacuccauaaagacgauguuaauggaauaagacauuuguacggacccaggccagaaccagaaccaagaccaccaacaacaacaacuccucaaccgacagcaccaccaacaguuuguccaacaggaccccccacaguacauccaucagaaagaccuacagcaggaccaacagguccgccaucagccggaccaacuggaccuccaacagcaggccccuccacagcaacaacaguaccauuaucaccaguagaugaugcaugcaauguaaauauauuugaugcuauagcagagauaggcaaucaacuauaucucuuuaaagacggaaaauauuggagauucucagagggcagaggaucaagaccccaaggaccauuuuuaauugcagauaaauggccagcuuuaccaaggaaauuagauucagucuuugaagagcgccucucaaaaaaauuauuuuuuuucucaggaagacaagucuggguuuauaccggagcauccguauuaggaccaagaagauuagacaaauuagguuuaggugcugaugucgcacaaguuacaggagcuuuacgaagcggucgaggaaaaaugcuacuguucucugguagaagacuauggagauuugacguaaaagcgcaaaugguagacccucgaagcgcuagugaaguagauagaauguucccugguguaccucuugacacccaugacguuuuucaauacagagaaaaagcauauuuuugccaagaucgcuucuacuggcgaguuaguucacguagcgaacuaaaucaaguagaccaaguuggauaugucacauacgauauacuacaauguccagaagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2016 - RNA, 1633 nt, Artificial Sequence
  mRNA product Design1 comprising derived and/or modified sequence from Homo sapiens__NP_002418.1__HsMMP13 (opt6)
gggagaaagcuuaccaugcacccagguguacuugcagccuucuuauuuuuaucauggacucacuguagagcacucccacuaccaucaggaggagacgaagaugauuuaucagaagaagaccuccaauucgcagaaagauaucuaagaucuuacuaucacccaacaaacuuagcagguauacuaaaagaaaacgcagcaucaucaaugacagaaagacuaagagaaaugcaaucauucuuuggauuagaaguaacaggaaaacuagaugauaauacacuagacguaaugaaaaaacccagaugcggaguaccugauguaggagaauacaacguauucccaagaacacuaaaauggucaaaaaugaaucuaacauacagaaucguaaacuauaccccagacaugacacauagugaaguagaaaaagcauucaaaaaagcauucaaaguauggucagacguaacaccauuaaacuucaccagacuucacgauggaauagcagacauuaugauuucauuuggcauaaaagaacauggcgacuucuacccauucgacgguccaagcgguuuacuagcccaugcauucccaccuggaccuaacuauggcggagacgcacacuuugacgaugacgaaacauggaccaguucaaguaaaggauacaaucuauuuuugguagcugcccacgaauucggccacucacuaggacuagaccauucaaaagacccuggugcauuaauguucccaauauauaccuauacaggaaaaucacauuucauguuaccagaugaugauguacaaggcauccaaucauuauacggcccaggagacgaagauccaaacccaaaacacccaaaaacaccagacaaaugcgacccuucacuaucucuagacgcaauaacuucuuuaagaggagaaacaaugauauucaaagaucgauucuucuggagacuucacccacaacaaguagaugcagaacuauucuuaacaaaaucuuucuggccagaacuaccaaaccguaucgacgcagcauaugaacacccaucacaugacuuaauauuuauauuuagaggacgaaaauuuugggcauuaaacggauaugauauauuagaaggauacccuaaaaaaauaucagaacucggauuaccaaaagaaguuaaaaaaauaucggcagcuguacacuucgaagacacaggcaaaacccuauuauuuucaggaaaccaaguauggcgauaugacgacacaaaucauauaauggauaaagauuacccaagauuaauagaagaagauuucccaggaauaggugacaaaguagacgcaguauacgaaaaaaaugguuacauauauuuuuuuaacggacccauacaauucgaauacucaauauggucaaacagaauaguacgagucaugccagcaaauucgauacuuuggugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2017 - RNA, 1285 nt, Artificial Sequence
  mRNA product Design1 comprising derived and/or modified sequence from Homo sapiens__NP_001286.1__HsCCR1 (opt6)
gggagaaagcuuaccauggaaacaccaaacacaacagaagacuacgauacaacaacugaauucgacuacggagacgcaacaccaugucaaaaagucaacgaacgagcauucggagcacaauuacuaccuccacuauacucauuaguauuuguaauaggcuuagucggaaacauacuaguaguacuaguuuuaguucaauacaaaagacuaaaaaacaugacaucuauauacuuacuaaacuuagcaauaucagaucuucuauucuuauucacccuuccauucuggauagacuacaaauuaaaagacgacuggguauucggcgacgcaaugugcaaaauauuauccggauucuauuacacaggacuauacucagaaauauuuuucauaauacuccuaacaauagacagauaccuagcaauaguucacgcaguauucgcuuuaagagcaagaaccguaacauucggaguuauaacaucaauuauaaucugggcacuagccauacuagccucaaugccaggacuauacuucucuaaaacucaaugggaauucacacaccauacauguucacuccacuuuccccaugaauccuuaagagaauggaaacucuuccaagcacuaaaauuaaacuuauucggacuaguauuaccacuacuaguaaugauaauaugcuacacaggaauuauaaaaauccuacuuagaagaccaaacgaaaaaaaaucaaaagcagucagacuaauauucgucauaaugauaaucuuuuuuuuauucuggacaccuuacaaucucacuaucuuaauaucaguuuuccaagacuuccuauucacacacgaaugugaacaaucaagacacuuagacuuagcaguacaagucacugaaguaauagcauacacacacugcugcguaaacccaguaaucuacgcauucguaggagaaagauuuagaaaauaccuaagacaacuauuccacagaagaguugcuguacaccuaguaaaaugguuacccuucuuaucagucgaucguuuagaaagagucucaucaacaucacccucaacaggugaacacgaacuaucagccggauuuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2018 - RNA, 853 nt, Artificial Sequence
  mRNA product Design1 comprising derived and/or modified sequence from Homo sapiens__NP_002598.4__HsPDGFA (opt6)
gggagaaagcuuaccaugagaacauuagcaugcuuauuacuauuaggauguggauacuuagcacacguauuagcggaagaagcagaaauaccaagagaaguaauagaaagacuagcacgaucacaaauacacucaauaagggaccuacaaagauuacuagaaauagacucaguaggaagcgaagacucacuagacacaucauuaagagcacacggaguacacgcaacaaaacacguaccagaaaaaagaccacuaccaauaagaagaaaaagaagcauagaagaagcaguaccagcaguaugcaaaacaagaacaguaauauaugaaauaccacgaucacaaguagacccaacaucagcaaacuucuuaauauggccaccaugcguagaagugaaaagaugcacaggcugcugcaacacaucgucaguaaaaugccaaccaagcagaguacaccacagaucaguaaaaguagcuaaaguagaauacguaagaaaaaaaccaaaacuaaaagaaguacaaguaagacuagaagaacaccuagaaugcgcaugcgcaacaacaagccuaaacccagacuaccgagaagaagauacaggaagaccgcgagaaaguggaaaaaaacgaaaaagaaaaagacuaaaaccaaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2019 - RNA, 943 nt, Artificial Sequence
  mRNA product Design1 comprising derived and/or modified sequence from Homo sapiens__NP_002599.1__HsPDGFB (opt6)
gggagaaagcuuaccaugaauagaugcugggcacuauucuuaagcuuauguugcuacuuaagacuaguaucagcagaaggagauccaauaccagaagaauuauacgaaaugcuaagcgaccacucaaucagaagcuuugacgauuuacaaagacuacuacauggagauccaggagaagaagacggagcagaacuagacuuaaauaugacaagaucacacucaggaggagaauuagaaucacuagcaagaggaagaagaagucuaggaucacuaacaauagcggaaccagcaaugauagcagaauguaaaacacgaacagaaguauucgaaauaucaagaagauuaauagacagaacaaaugcaaacuuccuaguauggccaccaugcguagaaguacaaagaugcucaggauguugcaauaacagaaacguacaauguaggccaacacaaguacaauuaagaccagugcaaguaagaaaaauagaaauaguacguaaaaaaccaauauuuaaaaaagcaacaguaacacuagaagaccaucuagcauguaaaugcgaaacaguagcagcggccagaccaguaacaagaagcccaggaggaagucaagaacaaagagcaaaaacaccacaaacuagaguuacaauaagaacaguaagaguaagaagaccaccaaaaggaaaacauagaaaauucaaacacacacaugauaaaacagcacuaaaagaaaccuuaggagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2020 - RNA, 1255 nt, Artificial Sequence
  mRNA product Design1 comprising derived and/or modified sequence from Homo sapiens__NP_057289.1__HsPDGFC (opt6)
gggagaaagcuuaccaugagcuuauucggacuacuacuccuuacuucagcacuagcaggacaaagacaaggaacacaagcagaaucaaaccuaagcucaaaauuccaauuuucaucaaacaaagaacaaaauggaguacaagauccacaacacgaaaggauuauuacagucucaacaaacggaaguauacacaguccaagauucccacauacauacccaagaaacacaguuuuagucuggcgacuaguagcaguagaagaaaauguauggauacaacuaacauucgaugaaagauucggauuagaagacccagaagacgacauaugcaaauaugacuuuguagaagucgaagaaccaagugacgguacaauacuaggaagauggugcggaucaggaacaguaccaggcaaacaaauaaguaaaggaaaccaaauuagaauaagauucguaucagaugaauacuuuccaucagaaccaggauucugcauacauuacaacauaguaaugccacaauucaccgaagcaguuucaccaucaguuuuaccaccaagugcccucccauuagaccuacuaaacaacgcaauaacugcauucaguacucuagaagaccuaauaagauaccuagaaccagaaagauggcaauuagaucucgaagaccuauauagaccaacauggcaacuauuaggcaaagcauuuguauucggaagaaaaucaagaguaguagacuuaaaccuauuaacagaagaaguaagacuauacagcugcacaccaagaaacuuuucaguuucaauaagagaagaauuaaaaagaacagauacaaucuucuggccaggaugucuauuagucaaaagaugcggcggaaacugcgcaugcugccuacauaacugcaacgaaugccaaugcguaccaaguaaaguaacaaaaaaauaccacgaaguauuacaacuaagaccaaaaacuggaguaagaggucuacacaaaucacuaacugacguagcauuagaacaucacgaagaaugugacugcgucugcagaggaucaacaggaggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2021 - RNA, 1312 nt, Artificial Sequence
  mRNA product Design1 comprising derived and/or modified sequence from Homo sapiens__NP_149126.1__HsPDGFD (opt6)
gggagaaagcuuaccaugcacagacuaauauucguauacacacucauaugcgcaaauuucugcucauguagagacacaucagcaacaccacaaucagcaucaauaaaagcacuaagaaacgccaaccuaagacgagacgauuuauacagaagagacgaaacaauacaaguaaaagguaacggauauguacaaucaccaagauucccaaacaguuacccaagaaaucuacuacuaacauggagacuacacucacaagaaaacacaagaauacaacuaguauuugacaaccaauuuggacuagaagaagcugaaaacgacauauguagauaugacuucguagaaguagaagacauaagugaaacaucaacaauaauuagaggaagauggugcggccacaaagaaguaccaccccgaauaaaaucaaggacaaaccaaaucaaaauaacuuucaaaucagacgacuacuuuguagcaaaaccaggcuuuaaaauauacuauagcuuacuagaagacuuccaaccagcagccgcaagugaaacaaacugggaaagcguaacaucaagcaucucaggaguaagcuauaacucaccaucaguaacagacccaacacuaauagcagacgcauuagacaaaaaaauagcagaauucgacacaguagaagauuuauuaaaauacuucaacccagaaucauggcaagaagaccuagaaaauauguaccucgacacaccaagauauagaggaagaagcuaucacgauagaaaaucaaaaguagaccuagacagacuaaaugacgacgcuaaacgauauaguuguacaccaagaaacuacagugucaacauacgagaagaacuaaaacuagcaaacguaguauucuuuccacgaugucuacuaguacaaagauguggaggaaacugcggaugcggaacaguaaauuggagaucaugcaccugcaacagcggaaaaacaguuaaaaaauaccacgaaguacuacaauucgaaccuggccacauaaaacgaaggggaagagcaaaaaccauggcacuaguagauauccaacuagaucaucacgagagaugugacuguauauguaguucaagaccaccaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2022 - RNA, 895 nt, Artificial Sequence
  mRNA product Design1 comprising derived and/or modified sequence from Homo sapiens__NP_003946.3__HsSOCS3 (opt6)
gggagaaagcuuaccaugguaacacacucaaaauucccagcagcaggaaugucaagaccauuagacacaucauuaagacuaaaaacauucucaucaaaaucagaauaucaacuaguaguaaacgcaguaagaaaacuacaagaaucaggauucuacuggucagcaguaacaggaggagaagccaaccuacuccuaucagcagaaccagcaggaaccuuccuaauaagagacucaucagaccaacgacacuucuucacacuaucaguaaaaacacaauccggaacaaaaaaccucagaauacaaugcgaaggaggaucauucucacuacaaucagacccacgcuccacacaaccaguaccaagauucgacugcguacuaaaacuaguacaccacuacaugccaccaccaggagccccaucauuuccaucaccaccaacagaaccaucaucagaaguacccgaacaaccaucagcacaaccacuccccggaucaccaccaagaagagcauacuacauauacucaggaggagaaaaaauaccauuaguacuauccagaccauuaucuucaaacgucgcaacacuacaacaucuaugcagaaaaacaguaaacggacacuuagacucauacgaaaaaguaacccaacuaccaggccccauacgagaauuccuagaccaauacgacgcaccacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2023 - RNA, 700 nt, Artificial Sequence
  mRNA product Design1 comprising derived and/or modified sequence from Homo sapiens__NP_003227.1__HsTGFA (opt6)
gggagaaagcuuaccaugguaccaucagcaggacaauuagcauuauucgcauuaggaauaguauuagcagcaugucaagcauuagaaaauucaacaucaccacuaucagcagauccaccaguagcagcagcuguaguaucacauuuuaaugacuguccagauucacauacucaauucuguuuucauggaacauguagauucuuaguacaagaagacaaaccagcauguguaugucauucaggauauguaggagcaagaugugaacaugcagauuuauuagcaguagucgcagcaucacaaaaaaaacaagcaauaacagcauuaguaguaguaucaauaguagcauuagcaguacuaauuauaacauguguacuaauacauuguugucaaguaagaaaacauugugaauggugcagagcauuaauauguagacaugaaaaaccaucagcauuauuaaaaggaagaacagcauguugucauucagaaacaguaguauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2024 - RNA, 1390 nt, Artificial Sequence
  mRNA product Design1 comprising derived and/or modified sequence from Homo sapiens__NP_000651.3__HsTGFB1 (opt6)
gggagaaagcuuaccaugccaccuagcggacucagauuauuacccuuacuacucccacuccuauggcuacuaguacuaacuccaggaagaccagcagcaggacuaaguacauguaaaacuauagacauggaauuaguaaaaagaaaaagaauagaagccauacguggacaaauccuaucuaaauugagacuagccucaccuccaucacaaggagaaguaccaccaggaccccuacccgaagcaguacuagcacuauacaacucaacaagagauagaguagcaggagaaucagcagaaccagaaccagaaccagaagcagauuauuacgcaaaagaaguaacacgcguauuaaugguagaaacacauaacgaaauauaugauaaauucaaacaaucuacacacucuauauacauguucuuuaauacaucagaacucagagaagccguacccgaaccaguauuauuaucaagagcagaacuaagacuucuaagacuaaaacucaaaguugaacaacacguagaacuauaccaaaaauacucaaacaauucuuggagauauuuaucuaacagacuacuagcccccucagacuccccugaauggcuaucauucgacguaacaggaguagucagacaaugguuaucuagaggaggagaaauagaaggauuccgacuuucagcacacuguucuugugauagucgcgacaacacauuacaaguagacauaaacgguuucacaacuggacguagaggagaccuugcaacaauacaugguaugaacagaccauucuuacuacuaauggcaacaccacucgaacgagcacaacaucuacaauccucacgccacagacgagcccuagacacaaacuacugcuucucaucaaccgaaaaaaauuguugcguaagacaauuauacauagauuucagaaaagaccuaggauggaaauggauacaugaaccuaaaggauaccacgccaauuuuuguuuaggcccauguccauacauauggucacuagacacacaauacucuaaaguauuagcucuauacaaccaacacaacccaggcgcaucagcagcaccaugcuguguuccacaagcuuuagaaccauuaccaaucguauauuacguaggaagaaaacccaaaguagaacaauuaucaaacaugauagucagaucauguaaaugcucuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2025 - RNA, 1462 nt, Artificial Sequence
  mRNA product Design1 comprising derived and/or modified sequence from Homo sapiens__NP_003229.1__HsTGFB2 (opt6)
gggagaaagcuuaccaugcauuacugcguacuaucagcauuccuaauacuacaccuaguaacaguagcauuaucccuaucaacuugcuccacccuagacauggaccaauuuaugagaaaacgcauagaagcaauaagaggacaaauuuuaucaaaacucaaacuaacaagcccaccagaagacuacccagaaccagaagaaguaccaccggaagucauuucaauauacaauucaacaagagaccuacuacaagaaaaagcaucaagaagagcugcagcaugugaaagagaacgcagcgacgaagaauacuacgcaaaagaaguauacaaaaucgacaugccuccauucuucccaagcgaaaacgcaauaccaccaacauucuaucgaccauauuuuagaauaguaagauucgacgucucagccauggaaaaaaaugcuagcaauuuaguaaaagcagaauuuagaguuuucagacuacaaaacccaaaagcacgaguccccgaacaacgaauagaauuauaccaaauacuaaaaucaaaagaccuaacauccccaacacaaagauacauagacucaaaaguaguuaaaacccgagcagaaggcgaauggcuaucuuucgauguaacagacgcaguacacgaaugguuacaccacaaagauagaaaccuagguuucaaaauaucucuccacugcccaugcugcacauucguaccauccaacaacuacauaauaccaaacaaaucugaagaauuagaagcaagauucgcaggaauagacgguacaucaaccuacacaucaggagaucaaaaaacaauaaaauccacaagaaaaaaaaauucaggaaaaacaccacaccuacuacuaaugcuacuaccaagcuacagauuagaaucacaacaaacaaacagacgaaaaaaaagagcacuagaugcagcauacugcuucagaaacguacaagacaacugcugucuccgcccacuauacauagauuucaaacgagauuuaggauggaaauggauacacgaacccaaaggauauaacgccaacuucugcgcaggagcaugcccauauuuauggucauccgacacccaacacuccagaguccuaucucucuacaacaccauaaacccagaagcaucagcaucacccugcuguguaucccaagacuuagaaccacuuacaauauuauacuacauaggaaaaacaccaaaaauagaacaacuaucaaacaugauagucaaauccuguaaaugcucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2026 - RNA, 1456 nt, Artificial Sequence
  mRNA product Design1 comprising derived and/or modified sequence from Homo sapiens__NP_003230.1__HsTGFB3 (opt6)
gggagaaagcuuaccaugaaaaugcacuuacaaagagcauuaguuguacuagcacuucucaacuuugcaacaguaucacuaucauuaucaaccugcacaacacuagacuuuggacacauaaaaaaaaaacgaguagaagccauaagaggacaaauacuaucaaaacuaagacuaacaucaccaccagaaccaaccguaaugacacacgucccauaccaaguauuagcccuauacaacaguacaagagaacuacucgaagaaaugcacggagaacgagaagaaggaugcacucaagaaaauacagaaucagaauacuacgcaaaagaaauacacaaauuugauaugauacaaggauuagcagaacacaaugaacuagccguaugcccaaaaggaauaacaucaaaaguauuuagauuuaacguaucaucagucgaaaaaaaccgcacaaaucuuuucagagcagaauuucgagugcuacgaguaccaaauccaucaucaaaaagaaacgaacaacgcauagaacuauuucaaauccuacgaccagacgaacacauagcaaaacaaagauacauaggaggcaaaaaccuccccacaagagguaccgcagaaugguuaucauucgaugucaccgacacaguacgagaaugguuacuaagaagagaaucaaaccuaggcuuagaaauaucaauccacugcccaugccacaccuuucaaccaaauggagacauauuagaaaacauacacgaaguuauggaaauaaaauucaaaggaguagauaaugaagaugaccacggacgaggugaucuuggaagacuaaaaaaacaaaaagaccaccacaacccacaucuaauauuaaugaugauaccuccacacagauuagacaaccccggacagggaggacaaagaaaaaaaagagcacuagauacaaacuauugcuucagaaaccuagaagaaaacugcugcgucagaccuuuauacauagauuucagacaagaucucggauggaaauggguccacgaaccaaaaggauacuaugcaaacuuuugcuccggccccugcccauaucuacgaucagcagacacaacacacucaacaguacucggacuuuauaacacucuaaaccccgaagcauccgccuccccaugcuguguuccacaagacuuagaaccacuaacaauauuauacuauguaggacgaacaccaaaaguugaacaauuaagcaacaugguaguaaaaucaugcaaauguagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2027 - RNA, 1603 nt, Artificial Sequence
  mRNA product Design1 comprising derived and/or modified sequence from Homo sapiens__NP_001057.1__HsTNFRSF1B (opt6)
gggagaaagcuuaccauggcacccguagcugucugggcagcauuagcaguuggauuagaauuaugggcagcugcccacgcacuaccagcccaaguagcauucacaccuuacgccccagaaccuggaucuaccugcagacuaagagaauauuacgaucaaacagcucaaauguguuguucaaaauguucaccaggccaacaugcaaaaguauucuguacaaaaacaucagauacaguaugugauucaugcgaagauucaacuuauacacaauuauggaauuggguucccgaaugccuauccuguggaucaagauguucaucagaucaaguagaaacccaagcauguacaagagaacaaaauagaauauguacaugcagaccagguugguauugugcacuaagcaaacaagaaggaugcagauuaugugccccauuaagaaaaugucgaccaggcuucggaguagcacgaccuggaaccgaaaccucugauguaguaugcaaaccaugugcaccaggaacauuuucaaacacaacaucuucaacagacauaugcagaccacaccaaauauguaacguuguagcaauaccuggcaaugccucaauggaugcaguuuguacaucaacauccccaacaagaucuauggcaccaggagccguacauuuaccacaaccaguuaguacucgaucacaacauacccaacccacacccgaaccauccacugcuccguccaccucauuccuacuaccaaugggacccucuccaccagcugaagguucuacaggagacuucgcacuaccaguuggauuaauaguaggaguaaccgcacuaggacuucuaaucauaggaguaguuaauuguguaaucaugacucaaguuaaaaaaaaaccuuuauguuuacaacgagaagcaaaaguaccacauuuaccggcagauaaagcaagaggaacucaaggaccagaacaacaacaucuauuaauuacagcuccaucaucaucaucaucaucacuagaaucaucagcuucagcacuugaucgaagagcaccuacacguaaccaaccacaagcaccagguguggaagcuucaggugcaggagaagcaagagcaaguacaggaucaucagacaguucaccaggaggucauggaacacaaguaaauguaacuuguauaguaaaugucuguagcucaucagaucauucaucccaaugcucaucucaagccuccucaacaaugggagacacagauuccucuccaucagaaucaccaaaagacgaacaaguaccauuuucaaaagaagaaugugccuucagaucacaacuagaaacaccagaaacuuuauuaggaucaacugaagaaaaaccgcuacccuuaggaguaccagacgccggaaugaaacccucuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2028 - RNA, 730 nt, Artificial Sequence
  mRNA product Design1 comprising derived and/or modified sequence from Homo sapiens__NP_002623.2__HsPGF (opt6)
gggagaaagcuuaccaugccaguaaugagauuauuuccauguuuucuacaauuauuagcaggauuagcacuaccagcaguaccaccacaacaaugggcauuaucagcaggaaauggaaguucagaaguagaaguaguaccauuucaagaaguguggggaagaucauauuguagagcauuagaaagauuaguagauguaguaagugaauauccaagugaaguagaacauauguuuucaccaaguuguguaaguuuauuaagauguacagguuguuguggagaugaaaaccuacauuguguaccaguagaaacagcaaauguaacaaugcaauuauuaaaaauaagaaguggagauagaccaucauauguugaauuaacauuuagucaacauguaagaugugaaugcagaccacuaagagaaaaaaugaaaccagaaagaagacgaccaaaaggaagaggaaaaagaagaagagaaaaacaaagaccaacagauugucauuuauguggagaugcaguaccaagaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2029 - RNA, 1456 nt, Artificial Sequence
  mRNA product Design1 comprising derived and/or modified sequence from Homo sapiens__NP_001020537.2__HsVEGFA (opt6)
gggagaaagcuuaccaugacagauagacaaacugauacagcaccgaguccgaguuaucauuuauuaccaggaagaaggagaacaguagaugcagcagcaucaagaggacaaggaccugaaccagcaccaggaggagggguagaaggaguuggagcuagaggaguagcauuaaaauuauuuguccaguuauuaggaugcaguagauuuggaggagccguaguaagggcaggagaagcagaaccaucaggggcagcacgaagugcaucaaguggaagagaagaaccacaaccagaagaaggagaagaagaagaggagaaagaagaagaaagaggaccacaauggcggcugggugcgagaaaaccaggaaguuggacaggagaagcagcaguaugcgcagauucagcucccgcagcgagagcaccucaagcauuagcaagagcaagcggaagaggaggaagaguagcaagaagaggagcagaagaaucagggccaccucauagcccaaguagaagggguagugcaaguagagcaggaccaggaagagcaagcgaaacaaugaauuuuuuauuaagcuggguacauuggucauuagcgcuauuacuauauuuacaucaugcaaaauggagccaagcagcaccaauggcagaaggaggaggucaaaaccaucacgaaguaguaaaauuuauggauguuuaucaaaggucauacugccacccaauagaaacacuaguagauauauuucaagaauacccagacgaaauagaauauauauuuaaaccaagcuguguaccacuaaugagaugugguggauguugcaacgaugaaggacuagaauguguaccaacagaagaaucuaauauaacaaugcagauaaugagaauaaaaccacaccaaggacaacauauaggagaaaugaguuuuuuacaacauaauaaaugugaauguagaccaaaaaaggauagagcaaggcaagaaaaaaaaucaguaagaggcaaaggaaaaggacaaaaaaggaaaagaaaaaagagcagauauaaaaguuggagcguguauguaggagcaagaugcugucuaaugccauggucacuaccaggaccucauccauguggaccauguagugaacgaagaaaacaucuauuuguacaggauccacaaacauguaaauguagcuguaaaaauacagauaguagauguaaagcaaggcaauuagaauuaaaugaaaggacuuguagaugcgauaaaccuagaagguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2030 - RNA, 916 nt, Artificial Sequence
  mRNA product Design1 comprising derived and/or modified sequence from Homo sapiens__NP_001165094.1__HsVEGFA (opt6)
gggagaaagcuuaccaugaacuuucuauuaagcuggguacauuggucacuugcauuauuacuauauuuacaucacgcaaaauggagccaagcagcaccaauggcagaaggaggaggacaaaaccaucacgaaguaguaaaauuuauggauguauaucaaaggaguuacugccauccaauagaaacacuaguggacauauuccaagaauauccagaugaaauagaauauauauuuaaaccaagcuguguaccacuaaugagauguggaggaugcuguaacgaugaaggacuagaaugcguaccaacagaagaaagcaauauaacaaugcaaauaaugagaauaaaaccacaccaaggacaacacauaggagaaaugucauucuuacaacauaacaaaugcgaaugcagaccaaaaaaagaucgagcaagacaagaaaaaaaaucaguaagaggaaaaggaaaaggacaaaaaagaaaaagaaaaaaaagcagauacaaaaguuggagcguauacguaggagcaagauguugcuuaaugccauggucacuaccaggaccacacccaugcggacccuguagcgaaagaagaaaacaucuauucguacaagacccacaaacaugcaaaugcucaugcaaaaacacagacucaagauguaaagcaagacaacuagaacuaaaugaaagaacauguagaugugacaaaccaagaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2031 - RNA, 841 nt, Artificial Sequence
  mRNA product Design1 comprising derived and/or modified sequence from Homo sapiens__NP_003368.1__HsVEGFB (opt6)
gggagaaagcuuaccaugucaccauuacuaagaagacuauuacuagcagcauuauuacaacuagcaccagcacaagcaccaguaucacaaccugaugcaccaggacaucaaagaaaaguaguaucauggauagauguauauacaagagcaacaugccaaccaagagaaguaguaguaccacuaacaguagaauuaaugggaacaguagcaaaacaauuaguacccucaugcguaacaguacaaagaugcggagguuguuguccagacgauggacuagaauguguaccuacaggucaacaucaaguaagaaugcaaauauuaaugauaagauacccaaguucacaauuaggagaaaugucauuagaagaacauucacaaugcgaauguagaccaaaaaaaaaagacucagcaguaaaaccagacagagcagcaacaccacaccauagaccucaaccaagaucuguaccaggaugggacucagcaccaggagcuccaucaccagcagacauaacucauccaacaccagcaccaggacccucagcacaugcagcuccaucaacuacaucagcauuaacaccaggaccagcagcagcugcugcagacgcagcagccucaucaguagcaaaaggaggagcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2032 - RNA, 1477 nt, Artificial Sequence
  mRNA product Design1 comprising derived and/or modified sequence from Homo sapiens__NP_005420.1__HsVEGFC (opt6)
gggagaaagcuuaccaugcaccuauuaggauuuuucucaguagcauguucauuacuugcagcagcauuacuccccggaccaagagaagcaccagcugcagcagcagcauucgaaucaggacuagaccuaagcgaugcagaaccagacgcaggagaagcaacagcauaugcaaguaaagaccuagaagaacaauuaagaaguguaucaucaguagacgaacuaaugacaguacucuaccccgaauacuggaaaauguacaaaugccaauuaagaaaaggaggauggcaacacaacagagaacaagcuaaccuaaacucaagaacugaagaaacaauaaaauuugcagcagcccacuacaauacagaaauauuaaaaucaaucgauaacgaauggcgaaaaacacaauguaugccaagagaaguuuguauagacguaggaaaagaauuuggaguugcaacaaauacauuuuuuaaaccaccaugcgucucaguauacagaugcggaggaugcugcaauagcgaaggauuacaauguaugaauacaucaacaagcuacuuaagcaaaacacuauuugaaauaacaguacccuuaucacaaggacccaaaccaguuacaauaaguuuugcaaaucauacuucaugcagauguaugaguaaauuagauguuuaucgccaaguacauucaauaauacgacgcagucuaccagcaacauuaccacaaugccaagcugcaaauaaaacaugcccaacuaauuauauguggaauaaucacaucugcagaugucuugcacaagaagacuucauguuuuccucagaugcaggagacgauucaacagacggcuuccacgacauauguggaccaaauaaagaacuagaugaagaaacaugucaaugcgucugcagagcaggauuaagaccagcaucauguggaccacacaaagaauuagacaggaauuccugccaauguguauguaaaaauaaacuauuuccaucacaaugcggagccaaucgagaauucgacgaaaauacaugccaaugugucuguaaaagaaccugucccagaaaucaaccauuaaacccuggaaaaugugccugugaaugcacagagucaccacaaaaauguuuacuaaaaggaaaaaaauuccaucaucaaacaugcuccuguuacagaagacccugcacaaacagacaaaaagcaugcgaaccaggauucagcuacagugaagaaguaugcagauguguaccaucauauuggaaacgaccacaaaugucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2033 - RNA, 1282 nt, Artificial Sequence
  mRNA product Design1 comprising derived and/or modified sequence from Homo sapiens__NP_004460.1__HsVEGFD (opt6)
gggagaaagcuuaccauguacagagaauggguaguaguaaacguauucaugaugcuauacguacaauuaguacaagguuccucaaacgaacacggcccaguaaaaagaucaucccaaagcacacuagaaagaucugaacaacaaauaagagcagcaucuucacuagaagaacuuuuaagaauaacacacucagaagacuggaaacuauggagaugcagacuaagacuaaaaucauucacaucuauggacagcagguccgcaagucacagaucaaccagauucgccgcaacauuuuaugacauagaaacacucaaaguaauagacgaagaauggcaaagaacacaaugcaguccaagagaaacauguguagaaguagccucagaacuaggaaaaagcacuaacacauucuucaaaccaccaugcguaaauguauucagaugcggcggauguugcaacgaagaaucucucauauguaugaacacaaguacaucauacaucucaaaacaacuauucgaaauaucagucccauuaacaucaguaccagaacuaguaccaguaaaaguagcaaaccacacaggauguaaaugccuaccaacagcaccaagacacccauacaguaucauaagaagaucaauccaaauaccagaagaagaccgaugcucccacucaaaaaaauuaugcccaauagacaugcuaugggauucaaacaaaugcaaaugcguacuacaagaagaaaacccauuagcaggaacagaagaccacucucacuuacaagaaccagcauuaugcggaccacauaugauguucgacgaagauagaugugaauguguaugcaaaacuccaugcccaaaagaccuaauacaacacccaaaaaacugcucauguuucgaaugcaaagaaucucuagaaacaugcugccaaaaacacaaauuauuucacccagacacaugcucaugcgaagacagaugcccuuuccacaccagaccaugugccagcggaaaaacagcaugugcaaaacacuguagauuuccaaaagaaaaacgagcagcccaaggaccacacucaagaaaaaauccauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2034 - RNA, 847 nt, Artificial Sequence
  mRNA product Design1 comprising derived and/or modified sequence from Homo sapiens__NP_061986.1__HsFGF21 (opt7)
gggagaaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagcugcuguuggaagauggguauaacguguaccagagugaggcccacggccucccccugcaucugccagguaauaaaagcccgcacagggaccccgcaccacgggggcccgcccgcuuucucccacugcccggcuugccgcccgcccugccagaacccccaggcauccucgcaccccagccaccggaugugggguccagcgacccccugaguauggucgguccaucccagggcaggagccccuccuaugccaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2035 - RNA, 1627 nt, Artificial Sequence
  mRNA product Design1 comprising derived and/or modified sequence from Homo sapiens__NP_002412.1__HsMMP1 (opt7)
gggagaaagcuuaccaugcacagcuuucccccacugcuccuguugcuguucuggggcguggucucccauaguuucccggccacccucgagacucaggaacaagacguggaucugguacagaaguacuuggagaaauauuacaaccugaagaaugacgggaggcaaguggaaaaacggcgcaacagcggucccgucguggagaagcucaaacagaugcaggaauuuuucggccugaaggugaccgggaagccagaugcagagacgcugaaagucaugaagcagcccaggugcggcgugccagacguagcccaguuugugcucacugaggguaauccccggugggaacagacccaccugaccuaucgcaucgagaacuacacuccagauuugccgagggcggacgucgaucaugccauugaaaaagcauuccaacugugguccaaugugacgccccucaccuuuacuaaggugagugaggggcaggccgacaucaugauuagcuucguccggggcgaucaccgcgacaacuccccauuugauggccccggggguaaucuggcacaugccuuccagccaggccccgggaucggcggugacgcgcacuuugaugaggacgaaagguggaccaacaauuuccgggaguauaaccugcaccgcguggccgcacaugaauuggggcacagccucggccugucccauaguacugacauuggcgcccugauguacccgagcuauaccuucuccggggauguacagcucgcccaagacgauaucgacgguauccaggcaauuuacggcaggagccagaaucccgugcaaccaaucgggccccagaccccaaaagccugugauaguaagcugacguuugacgcgauuacuaccauccggggcgaggucauguucuuuaaagaucgcuucuacaugaggacuaaccccuuuuauccagaaguggaguugaauuucauuuccguguuuuggccgcagcugcccaacggucucgaggccgcauacgaguucgccgaccgggaugaaguccgcuuuuucaagggcaauaaguauugggcagugcaggggcaaaacguacugcacggcuacccaaaagacaucuauagcuccuuuggguuccccaggaccgugaagcacauugaugccgcccugagugaagagaacaccgguaaaacuuacuuuuucgucgcgaauaaguauuggcgguacgacgaauacaaacgcagcauggacccaggcuaucccaagaugaucgcacaugauuucccggggaucggccacaagguggacgccgucuuuaugaaagaugguuucuuuuacuucuuucauggcacgaggcaguauaaguucgacccaaaaaccaagcggauuuugacucuccagaaagccaacuccugguuuaauugcaggaagaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2036 - RNA, 1387 nt, Artificial Sequence
  mRNA product Design1 comprising derived and/or modified sequence from Homo sapiens__NP_002412.1__HsMMP1(1-19,100-469) (opt7)
gggagaaagcuuaccaugcacagcuuucccccacugcuccuguugcuguucuggggcguggucucccauaguuucgugcucaccgaggggaacccgaggugggaacagacucaccugaccuaccggaucgagaauuauacgcccgacuugccacgcgccgauguagaccaugcaauugaaaaggccuuucaacuguggagcaacgugacuccccucaccuucaccaaagucuccgagggucaggcggauaucaugauuaguuuugugaggggcgaccaccgggauaauagcccauucgacgggcccggcgguaaccuggcccaugcauuucagccagggccgggcaucggcggggaugcccacuucgacgaagaugagcgcuggacuaauaacuuuagggaguacaaucugcaccggguggcagcccaugaacucggucacucccugggcuugagccauuccaccgacauuggggcgcugauguaucccaguuacacguucagcggcgauguccagcucgcccaagacgauaucgacgguauccaggcaauuuaugggcgcucccagaacccagugcagcccaucggcccacaaacucccaaggccugcgacagcaaacugaccuuugaugccauuacuaccaucaggggcgagguaauguucuucaaggaccgguuuuacaugcgcaccaauccguucuaucccgaaguggagcugaacuuuauuagugucuucuggccacaguugcccaaugggcucgaggcagccuacgaauuugcggauagggacgaggugcgguucuuuaaagguaacaaguacugggccgugcagggccagaauguccugcacggguauccaaaggauaucuacuccagcuucggcuuuccccgcacggugaaacacauugacgcagcccuguccgaagagaacacugguaagaccuauuucuuuguagcaaauaaauacuggagguaugaugaauacaagcggaguauggacccaggcuauccgaaaaugaucgcccaugauuuccccgggaucggccacaagguggacgccgucuuuaugaaagauggguucuucuacuuuuuccaugguacucgccaauacaaguuugacccaaagaccaaaaggauucucacccugcagaaggcgaacagcugguucaacugucggaaaaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2037 - RNA, 3574 nt, Artificial Sequence
  mRNA product Design1 comprising derived and/or modified sequence from Clostridium histolyticum__BAA77453.1__ColG (opt7)
gggagaaagcuuaccaugaagaaaaacauccugaagauucucauggacagcuacuccaaagagaguaagauccagaccgugaggcgggucacuagcgugucccuguuggccguauaucugaccaugaauacgaguagccucgugcuggcaaaacccauugaaaacacuaaugauaccuccaucaagaacgucgagaaguugcgcaaugccccaaacgaagagaauagcaaaaagguggaagacuccaaaaacgauaagguggagcacgucaaaaauauugaggaagcgaagguggagcaaguagccccggaagugaaaaguaagagcacccugagguccgcaagcaucgccaacacuaauagugagaaguacgacuucgaguaucucaacggccuguccuacaccgaacugacgaaucucaucaaaaacauuaaguggaaucagaucaacgggcuguuuaacuauagcacugguucccagaaauucuuuggcgauaagaaucggguccaggcaauuaucaacgccuugcaagagagugggcgcaccuacacugcgaaugacaugaaaggcauugaaaccuucaccgaggugcugagggccgguuuuuaucucggguacuacaacgauggccugagcuaucugaaugaccggaacuuccaggauaagugcauccccgcaaugauugccauccagaagaauccaaacuuuaaauugggcacggccgugcaggacgaagucaucacuucccucgggaagcugauugguaaugcaagcgccaacgcggaggugguaaauaacugugugcccguccugaaacaauuccgcgagaaucucaaccaguacgccccagauuaugugaagggcaccgcagugaaugaacugaucaaagggauugaguuugacuucaguggcgccgcauacgaaaaggaugucaagacuaugcccugguaugguaaaaucgacccauuuauuaacgaguugaaggcccuggggcucuacggcaacaucaccuccgccaccgaaugggcgagcgacgugggcaucuauuaccugaguaaauucgggcuguacuccacuaauaggaacgauauuguacagagcuuggagaaggcaguggacauguauaaauacgguaagaucgccuucgucgccauggagcggauuacgugggauuaugacggcaucgggagcaauggcaagaaaguggaucaugacaaguuucucgaugacgcagaaaaacacuaccugccgaagaccuauacuuucgauaacgguaccuuuauuauccgcgccggcgacaaagucuccgaggaaaagaucaaaaggcuguacugggcgagucgggagguaaagagccaguuccaucgcgugguggggaaugauaaggcccucgaagugggcaacgcagacgacguccugaccaugaaaauuuuuaauucccccgaggaguauaaguucaacacuaauaucaacggggugagcacggauaaugguggcuuguacauugaaccaagggggaccuuuuacacuuaugagcggacuccccaacagaguaucuucucccuggaggaacucuuucgccacgaguacacccauuaucugcaggccagguaccuggucgacggcuuguggggucaaggcccauucuaugagaaaaaccggcucaccugguuugaugaagggacggcagaguucuuugccggcagcacccgcacuuccggggugcugcccaggaagaguauucugggcuaccucgccaaagacaagguggaucaccgguauagccugaagaaaaccuugaacuccgguuacgacgauagcgacuggauguucuacaauuauggguucgcaguagcccacuaccuguaugaaaaggauaugccgacuuuuaucaaaaugaauaaggcgauucucaacaccgacgugaaaaguuacgaugaaaucaucaagaagcuguccgacgaugccaacaaaaauacggaguaucagaaccauauucaggagcuggcagacaaguaccagggcgccgguauccccuuggucagcgacgauuaucugaaagaccacggcuacaagaaagccuccgaaguguacagugagauuagcaaggcagcgucccucaccaauacuagcgucaccgccgagaaaagucaauauuucaacacuuuuacccugagggggacguacaccggcgaaacuuccaagggggaguucaaggauugggacgaaaugagcaaaaagcucgauggcacccuggaguccuuggccaaaaauagcuggagugguuauaagacucugaccgcauacuuuacgaacuaucgcgugaccagcgacaauaaagugcaguacgauguagucuuccauggggugcucacugacaacgccgauaucuccaauaacaaggcaccaauugccaaggugaccggccccaguacuggcgcggucgggcggaauaucgaauuuagcgguaaagacuccaaggaugaggacggcaaaaucgugagcuacgacugggauuucggggacggcgccaccuccagggguaagaacagugugcacgcauauaaaaaggccgggacguacaauguaacccugaaggucacugaugacaaaggcgccaccgcaacugagagcuuuaccauugaaaucaagaacgaagauacuaccacgccaauuaccaaagagauggagcccaaugacgauaucaaggaagccaacggcccaauuguggagggggugacugucaaaggugaccugaacggcuccgaugacgcggauaccuucuauuuugacgugaaggaagauggggacguaacuaucgaguugccguacaguggcagcuccaauuucaccuggcugguguauaaagagggugacgaucagaaccacaucgccagcgggauugacaagaauaacaguaaggucggcacguucaaauccaccaagggccgccauuacguguuuaucuauaaacacgauagcgcauccaauauuagcuacagucucaacaucaaggggcuggguaaugaaaaacucaaggagaaggaaaacaaugacuccagcgauaaagccacugugauucccaacuucaauaccacuaugcagggcagucuguugggggacgauucccgggacuacuauagcuuugaggucaaggaagagggcgaggugaacaucgaacuggauaaaaaggacgaguucgguguaaccuggacgcugcauccagaauccaauauuaacgauaggaucaccuacgggcaaguggacggcaauaaagucagcaacaaggugaagcuccgccccggcaaauauuaccuguugguguauaaguacagugggagcgguaacuaugagcugcgggucaauaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2038 - RNA, 3298 nt, Artificial Sequence
  mRNA product Design1 comprising derived and/or modified sequence from Clostridium histolyticum__BAA77453.1__HsALB(1-18)_ColG(111-1118) (opt7)
gggagaaagcuuaccaugaagugggugaccuucaucagccugcucuuucuguucuccagugccuacagcauugcaaacacuaauuccgagaaauaugacuuugaauacuugaacggccugaguuauaccgagcucacgaaucugaucaagaacauuaaauggaaucagaucaacggguuguucaauuacagcacugguucccaaaaguuuuucggcgauaaaaacaggguccaggccauuaucaaugcgcugcaggaaagcgggcggaccuauaccgccaacgacaugaagggcaucgagacuuuuaccgaagugcuccgcgcagguuucuaccugggguauuacaaugauggccuguccuaccucaacgacaggaauuuucaggauaagugcauucccgccaugaucgcaauucagaaaaacccaaauuucaagcugggcacggccguacaggacgaggugaucacuagcuuggggaaacugauugguaacgcgagcgccaacgcagaggucgugaauaacugugugccgguccucaagcaguuucgggaaaaucugaaccaguaugcccccgauuacgugaaaggcaccgccguaaaugagcugaucaaggggauugaguucgacuucuccggcgcagccuaugaaaaagaugugaagacuaugccaugguacgguaagaucgaccccuuuaucaacgaguugaaagcgcucgggcuguauggcaauauuaccagcgccaccgaaugggcaagugaugucggcaucuacuaucuguccaaguucgggcucuacagcacgaaccgcaaugacauugugcaaucccuggagaaagccguggauauguacaaguaugguaaaaucgcauuugucgccauggaaaggauuacuugggacuacgacggcaucgggaguaacggcaagaagguggaucacgacaaauucuuggaugacgccgagaagcauuaucugccaaaaaccuacacuuuugauaaugguaccuucaucauucgggcgggcgacaagguaagcgaagagaaaaucaagcgccucuauugggcauccagggaggugaagagucaguuucaccgggucguggggaacgauaaagcccuggaagugggcaaugccgacgauguccugaccaugaagauuuucaacagucccgaggaauacaaauuuaauacuaacaucaacgggguguccacggacaaugguggcuuguauauugagccacgcgggaccuucuacacuuacgaaaggaccccgcagcagagcaucuuuagucucgaggagcuguuccggcaugaauauacccacuaccugcaagcacgcuaucucguagauggccuguggggucagggccccuuuuacgagaagaacagguugacuugguucgacgaagggacggccgaguucuuugcgggcuccacccggacuagcggggugcugccacgcaaaagcauccucggcuaucuggccaaggacaaggucgaucauagguacucccugaaaaagaccuugaauagugguuaugacgauagcgacuggauguucuacaacuacggguuugcaguggcccacuaucucuacgaaaaagauaugcccaccuucauuaagaugaauaaagcaauccugaacacugacgucaaguccuaugaugagauuaucaaaaagcugagcgacgaugccaauaagaacacggaguaccagaaucacauucaagaacucgccgacaaauaucagggcgcagguaucccacuggugagugaugacuacuugaaggaucauggcuauaaaaaggccuccgagguguacagcgaaauuuccaaagcggccagucugaccaacacuagcguaaccgcagagaagucccaguacuuuaauacuuucacccuccgggggacguauaccggcgagacuagcaagggggaauuuaaagacugggacgagaugaguaagaaacuggauggcacccuggaauccuuggccaagaacagcugguccgguuacaaaacucugaccgccuauuucacgaauuaccgcgugaccagugacaacaagguccaguaugauguggucuuucacggggugcucacugacaaugcagauaucagcaacaacaaggcgcccaucgccaaagugaccggcccguccacuggcgcaguagggaggaauauugaguucagcgguaaggacaguaaagaugaagacggcaagaucguguccuacgauugggacuuuggggauggcgccaccagccgggguaaaaacuccguccaugccuacaagaaagcagggacguauaaugugacccugaaggucacugacgacaagggcgccaccgcgacugagagcuucaccauugagaucaaaaacgaagauacgaccacucccauuaccaaggagauggaaccaaaugacgauaucaaagaggccaacggccccaucguggaaggggugacuguaaagggugaccucaauggcagugaugacgcagauaccuucuacuuugacgucaaagaggauggggacgugacuauugagcugccauauagcggcuccaguaacuucaccugguugguguacaaggaaggugaugaccaaaaucacaucgccagcgggauugauaagaacaauuccaaagucggcacguuuaagagcaccaaaggcaggcacuauguguucaucuacaagcaugacuccgccaguaacauuagcuauucccugaauaucaaagggcucgguaacgagaagcugaaggaaaaagagaauaacgacaguagcgauaaggcaacugugauccccaacuuuaauaccacuaugcagggcucccuguugggggacgauagccgcgacuacuacaguuucgaaguaaaagaggagggcgaagucaacauugagcuggauaagaaagacgaauuuggugugaccuggacgcuccacccagaguccaauaucaacgaucggauuaccuaugggcaaguggacggcaauaaggucagcaacaaagugaagcugaggccgggcaaguacuaucuccugguauacaaauauuccgggagcgguaauuacgaguugcgcgugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2039 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt7)
gggagaaagcuuaccaugaagugggugaccuucaucagccugcucuuucuguucuccagugccuacagcaugaaaaagaacauuuugaaaauccugauggacuccuauaguaaggagagcaaaauucagacugucaggcgggugaccuccguaagccuccuggcaguguacuugacgaugaauacuuccagucugguccucgccaagcccaucgaaaacaccaaugauaccagcauuaagaacguggagaaacugcgcaaugcgccaaacgaagaaaauuccaagaaaguggaagacagcaagaacgauaaagucgagcacgugaagaauaucgaggaagccaaaguagagcaaguggcaccggaagucaagaguaaguccacucugaggagcgccucccggcgcaggcggaaacgcaucgcaaacaccaauagugagaaguaugacuuugaguaccucaacggccugagcuauacggaauugacuaaucugauuaaaaacaucaaguggaaucagauuaacggucucuucaacuacuccaccgggagccagaaauuuuucggcgauaagaauagggugcaggccaucauuaacgcgcugcaagagagugggcggacuuauaccgccaaugacaugaagggcaucgaaaccuuuacggaggugcugcgcgcagguuucuacuugggguacuauaacgauggccucuccuaccugaaugacaggaacuuucaggauaaaugcauucccgccaugaucgccauccagaagaauccaaacuucaaacugggcacugcaguccaggacgaagugauuaccagccucgggaagcugaucgguaaugccagugcgaacgccgagguagugaauaacuguguccccguguugaaacaauuucgggagaaucugaaccaguaugcaccagauuacgugaagggcacugccgucaaugaacucauuaaggggaucgaguucgacuucuccggcgcagccuaugaaaaagaugugaagaccaugcccugguacgguaaaauugacccauuuaucaacgagcugaaggcccugggguuguauggcaacaucaccagcgcgacugaaugggcaagcgacguaggcauuuacuaccucuccaaauucgggcuguauaguacgaaucgcaacgauaucgugcagagccuggagaaggccgucgacauguacaaguaugguaaaauugccuuuguggcaauggagaggaucaccugggauuacgacggcauuggguccaauggcaagaaagucgaucaugacaaguuccucgaugacgccgaaaaacacuaucugccgaagacuuacaccuuugauaacgguaccuucaucauccgggcgggcgacaaagugagcgaggaaaagauuaagcgcuuguauugggccaguagggaggugaaaucccaguuucaucggguaguggggaaugauaaggcacuggaagucggcaacgccgacgacgugcucacuaugaaaaucuucaauagccccgaggaguacaaguuuaacacgaauauuaacggggucuccaccgauaaugguggccuguacaucgaaccacgcgggacuuucuauaccuacgagaggacuccccaacagaguauuuuuagccuggaagaguuguuccggcacgaguauacccauuaccuccaggcaagguaucugguggacggccuguggggucaaggcccauuuuacgagaaaaaccgccucacgugguucgaugaggggaccgccgaguucuuugccggcuccacucggaccagcggggugcugcccaggaagaguaucuugggcuaucuggcaaaggacaaaguagaucaccgcuacucccucaagaaaacucugaauagcgguuacgacgauuccgacuggauguucuauaacuacggguuugccguggcgcacuaucuguacgaaaaggauaugccgaccuucauuaaaaugaauaaggccaucuugaacacggacgucaagaguuaugaugaaaucauuaaaaagcugagcgacgaugcaaacaaaaauaccgaguaccagaaccauauccaggagcucgccgacaaguaucagggcgccgguauuccccugguguccgacgauuaccucaaagaccacggcuacaagaaagcaagcgaagucuauagugagaucuccaaggcggccagccugacuaauaccuccgugacugcagaaaagagccaauacuuuaacaccuucacguugcgggggaccuauacuggcgagaccaguaaaggggaauuuaaggauugggacgagaugagcaaaaagcuggauggcacucucgagucccuggccaaaaauaguuggagcgguuacaagacccugacggccuauuucaccaacuacagggugacuuccgacaauaagguacaguacgaugucguguuucaugggguguugaccgacaacgcagauauuagcaauaacaaagccccaaucgcgaaggucacuggccccuccaccggcgccguggggcgcaauaucgaguucagugguaaagacagcaaggaugaagacggcaaaauuguguccuaugacugggauuuuggggacggcgcaacgagucgggguaagaacagcguacacgccuacaagaaagccgggaccuauaaugucacucugaaggugaccgaugacaaaggcgcaacugccaccgaauccuucacuaucgagauuaagaacgaagauaccacgaccccaaucacuaaagagauggagcccaaugacgauauuaaggaagcgaacggcccaaucguggagggggucaccgugaaaggugaccucaacggcagcgaugacgccgauacuuucuacuuugacguaaaggaagauggggacgugaccaucgagcugccguauaguggcuccagcaauuucacguggcucgucuacaaggagggugacgaucagaaccacauugcauccgggaucgacaaaaauaacagcaaggugggcaccuuuaaaaguacuaagggcaggcauuauguguucauuuacaaacacgauuccgccagcaauaucaguuacucccugaacauuaagggguuggguaaugaaaagcugaaagagaaggaaaacaaugacagcuccgauaaagcaaccgucauccccaacuuuaauacuaccaugcagggcagccugcucggggacgauagucgggacuauuacagcuucgaggugaaggaagagggcgagguaaacauugaacuggauaaaaaggacgaguuuggugugacguggaccuugcauccagaauccaauaucaacgaucgcaucacuuaugggcaagucgacggcaauaaggugaguaacaaagugaagcugaggcccggcaaauacuaucuccuggucuacaaguauagcggguccgguaacuacgagcuccgggugaauaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2040 - RNA, 3322 nt, Artificial Sequence
  mRNA product Design1 comprising derived and/or modified sequence from Clostridium histolyticum__BAA34542.1__ColH (opt7)
gggagaaagcuuaccaugaacuuccugaagaucauucucaauaggggcaaaaccaugaagcggaaaugccugagcaagcgcuugaugcuggccaucacuauggcaaccauuuuuacggugaacuccacucuccccaucuacgccgcggucgacaaaaauaacgccaccgcagccgugcagaaugagaguaagagguauaccguaagcuaccugaagacuuugaacuauuacgaucugguggaccuccuggucaaaaccgaaauugagaaucugccagaucucuuccaauauuccagugacgcaaaggaauuuuacgggaacaaaacgcggaugagcuucaucauggaugagaucggucgcagggccccgcaguauacugaaauugaccacaagggcauccccacccugguggaggugguccgggcgggguuuuacuugggcuuccauaauaaagagcugaacgaaauuaauaagcgcuccuuuaaagagagggugaucccaagcauucucgccauccagaagaaccccaauuucaagcuggguacugaaguacaggauaaaauuguguccgcaaccgggcuguuggccggcaacgagaccgccccacccgaggucgugaauaacuuuacgccaauccuccaagacuguaucaagaacauugaucgguacgcacuggacgaucugaaaaguaaggcccucuucaaugugcuggcggccccgacuuaugacaucaccgaauacuugcgcgcaacuaaagagaagcccgaaaacaccccaugguauggcaagauugauggguuuaucaaugagcugaaaaagcucgcccuguacgguaaaauuaacgacaauaacagcuggaucaucgacaauggcauuuaucacaucgcaccccuggggaaguugcauuccaacaauaaaauuggcaucgaaacccucacugaggucaugaagguguacccauaucugagcaugcagcaucugcagagugccgaucagauuaagaggcacuacgacuccaaagaugccgaggguaacaagaucccccucgacaaauucaagaaagaagggaaggagaaguacugcccgaaaacguauaccuucgaugacggcaagguaaucauuaaagcgggcgcacggguggaagaggaaaaggucaaacgccuguacugggccagcaaggaggugaauagucaauuuuucaggguguaugggaucgauaaacccuuggaggaagguaacccagacgauauucugacuauggucaucuacaauagucccgaggaauauaagcucaacagcgugcuguacggcuaugacaccaauaacgggggcauguacauugagccagaagguaccuuuuucacuuacgagcgggaggcccaggaauccacguauacccuggaggaauuguuucgccacgaguacacucacuaucuccagggcagguacgcaguacccgggcaguggggccggaccaagcuguaugauaacgaccgccugaccugguacgaggaagggggugccgaacucuucgcgggcagcacuaggacgagugggauccugccacggaaauccauugugagcaauauccauaacaccacuaggaauaaccgcuauaaguugagugacaccguccacuccaaauacggcgccagcuuugaguucuacaauuaugcauguauguuuauggauuacauguauaacaaggacauggguauccugaauaaacucaacgaucuggccaagaauaacgacguggauggcuacgacaauuauauucgggaucugagcuccaacuacgcauugaaugacaaguaucaagaucauaugcaggagaggaucgacaacuacgaaaaucugacugucccguucguggccgaugacuaccucgugcgccacgccuauaaaaaccccaacgagauuuacagugagaucagcgaaguagcaaagcugaaagaugccaaguccgaggugaaaaagagccaguauuuuaguaccuucacgcuccggggguccuacaccggcggggcgagcaagggcaaacuggaagaccaaaaggccaugaauaaauuuauugacgauuccuugaagaaacuggacacuuauaguuggagcgguuacaagacccucacugcauacuucaccaacuauaaagucgauuccagcaauagggugacguacgacgucguguuccacggguaucugccaaacgagggcgauaguaaaaauucccugcccuacgguaagaucaacggcaccuauaaggggacugaaaaggagaaaaucaaguuuagcuccgagggcaguuucgacccagaugggaaaauugugagcuacgaaugggacuuuggcgaugguaauaaguccaacgaggaaaaucccgagcauagcuaugacaagguagggaccuacacugugaaauugaaggucaccgaugacaaaggcgaaaguuccgugagcacgaccacugccgagaucaaggaccuguccgagaacaaacucccggucauuuacaugcacgugccaaagagcggcgcccugaaucagaaggugguauucuaugggaaagguaccuacgaucccgacggcaguaucgcaggguaucagugggauuuuggcgacgguagcgauuucuccagugaacagaaccccagccaugucuacacuaagaaaggggaguauaccgugacgcuccgcgugauggacuccagcggccaaauguccgaaaagaccaugaaaauuaagaucacugauccagucuaccccaucggcaccgagaaagagccaaauaacaguaaggaaacugcgagcgggccgauugugcccgguaucccaguguccggcaccauugagaauacuuccgaccaggauuauuuuuacuucgacguaaucacccccggggaagucaagauugauaucaacaaacugggcuacgguggggccacgugggugguguaugacgagaacaauaacgcagucagcuacgccaccgaugacggccagaauuuguccggcaaguuuaaagccgacaagccagggcgguauuacauucaccuguauauguucaacgguagcuacaugcccuauaggaucaauaucgaaggcaguguggggcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2041 - RNA, 3283 nt, Artificial Sequence
  mRNA product Design1 comprising derived and/or modified sequence from Clostridium histolyticum__BAA34542.1__ColH (opt7)
gggagaaagcuuaccaugaagaggaaaugccugagcaagcggcucaugcuggccaucaccauggcaacuauuuucaccgugaacuccacguugcccaucuacgccgcggucgacaaaaauaacgccacugcagccgugcagaaugagaguaagcgcuauaccguaagcuaccugaaaacccucaacuauuacgaucugguggacuugcuggucaagacugaaauugagaaucucccagaucuguuucaauauuccagugacgcaaaggaguucuacggcaacaaaaccaggaugagcuuuaucauggaugaaauugggcggcgcgccccgcaguauacggaaaucgaccacaaggguauccccacucugguggagguggucagggcgggcuucuaccucggguuucauaauaaagagcugaacgaaauuaauaagcgguccuucaaagagcgcgugaucccaagcauuuuggccauccagaagaaccccaauuuuaaacugggcaccgaaguacaggauaagauuguguccgcaacuggucuccuggccgggaacgagaccgccccacccgaggucgugaauaacuucaccccaauccugcaagacuguauuaagaauaucgauagguacgcauuggacgaucucaaaaguaaggcccuguuuaacgugcuggcggccccgacguaugacaucacugaauaccuccgggcaaccaaagagaagcccgaaaacacuccaugguauggcaaaauugauggcuucaucaaugagcugaagaaguuggcccuguacgggaaaauuaacgacaauaacagcuggaucauugacaaugguaucuaucacaucgcaccccucggcaagcugcauuccaacaauaaaauugggaucgaaacccugaccgaggucaugaagguguacccauauuugagcaugcagcaccuccagagugccgaucagauuaaacgccauuacgacuccaaggaugccgagggcaacaagaucccccuggacaaauuuaagaaagaagguaaggagaaauacugcccgaagacuuauacguucgaugacgggaagguaauuaucaaagcgggcgcaaggguggaagaggaaaaggucaaacggcuguacugggccagcaaggaggugaauagucaauucuuucgcguguauggcaucgauaaaccccucgaggaagggaacccagacgauauucugaccauggucaucuacaauagucccgaggaauauaaguugaacagcgugcuguacgguuaugacacuaauaacggcgggauguacauugagccagaaggcaccuucuuuaccuacgagagggaggcccaggaauccacuuauacgcucgaggaacuguuccggcacgaguacacccacuaucugcagggucgcuacgcaguacccggccagugggggaggacuaaauuguaugauaaugaccggcucaccugguacgaggaaggcggggccgagcuguuugcggguagcacccgcacuuccggcauccugccaaggaaguccauugugagcaacauccauaacacgacccggaauaacagguauaagcucagugacacuguccacuccaaauacggggccagcuucgaauuuuacaauuaugcauguauguucauggauuacauguauaacaaggacaugggcauucugaauaaauugaacgaucuggccaagaauaacgacguggaugguuacgacaauuauauccgcgaucucagcuccaacuacgcacugaaugacaaauaucaagaucauaugcaggagcggaucgacaacuacgaaaaucugaccgucccguuuguggccgaugacuacuuggugaggcacgccuauaagaaccccaaugagauuuacagugagaucagcgaaguagcaaagcugaaagaugccaaguccgaggugaaaaagagccaguauuucaguacuuuuacccuccgcggcuccuacacgggcggcgcgagcaaagggaagcuggaagaccaaaaggccaugaacaaauucauugacgauucccucaagaaacuggacaccuauaguuggagcggcuacaagacuuugaccgcauacuuuacuaacuauaaagucgauuccagcaaucgggugaccuacgacgucguguuccacgguuaucugccaaacgagggggauaguaaaaauucccuccccuacggcaagaucaacgguacguauaagggcaccgaaaaggagaaaauuaaguucagcuccgaggggaguuuugacccagauggcaaaaucgugagcuacgaaugggacuucggggauggcaauaaguccaacgaggaaaaucccgagcauagcuaugacaaaguagguacuuacaccgugaagcugaaggucacugaugacaaaggggaaaguuccgugagcaccacgaccgccgagaucaaggaccuguccgagaacaaauugccggucauuuacaugcacgugccaaagagcggcgcccugaaucagaaagugguauuuuauggcaaggggacuuacgaucccgacgguaguaucgcaggcuaucagugggauuucggggacggcagcgauuuuuccagugaacagaaccccagccaugucuacaccaagaaaggugaguauacugugacccucagggugauggacuccagcgggcaaauguccgaaaagacgaugaaaauuaagaucaccgauccagucuaccccauuggcacugagaaagagccaaauaacaguaaggaaaccgcgagcggcccgaucgugcccgggaucccaguguccgguacuauugagaauaccagugaccaggauuauuucuacuuugacguaaucacucccggcgaagucaaaauugauaucaacaagcugggguacggcggugccaccugggugguguaugacgagaauaacaacgcagucagcuacgccacggaugacgggcagaaucucuccggcaaguucaaagccgacaagccaggccgcuauuacauucaccuguauauguuuaacgggagcuacaugcccuaucggaucaauauugaagguaguguggggaggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2042 - RNA, 3217 nt, Artificial Sequence
  mRNA product Design1 comprising derived and/or modified sequence from Clostridium histolyticum__BAA34542.1__HsALB(1-18)_ColH(41-1021) (opt7)
gggagaaagcuuaccaugaagugggugaccuucaucagccugcucuuucuguucuccagugccuacagcguccagaacgaguccaaaagguauacugugaguuacuugaagacccugaauuauuacgaccucguagaucuguuggugaaaacggaaauugagaaccugcccgaccucuuucaauauagcuccgaugcaaaggaguucuacggcaauaaaacucggaugagcuuuaucauggacgaaauugggcgcagggccccacaguauaccgaaaucgaucacaaggguauuccgacccuggucgagguggugcgggcgggcuucuaccugggguuucauaacaaggagcucaaugaaaucaacaaacgcuccuucaaggagagggucauccccaguauucuggccauccagaaaaauccaaacuuuaaguugggcacugaagugcaggacaaaauuguaagcgcaaccggucugcucgccgggaaugagacggcacccccagagguggucaacaauuucacucccauccugcaagauugcauuaagaacaucgaccgguacgcccuggaugacuugaaauccaaggcgcucuuuaaugugcuggccgcaccaaccuaugauauuacugaauaccugcgcgccaccaaggagaaaccggaaaacacccccugguauggcaagaucgacggcuucaucaaugagcucaaaaagcuggccuuguacgggaaaauuaacgauaacaauagcuggaucauugacaacgguaucuaucacauugcaccacugggcaagcuccauaguaauaacaagaucgggaucgaaacgcugacugaggugaugaaagucuaccccuaucuguccaugcagcacuugcagagcgccgaccagauuaagaggcauuacgauuccaaagacgcggagggcaauaagaucccacucgauaaauucaagaaggaagguaaagagaaguacugucccaaaaccuauacuuuugacgaugggaaggugauuaucaaagccggcgcacggguagaagaggaaaaggugaagcgccuguacugggccaguaaagaggucaacagccaauucuuuaggguguauggcauugacaagccgcuggaggaagggaaucccgaugacauccucaccauggugaucuacaacuccccagaggaauauaaacugaauagcgucuuguacgguuaugauaccaacaauggcgggauguacauugagcccgaaggcacuuucuuuacguacgagcgggaggcacaggaaaguaccuauacucuggaggaacucuuccgccacgaguacacccacuaucugcaggguagguacgccgugccaggccagugggggcggaccaagcuguaugacaacgaucgcuugacuugguacgaggaaggcggggccgagcucuuugcggguuccacgaggaccagcggcauccugccccggaaaaguauuguauccaauauccauaacacuacccgcaauaacagguauaagcugagcgacaccgugcacagcaaauacggggcauccuucgaauuuuacaacuaugccugcauguucauggacuacauguauaauaaggauaugggcauucucaacaagcugaaugacuuggccaaaaacaaugaugucgacgguuacgauaacuauauccgggaccugaguagcaauuacgcacucaacgauaaguaucaagaccauaugcaggagaggauugauaauuacgaaaaccugacugugccauuugucgccgacgauuaccuggugcgccacgcguauaaaaauccgaacgagaucuacuccgagaucagcgaaguggccaaguugaaagacgcaaagagugagguaaagaaaucccaguauuucagcacguuuacccugcggggcuccuacacugggggcgccaguaaggggaaacucgaagaucaaaaggcaaugaauaaauucauugacgacagccugaagaagcucgauaccuauuccuggagcggcuacaaaacucugaccgccuacuucacgaacuauaagguggacaguuccaauagggucaccuacgauguggucuuucacgguuauuugcccaacgagggggacagcaaaaacucccugccauacggcaagaucaaugguacuuauaaaggcaccgaaaaggagaaaauuaaguucaguagcgagggguccuuugaucccgacggcaagaucgugagcuacgaaugggauuucggggacggcaacaaaaguaaugaggaaaacccagagcauuccuaugauaagguggguacuuacaccguaaaacucaaggugacggacgauaaaggggaaagcuccgucagcaccacuaccgccgagauuaaggaccugagugagaauaagcugcccgugaucuacaugcacgucccgaaaagcggcgcauugaaccagaaggugguguuuuauggcaaagggacuuacgacccagaugguuccaucgccggcuaucagugggacuucggggauggcagugacuuuagcuccgaacagaaucccagccauguauacaccaagaaaggugaguauacggucacccugcgcgugauggauuccagugggcaaaugagcgaaaagacuaugaagauuaaaaucaccgaccccguguacccaauuggcacugagaaggagcccaacaauuccaaagaaaccgcgaguggcccaaucgucccggggauucccgugagcgguacgaucgagaacaccuccgaucaggacuauuucuacuuugaugugaucacuccaggcgaaguaaagauugacaucaauaaacucggguacggcggugccaccugggucguguaugaugagaacaauaacgcagugagcuacgccacugacgaugggcagaaucugaguggcaaguucaaagccgacaagcccggccgguauuacauucaccucuauauguuuaacggguccuacaugccauauaggaucaacauugaagguagcgucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2043 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt7)
gggagaaagcuuaccaugaagugggugaccuucaucagccugcucuuucuguucuccagugccuacagcaugaaaaggaagugcuuguccaaacggcugaugcucgcaauuacuauggccaccaucuuuacggucaacaguacucugcccauuuaugcggccguggacaagaauaacgcaaccgccgcacgcaggcggcgcaaaaggguacagaaugagagcaagcgguacaccguguccuauuugaagacucugaacuacuaugaucucgucgaccugcuggugaaaaccgaaaucgagaaucucccagaucuguuccaauacagcuccgacgccaaggaauuuuauggcaacaaaacgcgcaugaguuucauuauggaugagaucgggaggcgggcgccgcaguacacugaaaucgaccacaaggguauucccaccuugguggaggucgugcgcgccggcuuuuaccugggguuccauaauaaagagcucaacgaaaucaauaagaggagcuuuaaagagcggguaauuccauccauccuggcaauucagaagaaccccaauuucaagcugggcacugaagugcaggauaaaaucgucagcgccaccgguuugcucgccgggaacgagaccgcaccacccgagguggugaauaacuuuacgccaauucugcaagacuguaucaagaauaucgaucgcuaugcccuggacgaucucaaaaguaaggcgcuguucaacgucuuggccgcaccgacuuacgacauuaccgaauaucugagggccacuaaagagaagcccgaaaacaccccaugguacggcaagaucgauggcuucauuaaugagcucaaaaagcuggcacuguaugggaaaaucaacgacaauaacuccuggauuaucgacaaugguaucuaccacauugcccccuugggcaagcuccauagcaacaauaaaaucgggauugaaacccugacugaggugaugaagguauauccauaccuguccaugcagcaccuccagagugccgaucagaucaagcggcauuacgacagcaaagaugcggagggcaacaagauuccccuggacaaauuuaagaaagaagguaaggagaaguauugcccgaaaacguacaccuucgaugacgggaaggugaucaucaaagcaggcgcccgcgucgaagaggaaaaggugaaaagguuguauugggccuccaaggaggugaauagccaauuuuuccgggucuacggcauugauaaaccccuggaggaagggaacccagacgauauccucacuauggugauuuauaauagucccgaggaauacaagcugaacuccguacuguaugguuacgacaccaauaacggcgggauguacaucgagccagaaggcaccuuuuucacuuaugagcgcgaggcacaggaaagcacguacaccuuggaggaacucuuuaggcacgaguauacucacuaccugcagggucgguaugccgugcccggccagugggggaggaccaagcuguacgauaaugaccgccucaccugguaugaggaaggcggggcggagcuguucgccgguaguacucggacguccggcauuuugccaaggaaaagcaucgucagcaacauucauaacaccacucgcaauaaccgguacaagcuguccgacaccgugcacaguaaauacggggcgagcuuugaguucuauaauuacgccuguauguuuauggauuauauguacaacaaggacaugggcauccucaauaaacugaacgaucuggcaaagaauaacgacgucgaugguuaugacaauuacaucagggauuuguccagcaacuaugcccugaaugacaaguaccaagaucauaugcaggaacgcauugacaacuacgaaaaucucacugugccguucguggccgaugacuaucugguacggcacgcauacaaaaaccccaaugagaucuauagugagauuuccgaaguggccaagcucaaagaugcaaagagcgaggucaaaaagucccaguacuuuaguaccuucacgcugaggggcagcuauaccgggggcgccuccaaggggaaauuggaagaccaaaaggcaaugaacaaauucaucgacgauagccugaagaaacucgacacuuacaguugguccggcuacaagacccugacugccuauuuuaccaacuacaaaguggauagcuccaaucgggucacguaugacgugguguuccacgguuaccugccaaacgagggggauaguaagaauagcuugcccuauggcaagauuaacgguaccuacaaaggcacugaaaaggagaaaaucaaguuuuccagcgaggggaguuucgacccagauggcaaaaucguauccuaugaaugggacuuuggggauggcaauaagagcaacgaggaaaaucccgagcauuccuacgacaagguggguaccuacacugucaaacugaaggugaccgaugacaaaggggaaagcagugucagcacgaccacugccgagauuaaggaccucuccgagaacaaacugccggugaucuauaugcacgugccaaagaguggcgcacucaaucagaagguagucuucuacggcaaagggaccuaugaucccgacgguagcauugcgggcuaccagugggauuuuggggacggcuccgauuucagcuccgaacagaaccccagucauguguauacuaagaaaggugaguacaccgugacgcugcgcgucauggacagcuccgggcaaaugagugaaaagaccaugaaaaucaagauuacugauccaguguaucccaucggcaccgagaaagagccaaauaacagcaaggaaacugccuccggcccgaucgugcccgggauuccaguaagcgguaccaucgagaauaccagugaccaggauuacuuuuacuucgacgucauuacucccggcgaagugaagaucgauauuaacaaauugggguauggcggugcaacguggguggucuacgacgagaauaacaacgccguguccuaugccaccgaugacgggcagaaucugagcggcaaguuuaaagcagacaagccaggcagguacuauauccaccuguacauguucaacggguccuauaugcccuaccggauuaauaucgaagguagcguaggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2044 - RNA, 793 nt, Artificial Sequence
  mRNA product Design1 comprising derived and/or modified sequence from Homo sapiens__NP_001133.1__HsAMELX (opt7)
gggagaaagcuuaccaugggcaccuggauccuguucgccugccuccugggggcagccuuugcgaugcccuugccaccgcaccccggucauccaggcuacauuaacuucagcuaugaggugcugacuccccucaagugguaccaguccaucaggccacccuauccaaguuacggguaugaaccgaugggcgguuggcugcaccaucaaauuauccccgucuugagccagcagcacccacccacccauacgcugcagccacaccaccauauucccgugguaccggcccaacagcccgugaucccacagcagcccaugaugccaguccccgggcaacacuccaugacuccaauccagcaucaccagccgaaucugcccccacccgcacagcaaccauaccagccccagccggugcaaccacagccccaccagcccaugcagccacaacccccagugcauccgaugcagccccucccaccccagccaccccugccgccaauguuucccaugcagccacugcccccgaugcuccccgacuugacccuggaggccuggccaaguaccgauaaaacuaagcgggaagaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2045 - RNA, 352 nt, Artificial Sequence
  mRNA product Design1 comprising derived and/or modified sequence from Homo sapiens__NP_001133.1__HsAMELX-TRAP (opt7)
gggagaaagcuuaccaugccccugccaccgcaccccggccauccaggguacaucaacuucagcuaugaggugcucaccccacugaagugguaccaguccauuaggccacccuaucccaguuacgguuaugaaccgaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2046 - RNA, 385 nt, Artificial Sequence
  mRNA product Design1 comprising derived and/or modified sequence from Homo sapiens__NP_001133.1__HsAMELX-LRAP (opt7)
gggagaaagcuuaccaugccccugccaccgcaccccggccauccaggguacaucaacuucagcuaugaggugcucacuccccugaagugguaccaguccauuaggccacccccaauguugccggaccugacccucgaagccuggcccaguaccgauaaaacgaagcgggaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2047 - RNA, 424 nt, Artificial Sequence
  mRNA product Design1 comprising derived and/or modified sequence from Homo sapiens__NP_001133.1__HLA-A2-SP_HsAMELX(17-60) (opt7)
gggagaaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguauucggcccccauauccgagcuacggcuaugaacccaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2048 - RNA, 457 nt, Artificial Sequence
  mRNA product Design1 comprising derived and/or modified sequence from Homo sapiens__NP_001133.1__HLA-A2-SP_HsAMELX(17-47,168-191) (opt7)
gggagaaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguauucggcccccaccgaugcuccccgaccugacucuggaagcauggccaagcaccgauaaaaccaagcgcgaggaaguagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2049 - RNA, 796 nt, Artificial Sequence
  mRNA product Design1 comprising derived and/or modified sequence from Homo sapiens__NP_001134.1__HsAMELY (opt7)
gggagaaagcuuaccaugggcaccuggauccuguucgccugccucgugggggcagccuuugcgaugccccugccaccgcaccccggucauccaggcuacauuaacuucagcuaugaggucuugacuccccugaagugguaccaguccaugaucaggccacccuauaguagcuacggguaugaaccaaugggcgguuggcuccaccaucaaauuaucccggugguaucccagcagcacccccugacccauacguugcagagucaccaccauauuccagugguccccgcccaacagccacgggugcgccagcaggcacugaugcccgugccggggcaacagagcaugacucccacccagcaccaucagccaaaucucccccugccagcccaacagcccuuucagccacaaccgguccagccccagccacaccagcccaugcaaccacagcccccggugcagccaaugcagccccugcucccccaaccaccccugccaccgauguuccccuugaggccacugcccccaauccuccccgaccugcaccuggaggcauggccggccaccgauaaaacuaagcaggaagagguagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2050 - RNA, 355 nt, Artificial Sequence
  mRNA product Design1 comprising derived and/or modified sequence from Homo sapiens__NP_001134.1__HsAMELY-TRAP (opt7)
gggagaaagcuuaccaugccccugccaccgcaccccggccauccaggguacaucaacuucagcuaugaggugcucaccccacugaagugguaccaguccaugauuaggccacccuauaguagcuacgguuaugaacccaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2051 - RNA, 388 nt, Artificial Sequence
  mRNA product Design1 comprising derived and/or modified sequence from Homo sapiens__NP_001134.1__HsAMELY-LRAP (opt7)
gggagaaagcuuaccaugccccugccaccgcaccccggccauccaggguacaucaacuucagcuaugaggugcucacuccccugaagugguaccaguccaugauuaggccacccccaaucuugccggaccugcaccucgaagccuggcccgcaaccgauaaaaccaagcaagaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2052 - RNA, 427 nt, Artificial Sequence
  mRNA product Design1 comprising derived and/or modified sequence from Homo sapiens__NP_001134.1__HLA-A2-SP_HsAMELY(17-61) (opt7)
gggagaaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguaugauucggcccccauauagcuccuacggcuaugaaccgaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2053 - RNA, 460 nt, Artificial Sequence
  mRNA product Design1 comprising derived and/or modified sequence from Homo sapiens__NP_001134.1__HLA-A2-SP_HsAMELY(17-48,169-192) (opt7)
gggagaaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguaugauucggcccccaccgauccuccccgaccugcaccuggaagcauggccagccacugauaaaaccaagcaggaggaaguagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2054 - RNA, 787 nt, Artificial Sequence
  mRNA product Design1 comprising derived and/or modified sequence from Sus scrofa__NP_999071.1__SsAMELX-001-1 (opt7)
gggagaaagcuuaccaugggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccauauaccaguuacggguaugaacccaugggcgguuggcugcaucaccaaauuaucccagucgugagccagcagacgccgcagucccaugcguugcaaccccaccaccauauuccaaugguacccgcccagcagccagggaucccccagcaaccgaugaugccccugccaggccagcacaguaugacucccacccagcaucaccagccaaaccucccccugccagcacaacagccguuucagccccaaccagugcagccccagccacaccagccccugcaaccgcagagcccaaugcaucccauccagccccuccugccacagcccccauugccgcccauguucuccaugcaaagccugcucccagaccugccccuggaggccuggccagcaaccgauaaaacuaagcgggaagaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2055 - RNA, 355 nt, Artificial Sequence
  mRNA product Design1 comprising derived and/or modified sequence from Sus scrofa__NP_999071.1__SsAMELX-TRAP (opt7)
gggagaaagcuuaccaugccccugccaccgcaccccggccauccaggguacaucaacuucagcuaugaggugcucacuccccugaagugguaccagaauaugauuaggcacccauauaccuccuacgguuaugaacccaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2056 - RNA, 388 nt, Artificial Sequence
  mRNA product Design1 comprising derived and/or modified sequence from Sus scrofa__NP_999071.1__SsAMELX-LRAP (opt7)
gggagaaagcuuaccaugccccugccaccgcaccccggccauccaggguacaucaacuucagcuaugaggugcucacuccccugaagugguaccagaauaugauuaggcacccauccuugcugcccgaccucccacuggaagccuggccggcaaccgauaaaaccaagcgggaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2057 - RNA, 427 nt, Artificial Sequence
  mRNA product Design1 comprising derived and/or modified sequence from Sus scrofa__NP_999071.1__HLA-A2-SP_SsAMEL(17-61) (opt7)
gggagaaagcuuaccauggccgugauggcacccaggacucugguccuccuguugagcggcgcccuggcgcucacucagaccugggccaugccacugccgccccacccagggcaucccgguuacaucaacuucuccuaugagguguugacgccacugaagugguaccaaaauaugauucggcaccccuauaccaguuacggcuaugaaccaaugggcggguggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2058 - RNA, 460 nt, Artificial Sequence
  mRNA product Design1 comprising derived and/or modified sequence from Sus scrofa__NP_999071.1__HLA-A2-SP_SsAMEL(17-49,167-189) (opt7)
gggagaaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaauaugauucggcaccccagucuccugccagaccugccgcucgaagcauggcccgccacugauaaaaccaagcgcgaggaaguagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2059 - RNA, 751 nt, Artificial Sequence
  mRNA product Design1 comprising derived and/or modified sequence from Sus scrofa__P45561-2__SsAMELX-001-2 (opt7)
gggagaaagcuuaccaugggcaccuggauccuguucgccugccuccugggggcagccuuuagcaugcccuugccaccgcaccccggucauccaggcuacauuaacuucuccuauaucaggcaccccuacaccaguuauggguacgagccaaugggcgguuggcugcaucaccagauuauccccguggucagccaacagacuccacagucccaugcgcuccagccgcaccaccauauucccauggugccagcccaacagcccgggaucccacagcagcccaugaugccgcugcccggccaacacaguaugacgccaacucagcaucaccagcccaauuugccacugcccgcacagcaaccauuucagccgcagcccguacaaccacagccccaccagccacuccagccccaaagcccgaugcauccaauccagccccugcugccccagccaccccucccaccgauguucuccaugcagagccuguugcccgaccugccacucgaagccuggcccgcaaccgauaagaccaaacgggaggaaguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2060 - RNA, 787 nt, Artificial Sequence
  mRNA product Design1 comprising derived and/or modified sequence from Sus scrofa__NP_998965.1__SsAMELX-001-3 (opt7)
gggagaaagcuuaccaugggcaccuggaucuucuuugccugccugcucggggcaagccuggccaugcccuugccaccgcaccccggucauccaggcuacauuaacuucuccuaugaggugcugacuccccucaagugguaccagaauaugaucaggcacccauauaccaguuacggguaugaacccaugggcgguuggcugcaucaccaaauuaucccagucgugagccagcagacgccgcagucccaugcguugcaaccccaccaccauauuccaaugguacccgcccagcagccagggaucccccagcaaccgaugaugccccugccaggccagcacaguaugacucccacccagcaucaccagccaaaccucccccugccagcacaacagccguuucagccccaaccagugcagccccagccacaccagccccugcaaccgcagagcccaaugcaucccauccagccccuccugccacagcccccauugccgcccauguucuccaugcaaagccugcucccagaccugccccuggaggccuggccagcaaccgauaaaacuaagcgggaagaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2061 - RNA, 436 nt, Artificial Sequence
  mRNA product Design1 comprising derived and/or modified sequence from Sus scrofa__K7GPB2__SsAMELX-002 (opt7)
gggagaaagcuuaccaugggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccaagucuguugcccgaccugccacucgaagcguggccggccaccgauaaaacgaagcgggaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2062 - RNA, 829 nt, Artificial Sequence
  mRNA product Design1 comprising derived and/or modified sequence from Sus scrofa__K7GLD0__SsAMELX-003 (opt7)
gggagaaagcuuaccaugggcaccuggauccuguucgccugccuccugggggcagccuuuagcaugcccuugccaccgcaccccggucauccaggcuacauuaacuucuccuaugaggaccuguaccucgaagcgaucaggauugaucggacugccuuugugcugacccccuugaagugguaucagaauaugauccgccacccauacacgaguuauggguacgagcccaugggcgguuggcugcaucaccaaauuaucccagucgugagccagcagacuccgcagucccaugcacuccaaccccaccaccauaucccaaugguacccgcccagcagccagggauuccccagcaaccgaugaugccccugccaggccagcacaguaugacccccacccagcaucaccagccaaaccugccccucccagcacaacagccguuccagccccaaccagugcagccccagccacaccagccccugcaaccgcagagcccaaugcaucccauccagcccuugcugccacagcccccacucccgcccauguuuuccaugcaaagccugcugccagacuugccccucgaagccuggccagcgacugauaaaaccaagagggaggaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2063 - RNA, 715 nt, Artificial Sequence
  mRNA product Design1 comprising derived and/or modified sequence from Sus scrofa__K7GPE9__SsAMELX-004 (opt7)
gggagaaagcuuaccaugggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccaacgccccaaagucaugcgcugcagccacaccaucacauuccgaugguccccgcccagcagccagggaucccccaacagccaaugaugcccuugccgggccagcacagcaugacccccacucagcaucaccaaccaaaccugccccucccagcacagcagcccuuucagccacaaccggugcagccccagccacaucaaccccugcagccacagucccccaugcacccgauucagccacugcucccccaacccccacugcccccaauguucaguaugcagagcuugcugccggaccucccccuggaagccuggccagcaaccgauaaaaccaagcgggaggaaguagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2064 - RNA, 739 nt, Artificial Sequence
  mRNA product Design1 comprising derived and/or modified sequence from Sus scrofa__J9JIM4__SsAMELX-201 (opt7)
gggagaaagcuuaccaugccccugccaccgcaccccggccauccaggguacaucaacuucagcuaugaggugcucacuccccugaagugguaccagaauaugauuaggcacccauauaccuccuacgguuaugaacccaugggcgggugguugcaucaccaaaucauuccagucgugagucagcagaccccgcagagccaugcccugcaaccccaccaccauaucccaaugguacccgcacagcagccaggcauuccccagcaaccgaugaugccccucccaggucagcacuccaugacgcccacucagcaucaccagccaaaccugcccuugccagcccaacagccguuucagccccaaccagugcagccccagccacaccagccccugcaaccgcagaguccaaugcaucccauccagccccuccugccacagcccccacugccgcccauguucagcaugcaaucccuccugccagacuugccccuggaggcguggccagccaccgauaaaaccaagcgggaagaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2065 - RNA, 3178 nt, Artificial Sequence
  mRNA product Design1 comprising derived and/or modified sequence from Homo sapiens__NP_006120.1__HsBMP1 (opt7)
gggagaaagcuuaccaugcccggcguggccaggcugccacuccuguuggggcugcuccuguugccgcggcccggucgcccacuggaccucgcagauuacaccuaugaccuggccgaggaagaugacagcgagccccugaacuacaaggauccaugcaaagcggccgcauuccucggcgacaucgcccuggaugaagaggacuugagggcauuucagguccaacaggccguggaucugcggcgccacacugcgaggaaguccaguauuaaagccgcaguacccgggaauaccagcacgccauccugucagaguacuaacggccagccgcaacggggugccugcgggcgcuggaggggccggagccgcuccaggcgggccgcaaccagccgccccgaaaggguguggccagacggcgucauccccuucgugauuggggguaauuuuaccggcucccagcgggccguguuccgccaggcgaugaggcauugggagaagcacacuugugucaccuuucucgagcggacggaugaagacaguuauaucguguucacuuaccgcccaugcggguguugcagcuauguaggcaggcggggugggggcccccaggccauuuccaucggcaaaaacugugauaaguuugggaucgugguccaugagcugggucacguggugggcuucuggcaugaacacaccaggccggaccgcgaccggcacgucagcauugugagggagaauauccaacccgggcaggaguacaacuuucugaagauggaaccacaggagguagaaaguuugggcgagacuuaugauuucgacuccauuaugcauuacgcacgcaauaccuuuagccgggguaucuuccucgauaccauugugcccaaauacgaagucaacggcgugaagccacccaucgggcagaggacgcgccuguccaaaggcgacauugcccaagcacggaagcuguauaaaugcccagccuguggggagacucuccaggauaguaccgguaauuucagcuccccggaguaccccaacggcuauagcgcccacaugcauugcguguggaggaucagugucacuccaggggaaaagaucauucugaauuuuaccuccuuggaccuguaccggagccgccucugcugguaugauuacguggagguaagggacggcuucuggcggaaagcgccccugcgcgguagguuuuguggcaguaagcugccagaacccaucguguccaccgauagccgguugugggucgaguuccgcagcuccaguaacuggguggggaagggcuuuuucgcagucuaugaagccauuugcgggggcgacgugaaaaaggauuacggucacauccagagcccgaauuacccagacgacuauaggcccuccaaaguguguauuuggcggauccaaguaagcgagggguuucacgugggccucacuuuccagaguuuugagaucgaaaggcaugauuccugcgccuacgacuaucuggagguccgcgauggucacagcgaauccaguacgcugauuggccgguacuguggguaugagaagcccgacgauaucaaaagcaccuccagcaggcucuggcugaaguucgugagugacggcuccauuaacaaggcaggguuugccgucaauuucuuuaaagaaguggaugagugcagccgcccaaaccggggcgguugugagcagaggugcuugaacacucugggguccuacaaguguaguugcgaccccggcuaugaacucgcgccagauaaacgccggugcgaggccgcauguggcggguuccugaccaagcugaaugguagcaucaccuccccgggcuggcccaaagaauacccacccaacaagaauugcauuuggcaguugguggccccaacucaauacaggaucagccuccaguucgacuuuuucgagacggaggggaacgauguauguaaguaugacuuuguggaaguccgcaguggccugaccgcagauuccaaacugcaugguaaguucugcgggagcgagaaacccgaagugaucacuucccaguacaauaacaugcgggucgaguuuaagagcgacaauaccgugaguaaaaagggcuucaaggcccacuuuuucagcgacaaagaugaauguuccaaggacaacggcgggugccagcaagauugugugaauaccuuugguaguuaugagugccaguguaggagcggcuucguacuccaugacaacaaacacgauugcaaggaggccgggugugaccacaaagucacuuccacgagcggcaccauuacuuccccgaauuggccagauaaguaccccaguaaaaaggaaugcaccugggcaaucagcuccacuccaggucaucgcgugaagcugaccuuuauggagauggacauugaaagucagcccgagugcgccuaugaucacuuggaaguguucgacgggcgggaugcgaaagccccgguccugggcagguucuguggcagcaagaaacccgagccagugcucgcaacggggucccgcauguuucugcgguucuacagcgacaacagugugcagaggaaggguuuucaagccucccaugccaccgagugcggcgggcagguacgcgcagacgucaaaacuaaggaucuguauagccacgcgcaguucggcgacaauaacuaccccggugggguggauugugaaugggugaucgucgccgaggaaggcuacggcguggaguugguauuucagaccuucgaaguggaggaggaaacugacugcggguaugauuacauggagcuguuugacgguuaugauuccaccgcaccaaggcucggccgguacugugggagcggucccccagaagaggucuauagugccggcgacuccgugcuggugaaguuccacagcgaugacacgauuaccaaaaagggcuuucaucucagguacaccaguacuaaauuccaagauacucugcacucccgcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2066 - RNA, 1408 nt, Artificial Sequence
  mRNA product Design1 comprising derived and/or modified sequence from Homo sapiens__NP_001191.1__HsBMP2 (opt7)
gggagaaagcuuaccaugguggccggcaccaggugccugcucgcacuguugcugccccagguccuccuggguggggccgcgggcuuggugccagagcuggggcggcgcaaguucgccgcagccagcuccggcaggccgaguagccaacccuccgacgaaguacucagugaguuugaacugcggcugcucagcauguucggucugaaacagcgcccaacucccuccagggaugcaguggucccacccuacauguuggaccuguaucggcgccacagcgggcagccaggcuccccggcccccgaucauaggcucgagcgggcggccagucgcgcaaacaccgugaggagcuuucaccaugaagagucccuggaggaacugccagagacgagcggcaagacuacccggcgcuucuuuuucaauuugaguuccauccccaccgaagaguuuauuacuagcgccgagcuccagguguucagggaacaaaugcaggacgcccuggggaacaauuccaguuuucaccaucggaucaacauuuacgagaucauuaaaccagcaaccgccaauagcaaguuccccgucacgcgccugcucgauacuaggcuggugaaccagaaugcgucccggugggaauccuuugacguaaccccggccgugaugcgcuggacugcacagggucacgccaaccacggcuucgucguggagguggcacauuuggaagagaaacaaggggucaguaagaggcacgugcggaucuccaggagccugcaucaggaugagcacaguuggucccagauccgcccccuccugguaaccuucggccacgacgguaaggggcauccacugcacaaacgggaaaagaggcaggccaaacauaagcaacgcaaacggcucaagagcagcuguaaaaggcaccccuuguauguggauuuuuccgacgucggcuggaaugauuggauuguggccccacccggcuaccaugcguucuauugccacggggaguguccauuuccgcuggcagaccaccugaacaguaccaaucaugccaucgugcagacgcucgucaacagcgugaauagcaagauucccaaggccugcuguguaccaacugaacugagcgcaaucaguauguuguaccuggaugagaacgaaaaagugguccucaagaauuaucaggacaugguggucgaggguugcggcugucgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2067 - RNA, 1444 nt, Artificial Sequence
  mRNA product Design1 comprising derived and/or modified sequence from Homo sapiens__NP_001193.2__HsBMP4 (opt7)
gggagaaagcuuaccaugauccccggcaacaggaugcugauggugguccuccugugccagguguugcucgggggugccagccacgcaucccugauuccagagaccggcaagaaaaagguagccgaaauccaagggcaugcgggcggucggcgcagugggcagagccacgagcuguugagggacuucgaagccacucugcuccagauguuuggccugcggcgcaggccgcagcccuccaaaagugcagugauuccagauuacaugcgggaccuguaucgccuccaaagcggcgaggaagaggaggaacagauccauuccaccgggcuggaguaccccgaaaggccagccagccgggcaaauacgguccgcuccuuccaccaugaggagcacuuggaaaacauucccgguaccagugagaauagcgccuuuagguuccuguuuaaccucuccagcaucccagaaaaugaggugaucaguuccgcggaacugcggcuguuccgcgaacagguggaucagggcccggacugggagaggggguuucaccggauuaacaucuaugaggucaugaagcccccagccgaggugguacccggccauuugauuacucgccuccuggauaccaggcuggugcaccauaaugucacucggugggaaaccuucgacgugagcccagcagugcuccgcuggacgagggagaaacaacccaacuacggucuggccaucgaagucacucacuugcaccagacccggacucaucaggggcagcacgugaggauuucccgcagucugccgcaaggcagcggcaauugggcccagcuccggccccugcugguaaccuuugggcaugaugguaggggccacgcauugacccgccggaggcgcgccaagcgguccccaaagcaucacagccagagggcgcggaaaaagaacaaaaauugucgcaggcacagucucuauguggacuucuccgaugucggguggaacgacuggaucguggcacccccaggcuaccaagccuuuuauugccauggugauugucccuucccacuggccgaccaccugaauagcacgaaccaugcaauugugcagacucucgucaauagugugaacuccagcaucccgaaggccugcuguguacccaccgagcugagcgccaucuccauguuguaccuggaugaguacgacaaagugguccucaagaacuaucaggaaaugguggucgagggcugcgggugucggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2068 - RNA, 1759 nt, Artificial Sequence
  mRNA product Design1 comprising derived and/or modified sequence from Homo sapiens__NP_001709.1__HsBMP6 (opt7)
gggagaaagcuuaccaugcccggccuggggaggcgggcccaguggcucugcuggugguggggucuguuguguagcugcuguggcccaccgccccugcgcccaccccucccagcagccgcggccgcagccgcagggggccaacuguugggugacgggggcucccccggcaggaccgagcagccaccgcccaguccacagagcuccaguggguuccuguaccggcgccucaagacucaggagaaaagggaaaugcaaaaggaaauccugagcgugcugggucucccccaccggccacgcccccugcauggcuugcagcagccgcagcccccagcccugaggcaacaggaggaacagcagcaacagcagcaacucccccgcggggagccacccccaggccggcugaaauccgcgccgcuguuuauguuggaucucuauaacgcccugagcgcagacaaugaugaggacggugccuccgaaggggagaggcagcagaguuggccccacgaagccgcaagcuccagccagcggcgccaaccacccccaggcgccgcgcauccccugaacaggaagagucuccuggccccgggcuccgggagcgguggcgcauccccauugaccagugcccaggauagcgcauuccugaaugacgccgauauggucauguccuuugugaaccucguagaguacgacaaagaguucagcccccggcagcgccaccauaaggaauuuaaguucaaucugagucagauucccgagggggaaguggucacggccgcggaguuuaggaucuauaaagauugcgugaugggcuccuucaagaaccaaacuuuucugauuagcaucuaccagguguugcaggaacaccagcaccgggacagugaucucuuccugcuggacacccgcgucgugugggcauccgaggaggguuggcucgaauuugauauuaccgccacuagcaaucuguggguagugaccccacaacauaacaugggcuugcagcugagcgucgugacgagggacggggugcacguccauccccgggccgcaggccucguggggagggacgguccauaugauaaacagccguucaugguagccuucuuuaagguguccgagguccacgugcgcacuacccggagugcgagcuccaggcgccggcagcaaagcaggaaucgcaguacucagucccaggacguggcccgggucagcuccgcaagugauuacaacagcuccgaacugaaaaccgccuguaggaagcacgagcuguaugugagcuuccaagacuugggcuggcaggauuggaucaucgcacccaaaggguacgccgccaauuacugcgacggcgaauguaguuuuccacucaacgcacauaugaaugccaccaaccacgcgauuguacagacgcuggugcaucugaugaaucccgaguaugucccaaagcccugcugugccccgacuaagcucaacgcaaucuccgugcuguacuucgaugacaacagcaaugucauuuugaaaaaguaucggaacaugguggugcgcgccugcgguugccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2069 - RNA, 1513 nt, Artificial Sequence
  mRNA product Design1 comprising derived and/or modified sequence from Homo sapiens__NP_001710.1__HsBMP7 (opt7)
gggagaaagcuuaccaugcacgugaggagccugcgggccgcagcgccccauuccuucgucgcccucugggccccacuguuuuugcugcgcagugcacucgccgacuucagccuggauaacgaggugcacuccaguuuuauccauaggcgguugcgcagccaggaaaggcgggagaugcaacgcgaaauucuguccauccucggccugccgcacaggccccggccacaucugcaggggaagcacaauagcgcacccauguucaugcucgaccuguacaacgccauggcgguagaggaagguggcgggccaggcggucagggguuuuccuaucccuacaaagccguguucaguacccagggcccaccguuggcaagccugcaagauucccacuuucucacugacgccgauauggucaugagcuucgugaaucugguggagcaugacaaggaguuuuuccacccccgcuaucaucacagggaauuucgguucgaucugaguaaaauuccagagggcgaagccgucaccgcagccgaguuccgcaucuacaaggacuauauuagggagcgguuugauaacgaaacguuccgcaucuccguguaccagguauugcaggagcaccucgggagggaaagcgaccuguuucugcucgauucccggacucugugggcgagugaggaagguugguugguguucgacaucaccgccaccagcaaucauugggucgugaacccccgccacaaucugggccuccagcuguccguggagacucuggaugggcaaagcauuaacccaaaauuggcaggccucaucgguaggcaugggccccagaauaagcagccguuuauggucgccuucuuuaaggcaaccgaggugcacuuccggaguauuagguccacgggcagcaaacagcgcagucaaaaccgguccaagacucccaaaaaucaggaagcccugaggauggccaacguagcggagaauagcagcuccgaccagcgccaagcaugcaagaaacaugaacuguaugugaguuuucgggaccucggcuggcaggauuggaucauugccccagagggguacgccgcauacuauugugaaggugagugcgccuucccccugaacagcuacaugaaugcgaccaaccacgccaucguccagacuuuggugcacuuuauuaacccagagaccgugcccaagccauguugcgcaccgacccagcugaaugccaucuccguccucuauuucgacgauagcaguaacgugauccugaaaaaguacaggaauaugguagugcgcgcauguggcugccauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2070 - RNA, 517 nt, Artificial Sequence
  mRNA product Design1 comprising derived and/or modified sequence from Homo sapiens__NP_006264.2__HsCCL7 (opt7)
gggagaaagcuuaccaugaaggccagcgcagcccugcucugccuguugcugaccgcggccgcauucaguccccagggccucgcccaaccaguggggaucaacacuuccaccacguguugcuacagguuuauuaauaaaaagaucccgaaacagcggcuggagagcuaucgcaggacuaccuccagucacuguccccgggaagcagucauuuucaagaccaaauuggacaaggagaucugcgccgauccaacucagaagugggugcaggacuuuaugaaacaucuggauaagaaaacccaaacgcccaagcucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2071 - RNA, 3841 nt, Artificial Sequence
  mRNA product Design1 comprising derived and/or modified sequence from Homo sapiens__NP_001954.2__HsEGF (opt7)
gggagaaagcuuaccaugcugcucacccugaucauuuugcugcccguggucagcaaguucuccuuugugagucucagcgccccacagcacugguccugcccggagggcacucuggcagggaacgguaauaguaccuguguaggccccgccccauucuugaucuuuagccaugggaacuccauuuucaggaucgacacggaaggcacuaauuacgagcaacugguggucgacgcgggugugagcgugauuauggacuuucacuauaacgaaaaacggaucuacugggucgaucucgagcgccagcugcugcagaggguguuccucaaugggucccggcaggaacgcguaugcaacaucgagaagaaugugaguggcauggccauuaacuggaucaaugaggaagucauuuggagcaaccaacaggagggcaucauuaccgugaccgacaugaaagggaauaacucccauauccuguugagcgcacugaaguaucccgccaauguggcagucgauccaguggaaagguuuauuuucuggaguuccgagguagccgguagccucuaccgggcggaccuggauggcgugggggucaaagcccuguuggagacuuccgaaaagaucaccgcagugagucucgacgugcuggauaagcgccuguuuuggauccaguauaacagggagggcagcaauucccucauuuguagcugcgacuacgauggugggaguguccacaucuccaaacaucccacgcagcacaaccuguucgccaugagcuuguuuggcgaccggauuuucuauaguacuuggaagaugaaaaccaucuggauugccaacaagcacacuggcaaagauauggugcgcaucaaucugcauuccagcuucguaccacucggggaacugaaggugguccacccgcuggcacaacccaaagccgaggacgacaccugggaaccagagcagaaguuguguaagcucaggaaagguaacugcagcuccaccguguguggccaggaucugcagagucaucugugcaugugugcggagggguacgcccucagccgggaccgcaaguacugcgaagaugucaaugagugcgcauuuuggaaccacggcuguacgcuggguugcaaaaauacucccggcuccuauuacuguaccugcccagugggguucguguugcugcccgacggcaagaggugucaccaacucguaagcugcccgcggaacgugagugaauguucccaugauugcguccugacuagcgaggggccccuguguuuuugcccagaagguuccguguuggagcgcgacggcaaaaccugcaguggguguagcucccccgauaauggcgguugcagccagcucugugucccacugagucccguguccugggagugcgacuguuucccaggcuaugaucugcagcucgacgaaaagagcugcgccgcauccgggccgcaacccuuucuguuguucgccaacagucaggauaucaggcacaugcauuuugacggcaccgacuacgggacucugcucagccagcagaugggcaugguguaugcccuggaucacgacccaguagagaauaagauuuacuucgcgcauacggcacugaaauggaucgaacgggccaacauggaugguucccaacgcgagagguugauugaagaggggguggacguccccgagggccuggccguggauuggaucggucggagguuuuauuggaccgaccgcggcaagagccucauugggcggagugaucugaauggcaaaagguccaagaucaucacuaaagaaaacauuagccagccacgcgggaucgcaguccaccccauggccaagcggcuguucuggaccgacaccggcauuaauccgaggaucgaguccagcagucuccaggguuuggggcgccuggugauugcgagcuccgaucucaucuggccaaguggcauuacuaucgacuuucugacggauaagcuguacuggugugacgccaaacagagcgugaucgaaauggcaaacuuggauggcuccaagcggaggcggcugacccaaaaugacguagggcaccccuucgccgucgcaguguuugaggacuacgugugguucagcgauugggccaugcccuccgucaugcgcgugaacaaaaggacugguaaggaccgggugcgccuccagggcaguaugcugaaaccaagcucccucguagucgugcauccccuggccaagccaggggcagauccgugcuuguaucagaacggcgguugugagcacauuugcaagaaaaggcuggggaccgccugguguaguugccgggaaggcuucaugaaggcgagcgacggcaaaaccugccuggcccucgaugggcaucagcuguuggccgguggcgagguggaccugaagaaucaagucacuccccucgauauccuguccaaaacgcgcgugagcgaagacaacauuaccgagagucagcacaugcucguagcagaaaucaugguguccgaucaggacgauugugccccagucgggugcagcauguacgcaagguguauuuccgagggcgaggacgcgacuugccagugucugaaggguuuugccggggacggcaaauugugcagcgauaucgacgaaugugagaugggcgugcccgugugcccacccgcaaguuccaaguguaucaauaccgaaggggguuaugucugccggugcagcgagggcuaccaaggggauggcauucacugucuggacaucgaugaaugccagcugggugagcauaguuguggggagaacgccuccugcacuaauaccgaaggcggcuauacguguaugugcgccgggaggcucagcgagccgggucugauuuguccagacuccacucccccaccccacuugcgcgaagaugaccaucacuacagcgugcggaacagugauagcgagugcccgcugucccaugacggcuauugucuccacgaugggguaugcauguacaucgaagcacuggacaaguacgccugcaauuguguggucggcuauauuggugagaggugccaguaccgcgaucugaaauggugggagcuccggcacgcgggccaugggcaacagcagaaggugaucguggucgccguguguguagugguccuggugauguugcugcuccugaguuuguggggcgcacacuauuacaggacccagaaacugcucagcaagaaccccaaaaauccauaugaagaguccagccgcgacgugcgguccaggcgccccgccgacaccgaagaugggaugaguagcugcccacaacccugguucgucgugaucaaggagcaucaggaccugaagaacgguggccagccaguagccggggaggauggccaggcagccgacgguuccaugcaaccgacuagcuggcggcaggaaccccagcuguguggcauggggaccgagcagggcugcuggauuccagugaguuccgauaaagggagcuguccccaagucauggaaagguccuuucacaugccaaguuacgguacgcagacccucgagggcgggguggaaaagccccacagccuguuguccgcgaauccgcuguggcagcaacgcgcccucgaucccccacaucagauggagcugacucagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2072 - RNA, 727 nt, Artificial Sequence
  mRNA product Design1 comprising derived and/or modified sequence from Homo sapiens__NP_001423.1__HsEREG (opt7)
gggagaaagcuuaccaugaccgccggcaggcggauggagaugcugugcgcagggcgcgugcccgcccuccuguugugccuggguuuccaccuccugcaggcggucuugagcacuaccgugaucccauccugcauuccgggcgaaaguagcgacaacuguacggcccugguacaaacugaggauaaucccaggguggcacaggucuccaucaccaagugcaguagcgacaugaacggguacugucuccauggccagugcauuuaucugguggauaugucccagaauuacugucggugcgaaguggguuauaccgggguccgcugugagcacuuuuuccugacugugcaucaaccacucagcaaagaauacguagcccugaccgugaucuugauuauccuguuucucaucacggucgugggcuccacuuauuacuucuguaggugguaucggaaccgcaagaguaaagagcccaagaaagaguacgaaagggugaccagcggcgacccagagcugccccaggucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2073 - RNA, 685 nt, Artificial Sequence
  mRNA product Design1 comprising derived and/or modified sequence from Homo sapiens__NP_000791.1__HsFGF1 (opt7)
gggagaaagcuuaccauggccgagggcgaaaucaccacuuucaccgcacugacggagaaguuuaaccugcccccagggaauuacaaaaagccgaaacucuuguauugcagcaacgguggccacuuccugaggauucuccccgacgggacuguggauggcacccgggaccgcuccgaucagcauauccaacugcaguugagugccgaaagcgucggugagguguacauuaaguccaccgaaacugggcaguaucuggcgauggacaccgauggccuccuguacggcagucagacgccaaaugaggagugucuguuucucgaaaggcuggaggaaaaccacuauaauacuuacaucagcaaaaagcaugccgagaagaacugguucguaggguugaaaaagaaugguuccugcaaacggggcccccgcacccacuaugggcaaaaggcaauucuguuucucccacugcccgugagcuccgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2074 - RNA, 1084 nt, Artificial Sequence
  mRNA product Design1 comprising derived and/or modified sequence from Homo sapiens__NP_001997.5__HsFGF2 (opt7)
gggagaaagcuuaccauggugggcgucggggguggcgacguggaggauguaacccccaggccagggggcugccagaucagcggucgcggggcccggggcuguaacggcauuccgggggcagccgcgugggaagccgcacugcccaggcggcgcccaaggcggcaccccuccgugaauccacgcaguagggccgcagguagcccccggacucgcggcaggcggaccgaggaacgcccauccgggaguaggcucggcgaccggggucgcgggagggcccugccgggcggccgguugggugggcgcggcagggggcgggcgcccgagagggucggcggucgcggccgggggaggggcacggccgcaccacgcgccgcccccgcagcccgggggagcaggccaggucccgcgggcacuauggccgcaggguccaucaccacccugccggcccuccccgaagauggcgguagcggcgcauucccacccgggcauuuuaaggacccaaaacgccuguacugcaagaacggcggguucuuuuugcggauucaccccgauggcaggguggacggugugcgggagaaauccgauccacauaucaagcugcaacuccaggccgaggaacgcggggucgugaguauuaaaggcguaugugccaauagguaucuggcgaugaaggaggacggucggcugcucgcaagcaagugcgugacugaugaauguuucuuuuucgagcgccuggaguccaacaauuacaacaccuauaggagccggaaauacacgaguugguaugucgccuugaagcgcacuggccaguacaaacugggguccaagaccggcccggggcagaaagccauccucuuucugcccaugagcgcaaaguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2075 - RNA, 802 nt, Artificial Sequence
  mRNA product Design1 comprising derived and/or modified sequence from Homo sapiens__NP_002000.1__HsFGF7 (opt7)
gggagaaagcuuaccaugcacaaguggauccugaccuggauucuccccacucuguuguacaggagcugcuuccauaucauuugucuggugggcaccaucucccucgccugcaacgacaugacgccagagcagauggcaacuaaugucaacuguaguagcccggaacggcacacccgcuccuaugauuacauggaagggggugacauuagggugcggcgccuguuuugcaggacccaaugguauuugcggaucgauaaacgcggcaagguaaaagggacucaggagaugaagaauaacuacaauaucauggagauuaggaccguggccgucggcaucguggcgauuaaagguguggaaagugaguucuaucuggccaugaacaaggaggggaagcucuacgccaaaaaggaauguaaugaggacugcaacuuuaaagaacugauccuggagaaucauuauaacacguacgcaagcgcaaaguggacucacaauggcggcgagauguucgucgcccucaaccagaaagggauucccgugcgggguaagaaaaccaagaaggaacagaaaacugcgcauuuucugccaauggccaucaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2076 - RNA, 844 nt, Artificial Sequence
  mRNA product Design1 comprising derived and/or modified sequence from Homo sapiens__NP_001936.1__HsHBEGF (opt7)
gggagaaagcuuaccaugaagcugcuccccagcgugguccugaaauuguuccuggccgcagugcucuccgcccugguaaccggcgagaguuuggaaaggcugcggcgcgggcucgcggccgguacuagcaacccagacccgcccaccguguccacggaucagcugcugccacucggcgggggcagggaccggaagguccgcgaucugcaagaggcagacuuggaucugcucagggugacucugaguagcaaaccccaggcccuggcaaccccaaauaaggaggaacacgguaaacggaagaagaaagggaagggcuugggcaaaaagcgcgaccccugccucaggaaauacaaggauuuuuguauccauggggaaugcaaauaugugaaggagcugcgggccccauccuguauuugccacccggguuaccauggcgagcgcugucacgggcugagccuccccgucgaaaacaggcuguauaccuacgaccauacuaccaucuuggcggugguagccgugguccuguccagugugugccuccuggugauugucggccuguugauguuccgguaucaccgcagggguggguacgauguggagaaugaagagaagguaaaacucggcaugacgaacagccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2077 - RNA, 2404 nt, Artificial Sequence
  mRNA product Design1 comprising derived and/or modified sequence from Homo sapiens__NP_000592.3__HsHGF (opt7)
gggagaaagcuuaccaugugggugaccaagcugcuccccgcccuguugcugcagcacguccuccugcauuugcugcuccugccaaucgcaauuccguacgccgagggccaaaggaaacggcgcaacacuauccacgaauuuaagaaaagcgcgaagaccacgcugauuaaaaucgaccccgcccucaagauuaagacuaaaaaggugaauaccgcagaucagugcgccaacagguguacccggaauaaagggcugccauucacuugcaaggcauucguauuugacaaagcccgcaagcaguguuugugguuccccuuuaacuccaugaguagcggugugaaaaaggaguucggccaugaauuugaucuguaugagaauaaggacuacaucaggaacugcaucauugggaaaggccgguccuauaaggguaccgucaguaucacgaaaagcgggauuaagugucagccaugguccagcaugaucccccacgaacauuccuuccucccaaguagcuaccgcggcaaagaucugcaagagaauuauugcaggaacccgcggggcgaggaagggggucccugguguuuuacuuccaauccagaggugcgcuacgaagugugcgacauuccccaguguagcgaggucgagugcaugaccugcaacggcgaaaguuauagggggcugauggaucacacugaguccggcaagaucugucagcggugggaccaccagaccccacaucgccacaaguucuugcccgaaagguacccggauaaagguuuugacgauaauuacugccggaaccccgacgggcaaccacgccccugguguuauacccucgauccacauacgaggugggaguacugcgcgauuaagacuugugccgacaauaccaugaacgacacugaugugccccuggaaaccaccgagugcauccagggccagggcgagggguaucgggguacuguaaauacgaucuggaacggcauuccaugucagcgcugggacagccaauacccgcacgaacacgauaugacccccgagaacuucaaaugcaaggaccugagggaaaauuauugucggaacccagauggguccgagagucccuggugcuucacuaccgacccaaauaucagggugggcuacugcagccagauucccaacugugauaugucccauggucaggacugcuaucgcggcaaugggaaaaacuacaugggcaaucucagccaaacccggagugggcugacuuguuccaugugggauaagaacauggaagacuugcacaggcauaucuuuugggagccggaugcaagcaagcugaaugagaacuacugccgcaauccagacgacgaugcccacggucccugguguuauacgggcaacccccucauuccaugggacuacugccccaucagucggugugaaggggauaccacuccaaccaucgucaaucuggaccauccggugauuuccugcgccaaaaccaagcagcugaggguggucaacggcauccccacucgcacgaauauugguuggauggugagcuugcgguauaggaacaaacacaucuguggcgggagccucauuaaggaguccuggguacugaccgcacggcagugcuucccaagucgcgaucugaaagacuacgaagccuggcucggcauccacgaugugcaugggaggggcgacgagaaguguaagcagguccugaacgugagccaauugguguauggucccgaaggguccgaucugguccucaugaaacuggcgcggccagccgugcuggacgauuuuguaagcacuaucgacuugcccaauuacggcugcaccauuccggagaagaccaguugcuccguguaugguuggggcuacacugggcucaucaacuacgauggccugcugcgcgucgcacaccucuauauuauggggaaugagaaauguagccagcaucacaggggcaaggugacgcugaacgaauccgagaucugcgccggugcagagaaaauugggaguggcccaugugaaggcgacuacgggggucccuuggucugcgagcagcacaagaugcggauggugcugggcgugaucguaccagggcgcggcugugccauucccaauaggccggguaucuucgugcgggucgccuauuacgcgaaauggauccauaagauuauccucaccuauaaggugccccagagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2078 - RNA, 2143 nt, Artificial Sequence
  mRNA product Design1 comprising derived and/or modified sequence from Homo sapiens__NP_005336.3 __HsHSPA1A (opt7)
gggagaaagcuuaccauggccaaggcagccgcgaucggcauugaccuggggaccacuuacagcugcgugggugucuuccagcacggcaaaguggagaucauugccaacgaucaagggaauaggaccacgcccuccuauguagcauuuacugacaccgaacggcucaucggcgaugccgcaaagaaccagguggcccugaauccacagaacaccgucuucgacgcgaaacgcuugauugguaggaaguuuggggauccgguggugcagagugacaugaaacauuggcccuuccaagucaucaaugauggcgacaagccaaaggugcagguaagcuacaaaggcgagacuaaggccuuuuaucccgaagagaucuccaguauggugcugaccaaaaugaaggaaauugcagaggccuaccucggguauccagucacgaacgccgugaucacugugcccgcauacuucaaugauagccagcggcaggccaccaaagacgcgggugucauugccggccugaacguguugcgcaucauuaaugagccaacugcagccgcaaucgccuaugggcuggauaggaccggcaagggugaacggaacguacucauuuuugaccucgggggcggcaccuucgauguguccauccugacgaucgacgacgggauuuuugaggucaaagccacugcgggugauacccaccugggcggggaagacuucgauaaucgccuggugaaccauuuuguggaggaguucaagaggaagcacaaaaaggacaucagccaaaauaaacgggcaguccgcagguugcggacugccugugaacgcgccaagaggacccuguccaguagcacccaggcaucccucgagauugauagccuguucgaaggcaucgacuuuuacacuagcauuacgcgggcccgcuucgaggaacugugcuccgauuuguuuaggagcacccucgagccgguggagaaagcgcugcgggacgccaagcuggauaaggcacagauccaugaccucguacugguggguggcuccacucgcauccccaaaguccagaaguugcugcaagauuucuuuaacgggagggaccucaauaaaaguauuaacccagacgaagccguggcauacggcgccgccguccaggcagccauccugaugggggauaagagcgagaacgugcaggaccuguugcuccuggauguggcgccccugucccucggucuggaaaccgccggcgggguaaugaccgcauugauuaaacggaauagcacuaucccaacgaagcaaacccagauuuucacuaccuauagugacaaccagcccggcgugcugauccaggucuacgagggugaaagggccaugaccaaggauaauaaccuccugggccgcuuugagcuguccgggaucccgcccgccccacggggcgugccccaaauugaggucacuuucgacaucgaugcaaaugggauuuugaacgugacggcgaccgacaaaagcacuggcaaggccaauaaaaucaccauuacuaacgauaaggguaggcucaguaaagaagagaucgaacgcauggugcaggaggcagaaaaguauaaggccgaggacgagguacagcgggaaaggguguccgccaaaaaugcacuggagagcuacgccuuuaacaugaagagugcggucgaagaugaggggcugaaaggcaagauuuccgaggccgacaaaaagaaagugcucgauaagugucaggaagucaucaguuggcuggacgcaaauaccuuggccgagaaggacgaguucgaacacaaacgcaaggaacuggagcaagugugcaacccaaucauuagcggucucuaucagggcgccgggggccccgggccaggcgguuuuggggcacagggcccgaaaggcggguccgguagcggccccacgaucgaggaaguggauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2079 - RNA, 2143 nt, Artificial Sequence; identical to SEQ ID NO: 2078
  mRNA product Design1 comprising derived and/or modified sequence from Homo sapiens__NP_005337.2 __HsHSPA1B (opt7)

SEQ ID NO: 2080 - RNA, 2143 nt, Artificial Sequence
  mRNA product Design1 comprising derived and/or modified sequence from Homo sapiens__NP_005518.3 __HsHSPA1L (opt7)
gggagaaagcuuaccauggccaccgcaaagggcaucgccauugggaucgaccuggguacuaccuacagcugcgugggcgucuuccagcacgggaaaguggagauuaucgcgaacgaucaaggcaauaggacgacucccuccuauguagccuuuaccgacaccgaacggcucauuggugaugcagccaagaaccagguggcaaugaauccacagaacacugucuucgacgccaaacgccugaucgggaggaaguuuaaugauccgguggugcaggcggacaugaaauuguggcccuuccaagucaucaacgagggcggcaagccaaaggugcugguaaguuacaaaggggaaaauaaggccuuuuaucccgaggaaauuagcuccauggugcucaccaaacugaaggagacggcagaggccuucuugggucauccagucacuaacgccgugaucaccgugcccgcauacuuuaaugauagucagcggcaggccacuaaagacgcgggcgucauugccgggcugaacgugcuccgcaucauuaaugaaccaaccgcagccgcaaucgccuauggccuggauaagggugggcagggcgagaggcacguacugauuuucgaccucggcggggguaccuuugaugugagcauccugacgaucgacgauggcauuuucgaagucaaagccacugcgggggacacccauuugggcggugaggacuuugauaaccggcuggugucccacuucguggaggaguucaagcgcaagcauaaaaaggacaucagccaaaauaaaagggcaguccggcgccucaggacugccugugagcgggccaagcgcacccuguccaguagcacccaggcaaaccuggaaauugauuccuuguacgagggcaucgacuuuuauacuagcauuacgagggcccgguucgaagaacucugcgcggaucuguuucgcgggacccuggagccgguggaaaaagcccucagggacgcaaagauggauaaggccaaaauccacgacaucguacuggugggcgggaguacucggauucccaagguccagcgcuugcugcaggauuacuucaaugguagggaccucaacaaauccaucaacccagaugaggcaguggccuacggcgccgcaguccaagccgcgauucugaugggggacaagagcgaaaaagugcaggaccuguugcuccuggauguggcaccccugucccucggccuggagaccgccgguggcguaaugaccgccuugaucaagcggaauaguacuauuccaacgaagcagacccaaaucuuuacuaccuauagcgacaaccagcccggggugcugauccaggucuacgaaggcgagagggccaugaccaaagauaauaaccuccuggggcgcuucgaccugacuggcauuccgcccgcaccacggggugugccccagaucgaggucacguuugauauugacgcgaaugggaucuugaacgugaccgccacugauaaguccaccggcaaagugaauaagauuacuaucaccaacgacaaagguaggcucagcaaggaagagauugaacgcaugguacuggaugcagagaaguauaaagccgaagacgaggugcaacgggagaagaucgccgccaaaaaugcacuggaaaguuacgcguucaacaugaaguccgucgugagcgaugagggccucaaagggaagaucagugaauccgacaaaaauaagauucuggauaaguguaacgaguugcugagcuggcucgaggucaaucagcuggccgaaaaagacgaguuugaccacaagaggaaagaacuggagcagaugugcaacccaaucauuacgaaguuguaucagggcggguguaccggccccgcaugcgguacuggguacgugccaggccgcccggccaccggccccacuaucgaagagguggauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2081 - RNA, 2137 nt, Artificial Sequence
  mRNA product Design1 comprising derived and/or modified sequence from Homo sapiens__NP_068814.2 __HsHSPA2 (opt7)
gggagaaagcuuaccaugagcgccaggggccccgcaaucgggauugaccuggguaccacuuacuccugcgugggcgucuuccagcacgggaagguggagaucauugccaacgaucagggcaaucggaccacgccaaguuauguagcguuuacugacaccgaacgccucaucggugaugccgccaaaaaccagguggcaaugaauccgaccaacacuauuuucgacgcaaagaggcugaucgggcggaaauuugaggaugccaccguccagagcgacaugaagcauuggcccuuccgcgugguguccgaaggcggcaaaccaaagguccagguggaguacaagggggaaacgaaaaccuuuuuccccgaggagaucaguagcaugguauugacuaagaugaaagaaauugcggaggccuaucuggguggcaaggugcacuccgcagucaucacugugccagccuacuuuaaugauagccaaaggcaggccaccaaagacgcagggaccauuacgggccucaacgugcugcggaucauuaaugaacccacugccgcggccaucgcauaugguuuggauaagaaagggugugccggcggcgagaagaacguccugauuuucgaccucggggguggcaccuuugauguguccauccugacuaucgaggacgggauuuucgaaguaaagaguaccgcaggcgauacccaucuggguggcgaggacuuugacaaucgcauggugagccaccucgccgaagaguucaaaaggaagcauaaaaaggauaucgggccaaacaaacgggccguccgcaggcugcggacugcgugcgaacgcgcaaagaggacguuguccagcaguacccaggccuccauugagaucgacagccuguacgagggcguggauuucuauacuuccauuacccgggcccgcuuugaggaacucaaugcagaccuguucagggggacccuggaaccgguggagaaggccuugcgggaugcgaaacucgacaagggucagauccaagaaaucguccuggugggcgggaguacucgcauucccaaaauccagaagcugcuccaggacuuuuucaacggcaaagagcugaauaagagcauuaacccagaugaggccguagcauacggugccgcagugcaggccgccaucuugauuggcgauaaguccgaaaauguccaagaccugcuccugcuggaugugacgcccuugagccucgggaucgagaccgcaggcggggucaugacuccacugaucaaaaggaacaccaccauucccacuaagcagacgcagaccuuuacuaccuacagugacaaccaauccagcgugcuggugcagguauaugaaggcgagcgggccaugacuaaagacaauaaccuccuggguaaguucgauuugaccgggaucccgcccgcgccaaggggcgugccccagauugaagucacguuugacaucgaugccaaugguauucugaacgugaccgcagccgacaaaaguacuggcaaggagaauaagaucaccauuacuaacgauaaagggcgccucuccaaggacgauaucgaccggaugguccaggaggccgaaagguacaaaagcgaggaugaagcaaaucgcgaccggguggcggccaagaacgcacuggagagcuauaccuacaauaucaaacaaacgguggaggaugaaaagcugaggggcaaaauuuccgagcaggacaagaacaagaucuuggauaaaugucaggaaguaauuaauuggcucgaccgcaaccagauggccgagaaggacgaauaugagcacaaacaaaaggagcuggaacgggugugcaauccaaucauuaguaaacuguaccaagggggccccggugggggcagcggcggggguggcuccggggccagcggcgguccaaccaucgaggaagucgauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2082 - RNA, 2740 nt, Artificial Sequence
  mRNA product Design1 comprising derived and/or modified sequence from Homo sapiens__NP_002145.3 __HsHSPA4 (opt7)
gggagaaagcuuaccaugagcguggucggcaucgaccugggguuccaguccugcuacguggccguagcaagggccgguggcauugagaccaucgcgaacgaauauagugaucgguguacucccgccugcauuagcuuugggccaaagaaucgcuccaucggcgcagccgcaaaaagucaagugauuagcaacgccaagaauaccguccaggguuucaaaagguuucacgggcgggcguucuccgacccguuuguggaggccgaaaagagcaaccucgcauacgauaucgugcagcugcccacgggcuugacuggcaucaaagucaccuauauggaggaagaacgcaauuucaccacugaacaggugaccgccaugcugcucuccaagcugaaggaaacggccgagaguguauugaaaaagccaguggucgacuguguggugagcguccccugcuuuuacacugaugcagaaaggcgguccgugauggacgccacccaaauugcggggcugaacugucuccgccugaugaaugagacuaccgccguagcacuggccuaugguaucuacaaacaggaucucccagcacuggaggaaaagcccaggaacguggucuucguggacaugggccauagcgccuaucaggugagugucugcgccuuuaaucgggggaaauugaaggugcuggcgaccgcauucgauacgacucucggcggucgcaaauuugacgagguacuggugaaccacuucugugaagaguucgggaagaaguacaaacuggauauuaaguccaaaaucagggccuugcuccggcugagccaggaaugcgagaagcugaaaaagcucauguccgccaaugcaagugaccugccauugagcauugaguguuuuaugaacgaugucgacguguccggcaccaugaaucgcggcaaguuccuggaaaugugcaacgaccuccuggccagggucgagccgccccugcggagcguguuggaacaaacuaaacucaagaaagaggauaucuacgcgguggaaauuguagggggugccacccgcaucccagcagugaaggagaaaaucaguaaguuuuucggcaaggagcuguccaccacucugaaugccgacgaagcagucacgagggggugcgcccuccagugugccauucugagccccgcauuuaaagugcgggaguucaguaucaccgaugucgugccauaucccauuuccuugcgcuggaacagcccggccgaagagggcagcuccgacugcgaaguguuuaguaagaaccaugcggcccccuucagcaaaguacugacuuuuuacaggaaggagccauucacccucgaggcauauuacuccagcccccaggaucugccauaucccgacccagccaucgcccaguuuagugugcaaaaagucaccccgcaguccgaugguagcuccaguaaggugaaggucaaagugcgggugaauguacacggcauuuucagcgucuccagcgcaagucugguggaagugcauaaguccgaggaaaacgaggagcccauggaaacugaccagaaugcgaaagaggaagagaagaugcaagucgaucaggaggagccacacguggaggaacagcagcaacagacgcccgccgagaacaaagcagaaagcgaggaaauggagaccucccaggccgggaguaaggacaaaaagauggaucagccaccccaagccaagaaagcaaaggugaaaacuagcaccguagacuugccgaucgagaaucagcuccuguggcagaucgacagggaaaugcugaaccucuacauugagaaugaaggcaagaugaucaugcaggauaaacuggagaaggaacgcaacgacgccaagaaugcggucgaggaguauguguacgaaaugcgggauaaauuguccggggaguacgaaaaguuugugagcgaggacgauaggaacaguuucacccugaaacucgaggacacugaaaauuggcuguaugaggauggugaagaccaaccaaagcaggucuacguggauaaacuggccgaguugaagaaccugggccagcccauuaagauccgcuuccaggaauccgaggagcggcccaaacucuuugaggagcuggggaagcaaauucagcaguauaugaaaaucaucagcuccuucaagaauaaagaagaccaauacgaucaccucgacgcagccgauaugacgaagguagagaaaagcaccaacgaagccauggaguggaugaauaacaagcugaacuugcagaauaagcagagucugacuauggacccaguggucaaaagcaaggagauugaagcaaaaaucaaggagcucaccuccacuuguagucccauuaucagcaaaccaaagccgaagguggaacccccaaaagaggagcagaagaacgccgaacaaaauggccccguggacggucagggcgauaacccagggccccaggcggccgagcagggcaccgacacggcagucccguccgauagcgacaaaaagcugccagaaauggauauugacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2083 - RNA, 2737 nt, Artificial Sequence
  mRNA product Design1 comprising derived and/or modified sequence from Homo sapiens__NP_055093.2 __HsHSPA4L (opt7)
gggagaaagcuuaccaugagcguggucggcaucgaccugggguuccucaacugcuacauugccguggcaagguccgguggcaucgagaccauugccaaugaauauagugaucgguguacucccgcgugcaucagccuggggucccgcaccagggccauuggcaacgcagccaagagucagaucguaacgaaugugcggaacacuauccacgguuuuaaaaaguugcaugggcgcagcuucgacgauccaauuguccaaaccgagaggauccggcugccguacgaacuccagaaaaugcccaauggcuccgcaggcgugaaggugcgcuaucuggaggaagagaggccauuugccauugagcaggucaccgggauguugcuggcgaaacucaaggaaacuagcgagaacgcccugaagaaacccguggcagacuguguaaucuccauuccaaguuucuuuaccgaugccgaacggcgcagcgugauggccgcagcccaggucgcgggucugaauugccucaggcugaugaacgagacgacugccguggcauuggccuacggcaucuauaagcaagaccugcccccacucgaugagaaaccgcggaauguggucuucauugacauggggcacuccgcauaccaggugcugguaugugccuuuaacaagggcaaacugaagguguuggccaccacuuucgaucccuaucucggugggcgcaauuuugacgaagcgcuggucgauuacuucugcgacgaguuuaaaaccaaguacaagaucaacgugaaagaaaauagcagggcacugcuccggcuguaucaggagugugaaaaguugaaaaagcugaugagugccaacgccuccgaucucccacugaauaucgagugcuucaugaacgaccuggacgugagcuccaaaaugaaccgcgcacaguucgagcaauugugugccagucuccuggcgagggucgaacccccacugaaggccgugauggagcaggcaaaucuccagcgggaagauauuagcuccaucgagauuguaggcggcgccacccgcauccccgcagugaaggaacagauuacgaaauuuuuccugaaggacaucagcacuaccuugaacgccgaugaggccgucgcaagggggugcgcccugcaaugcgcgauccucaguccggccuuuaaagugcgggaguucuccauuacugaccugguccccuacagcaucacccugagguggaagaccaguuuugaagaugguuccggcgagugugaaguguucugcaaaaaucauccagcacccuuuagcaaggugauuacuuuccacaagaaagagccauuugaauuggaggccuucuauacgaaccuccaugagguacccuacccagacgcccgcaucgggagcuuuaccauucagaauguguucccgcaguccgauggcgacaguagcaaggucaaagugaagguccgggugaacauccacgguaucuuuuccguggcaagcgcgaguguaauugaaaaacaaaaucuggagggcgaucacuccgacgcccccauggaaacugagaccagcuucaagaacgagaauaaggauaacauggacaaaaugcaaguggaccaggaagaggggcaucagaagugucacgcagaacauaccccagaggaagagaucgaucacacuggcgccaaaacgaaguccgccgucagugacaaacaggauaggcugaaucagacccucaagaaagggaaggugaaguccauugaccugcccauccaguccagcuugugccgccagcugggucaagaucuccugaacaguuauauugagaaugaaggcaaaaugaucaugcaggacaagcuggagaaagaacggaacgaugcaaagaaugccgucgaggaauacguguaugacuucagggaucgcuuggggacuguguacgagaaauuuauuaccccagaggaccuguccaagcucagcgcgguacuggaagauaccgagaacuggcucuacgaagacggcgaggaucagcccaagcaggucuauguggacaaacugcaagaauugaagaaauacggucagccgauccagaugaaguauauggagcacgaggaacggccaaaagcccugaacgaccucggcaagaagauccagcuggugaugaaagucauugaggcauacaggaauaaggaugaacgguaugaccaucuggaucccacugagauggagaaaguggaaaaguguaucuccgacgccaugaguugguugaacagcaaaaugaaugcccaaaacaagcugucccucacgcaggaucccgugguaaaagucagcgagauuguggcaaagaguaaggaacuggacaauuucugcaacccaaucauuuacaaacccaagccaaaagccgaggugccggaagauaagcccaaagcgaauagcgagcacaacgggccaauggacggccagagcgggaccgagacuaaguccgauagcaccaaggacaguagccaacauacuaaauccaguggcgaaauggaggucgauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2084 - RNA, 2182 nt, Artificial Sequence
  mRNA product Design1 comprising derived and/or modified sequence from Homo sapiens__NP_005338.1__HsHSPA5 (opt7)
gggagaaagcuuaccaugaagcugagccucguggccgcaaugcuguugcugcucuccgccgcgagggccgaggaagaggacaaaaaggaagaugucggcaccgugguagggaucgaccuggguacuaccuacaguugcgugggcgucuucaaaaacgggcggguggagauuaucgcaaaugaucagggcaaccgcauuacgcccagcuauguggccuuuacuccagaaggugagagguugaucggggacgcagccaagaaucaacugaccuccaacccggagaauaccgucuucgaugcgaaacggcucauuggccgcacuuggaacgaccccagugugcagcaggauaucaaguuucugccauucaagguaguggagaaaaagaccaaacccuacauccaggucgacauuggcgggggucaaacgaagacuuuugccccagaagaaaucagcgcaauggugcugaccaaaaugaaggagacugccgaggccuaucucggcaaaaaggugacccacgcagucgugaccguacccgccuacuucaaugaugcgcagaggcaggccacgaaggacgcagggacuauugccggccugaacgugaugcggaucauuaaugaaccaaccgcagccgccaucgcguaugguuuggauaaacgcgagggggaaaagaacauucuggucuuugaccucggcggcgggacuuucgaugugucccugcugaccaucgacaaugguguguuugaggucguggcaaccaacggcgacacucaucucgggggcgaagauuucgaccagaggguaauggagcacuuuaucaaauuguacaagaaaaagacggguaaggaugugcggaaagacaaucgcgccguccaaaagcugaggcgggagguggaaaaagccaagcgcgcacugagcucccagcaucaggccaggauugagaucgaaaguuucuaugagggcgaagauuucagcgagacccucacucgggcgaaauuugaggaacugaacauggacuuguuccgcuccaccaugaagccgguccagaaggugcuggaggauagcgaccucaaaaagagugauauugacgaaaucgugcugguagggggcuccaccaggauucccaaaauccaacagcuggugaaggaguuuuucaaugggaaagaaccaagccgggguaucaaccccgaugaggccgucgcauacggcgccgcagugcaggccggggucuuguccggcgaccaagacacuggugaucucgugcugcuggacguguguccacucacgcugggcauugagaccguagggggcgugaugacuaaguugaucccccgcaacaccgucgugccgaccaagaaaagucagauuuuuagcacugccuccgauaaucagcccacggucaccaucaagguguacgaaggggagaggccacugacuaaagacaaccaccuccugggcaccuucgaucugacugguauucccccagcaccccggggcgugccacagaucgaaguaaccuuugagaucgacgucaaugggauuuugagggugacggccgaggauaaggguaccggcaacaaaaauaagaucacuauuaccaacgaccaaaaucgccucacuccggaagagaucgaacggauggugaacgaugcggagaaauucgccgaagaggacaagaagcugaaagagaggauugauacccgcaaugaacuggagagcuaugcauacagucucaagaaccagaucggggacaaagaaaagcugggcgggaaauuguccagcgaggauaaggaaacgauggagaaggccgucgaggagaaaauugaauggcuggaaagucaucaggacgccgacaucgaggauuuuaaggcgaaaaagaaagaacucgaggagaucgugcagcccauuaucuccaagcuguauggcagcgcagguccacccccaaccggggaagaggacacugccgaaaaggaugagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2085 - RNA, 2149 nt, Artificial Sequence
  mRNA product Design1 comprising derived and/or modified sequence from Homo sapiens__NP_002146.2__HsHSPA6 (opt7)
gggagaaagcuuaccaugcaggcccccagggagcuggcagugggcaucgaccucgggaccacuuacagcugcgucgguguguuccaacagggccggguagaaauucuggccaacgaucaggggaaucgcaccacgccauccuauguggcguuuacugacaccgagagguuggucggcgaugccgcaaagagucaggccgcacugaacccgcacaauaccguguucgacgccaaacggcucaucggucgcaaguuugcggauacuaccgugcaaagcgacaugaaacauuggcccuucagggucguguccgaagggggcaagccaaaaguacggguguguuaccgcggcgaggauaagacguuuuaucccgaagagauuaguagcaugguccuguccaagaugaaagagacugccgaagcauacuuggggcagccagugaagcacgccgugaucaccguccccgccuauuucaacgacagccagaggcaggcaacuaaagaugccggugcgauugccggccugaaugugcuccggaucaucaacgagccaaccgcagccgcaauugccuacgggcuggaccgcaggggcgccggugaacggaauguacugaucuuugaucucgggggcggcaccuucgacguguccguccugaguauugaugcggggguguuugaggugaaggcaacggccggugacacucauuugggcggggaggacuucgauaaccgccuggucaaucacuuuauggaagaguucaggcggaaacauggcaaggaccucagcgguaacaaacgcgcccugaggcggcugcgcaccgcaugcgaaagggccaagcggacuuuguccagcaguacccaagcgacccucgagaucgauucccuguucgaaggcguggacuuuuauacuagcauuacgagggcccgcuucgaggagcuguguuccgaucucuuucggaguacccuggaaccgguagagaaggcauugagggacgccaaacuggauaaggcacagauccacgacgugguccucgucgggggcagcacucgcauucccaaagugcagaagcugcugcaggauuucuuuaaugggaaagaauugaacaaguccaucaauccagacgaggccguggccuacggugcagccgugcaagcggccguacucaugggcgauaagugcgaaaaagugcaggaccugcugcuccuggacgucgcacccuugagccuggggcucgagaccgccggcggugugaugaccacucugauccagcggaacgccacgauuccaaccaagcaaacucagaccuucaccacuuacagugauaaucagcccggcgucuuuauccagguguaugagggggaaagggcaaugacgaaagacaacaaccuguugggccgcuucgagcucuccgggauuccgcccgcgccacggggcgugccccaaaucgaaguaaccuuugauauugacgccaaugguauccugagcgugacugcaaccgauaggaguacugggaaggccaacaaaaucaccauuacgaaugacaagggccggcuguccaaggaggaagucgagcgcauggugcacgaggccgaacaguacaaagcagaggaugaagcccagagggaccgggucgcggccaagaacagccucgaggcacauguguuccacgugaaagguagccugcaggaggaauccuugcgcgauaagaucccagaggaagacaggcggaaaaugcaagauaagugucgcgagguacuggccuggcucgaacauaaucagcuggccgagaaggaggaauaugagcaccagaaaagggaacuggagcagauuugccggcccaucuuuaguagguuguacggcgggccaggcguccccgggggcagcuccugugguacccaagcacgccagggggacccgagcacuggcccaauuaucgaagagguggauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2086 - RNA, 1321 nt, Artificial Sequence
  mRNA product Design1 comprising derived and/or modified sequence from Homo sapiens__P48741__HsHSPA7 (opt7)
gggagaaagcuuaccaugcaggcccccagggagcuggcagugggcaucgaccucgggaccacuuacagcugcgucgguguguuccaacagggccggguagaaauucuggccaacgaucaggggaaucgcaccacgccauccuauguggcguuuacugacaccgagagguuggucggcgaugccgcaaagagucaggccgcacugaacccgcacaauaccguguucgacgccaaacggcucaucggucgcaaguuugcggauacuaccgugcaaagcgacaugaaacauuggcccuuccaggucguguccgaagggggcaagccaaaaguaaggguguguuaccggggcgaggauaagacguuuuaucccgaagagauuaguagcaugguccuguccaagaugaaagagacugccgaagcauacuuggggcagccagugaagcacgccgugaucaccguccccacuuauuucagcaacucccagcgccaagccaccaaagacgcaggggccauugcgggccugaaggugcucccaaucaucaaugaggccaccgcagccgcaauugccuacgggcuggauaggcggggcgccgguaaacgcaacguacugaucuuugaccucgggggcggcacguucgaugugaguguccugagcauugacgcggggguguuugaagugaaggcaacugccggugauacccauuugggcggggaggacuucgacaauaggcuggucaaccacuuuauggaggaguuccggcgcaaacauggcaaggaucucuccgguaauaagagggcccugcggcgccugaggacugcaugcgagcgggccaaacgcaccccgagcaguuccacccaggcgacuuuggaaaucgacagccucuucgagggcguggauuuuuauaaguccauuacgagggcccgguucgaagaacuguguagugaccuguuuaggagcacccucgagcccguagaaaaagcacugcgcgaugccaaguuggacaaagcacagauccacgauuucgugcuggguggcgggcuccacucccauccacagggugccgaggucgccgcaggccugcugcaacggcagggggccgaacaggagcaccaacccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2087 - RNA, 2158 nt, Artificial Sequence
  mRNA product Design1 comprising derived and/or modified sequence from Homo sapiens__NP_006588.1 __HsHSPA8 (opt7)
gggagaaagcuuaccaugagcaagggccccgccguggggaucgaccuggguaccacuuacuccugcgucggcguguuccagcacgggaaaguagagauuaucgcaaacgaucaaggcaauaggaccacgccaaguuauguggccuuuacugacaccgaacggcucauuggugaugcggccaagaaccaggucgcaaugaauccgaccaacacuguguucgacgccaaacgccugaucgggaggcgguuugaugacgcagugguccagagcgauaugaagcauuggcccuucauggugguaaaugacgccggccgcccaaaagugcaggucgaguacaagggcgaaaccaaguccuuuuaucccgaggaagugaguagcaugguguugacgaaaaugaaggagauugcggaggccuaccuggggaaaacugucaccaacgcagugguaacugugccagccuauuucaaugauucccaaaggcaggccaccaaggacgcagguaccaucgccggccucaacguccugcggaucauuaaugaacccacggcggccgcaaucgccuacggguuggauaaaaaggugggcgcagagcgcaacgugcugauuuuugaccucggugggggcacuuucgaugucagcauccugaccauugaagacggcaucuuugaggugaaauccacugccggggacacccaccuggguggcgaggauuucgacaauaggaugguaaaccauuuuauugccgaauuuaagcggaagcacaaaaaggauaucagugagaauaaacgcgcggugaggcggcuccgcaccgcaugugaaagggccaagcggacucugagcuccagcacgcaggccaguaucgagauugacuccuuguaugaagggaucgauuucuacaccagcauuacucgcgcaagguuugaggagcugaacgccgaccucuuccggggcacccuggauccagucgaaaaagcgcugcgcgacgccaaguuggauaagucccagauccaugacauugugcucgucgguggcaguaccaggaucccgaaaauccaaaagcugcugcaggauuucuucaaugggaaagagcucaacaagagcauuaaccccgacgaagcaguggccuacggcgcagccgugcaggccgcaauccuguccggggacaaaagcgagaauguacaggauuugcugcuccuggacgugacuccacugaguuuggguauugaaacggccggcggggucaugaccgugcucaucaagcggaacacuaccauucccaccaagcaaacucagacguuuaccacuuauuccgauaaucagccaggcguccugauccaaguguacgagggugagagggcgaugaccaaagacaacaaucugcucggcaaguucgaacugacugggauucccccggcaccccgcggcgugccacagaucgagguaaccuuugauaucgacgccaacgggauuuugaaugugagcgccgucgauaaaaguacgggcaaggaaaacaaaaucaccauuacuaaugacaagggucggcuguccaaggaggauaucgaaaggauggugcaggaggccgagaaauauaaggcagaagacgagaaacagcgcgauaaggucagcagcaaaaacucccucgaaaguuacgcguucaauaugaaggccaccguggaggacgagaaacugcaagggaagauuaacgaugaagacaagcagaaaauccuggacaagugcaaugagaucauuaacugguuggauaaaaaucagacugcagaaaaggaggaauuugagcaccagcaaaaagagcucgaaaagguguguaaccccaucauuaccaagcuguaucagagcgccggcgguaugccaggcgggaugcccggcggguucccaggcgguggggccccgcccuccggcggcgcaagcagugggccaacgaucgaggaaguagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2088 - RNA, 2257 nt, Artificial Sequence
  mRNA product Design1 comprising derived and/or modified sequence from Homo sapiens__NP_004125.3 __HsHSPA9 (opt7)
gggagaaagcuuaccaugaucagcgccuccagggcagccgcggcccggcuggugggcgcagccgcaagucgcgggcccaccgccgcgaggcaccaggacagcuggaacggucucucccaugaggccuuccggcuggucagucgcagggauuacgcaagcgaagccauuaagggcgccgugguagggaucgacuugggcacuaccaauuccugcguggcagucauggaggguaaacaagccaaggugcuggaaaacgcggagggggcccggacgacuccaagcguggucgcauuuaccgccgauggcgaacgccucgugggcaugccggcaaaaaggcaggccguaaccaaucccaacaauacuuucuaugccaccaagcggcugauugggcgcagguacgacgauccagaggugcagaaagacaucaagaacguccccuuuaagauugugcgggcguccaauggugaugcauggguggaggcccacggcaaauuguauaguccaagccagaucggggccuucguccugaugaagaugaaagaaacggcagagaacuaccucggccauacugccaagaaugcggugaucaccguacccgccuauuuuaacgacucccaacgccaggcaacuaaagaugccggucagauuagcgggcugaaugugcugagggucaucaacgaaccaaccgcagccgcccucgcauacggccuggacaagagugaggauaaagugauugccguguaugacuugggcggggguaccuucgauaucuccauucuggagauccagaagggcgucuuugaaguaaagagcacgaauggggacacuuuccucggcggugaggacuuugaucaagcgcugcugcggcacauugugaaagaguucaagcgcgaaaccggcguggacuugacuaaagauaacauggcccuccagaggguccgggaagcagccgagaaggccaaaugugagcuguccaguagcgugcagaccgacaucaaucugccguaccucaccauggauuccagcgggcccaagcaucugaacaugaaguugacucgcgcacaguuugaaggcaucgucacggaccugauuaggcggaccaucgcgccaugccaaaaagccaugcaggaugcagaggugaguaaguccgacauuggggaagugauccucguagguggcaugacuaggaugcccaaagugcagcaaaccguccaggaucuguucgggcgcgccccaagcaaggccgugaaccccgacgaggcagucgccauuggcgcggccauccaggguggcgugcuggcaggggaugugaccgacguauugcuccuggacgugacuccgcugagucucggcaucgaaacgcugggcggggucuucaccaaauugauuaaucggaacacuaccauccccaccaagaagucccagguguuuagcacugccgccgauggucaaacgcaggucgagauuaaagugugucagggggagagggaaauggcaggcgacaauaagcugcucggucaguucacccugaucggcauuccacccgccccacgcggggugccccaaaucgagguaacuuuugauaucgacgcgaacggcauuguccacgugagcgccaaagauaaggggaccggccgggaacagcagaucgugauucaguccaguggugggcugagcaaagacgauaucgagaauauggucaagaacgcagaaaaguacgccgaggaggacaggcgcaaaaaggaacggguggaggcagugaauauggccgaaggcauuauccacgauacugagaccaaaauggaggaguucaaggaccaauugccagcggaugaaugcaacaaacucaaggaagagauuuccaaaaugagggaacugcuggcccggaaggacagcgagacgggcgagaauauccgccaggcagccaguucccuccagcaggccagccugaaguuguuugaaauggcauauaaaaagauggccuccgagagggaagggagugguagcuccggcaccggggagcaaaaagaagaucagaaggaggagaaacagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2089 - RNA, 2245 nt, Artificial Sequence
  mRNA product Design1 comprising derived and/or modified sequence from Homo sapiens__NP_079291.2__HsHSPA12A (opt7)
gggagaaagcuuaccauggccgacaaggaggcaggcgggagcgauggucccagggaaaccgccccaacuuccgcguacaguagcccggcccggucccugggcgacaccgggaucacgccccucaguccaagccacauugugaacgauacugacuccaaugucagcgagcagcaauccuuccuggugguaguggcagucgauuuuggcaccaccaguagcgguuaugccuacuccuucacuaaagaacccgagugcauccaugugaugaggcgcugggaagggggcgacccaggcgugagcaaccagaagacccccacgacuauuuugcugaccccagagcggaaauuucacaguuucggguaugcagcccgcgauuuuuaccaugaccucgauccgaaugaggcgaagcaguggcuguauuuggaaaaauucaagaugaagcugcacacuaccggugaccucaccauggauacggaccugacugccgcaaacggcaaaaaggucaaagcccuggagaucuuugccuacgcacuccaguauuucaaggaacaagcccugaaagaguuguccgaucaggcggggagcgaguuugaaaauuccgacgugagguggguaauuaccgugcccgccaucuggaagcagccagcaaaacaguucaugcggcaagccgcauaccaggccggccuggccagucccgagaacagcgaacagcucaucauugcgcuggagccagaagcagccuccaucuacugucgcaagcugagguugcaucagaugauugagcucagcaguaaggccgcagucaaugguuauuccgggagcgacacugugggcgccggcuuuacccaagcgaaagagcacauccggcgcaacaggcagagucggaccuuccugguggaaaaugucauuggggagaucugguccgaacuggaggaaggugauaaguacgugguaguggacagcggcgggggcacugucgaucucacggugcaccagauucgccugcccgagggucauuugaaagagcuguauaaggccaccggcgggccguacggcagccucgggguggacuaugaguucgaaaaacugcuguacaagaucuuuggugaagauuucaucgagcaauuuaagauuaaaaggcccgcagccugggucgacuugaugaucgcauucgaaucccggaagcgcgccgccgcaccagauaggacuaacccccucaauauuacccugccauuuaguuucaucgacuauuacaaaaaguuucggggccacagcguggagcaugcccugcgcaaauccaacguagauuucgugaaguggagcagucaggggaugcucaggaugucccccgacgcgaugaaugcccuguuuaagccaaccauugauagcaucaucgagcacuugcgggaccuguuccagaaaccggaagucuccacugugaaguuucucuuccuggucggcgguuuugcagaggcaccccuguugcagcaagccgugcaggccgcguucggcgaccagugcaggauuaucauuccacaggauguggggcucacgauccugaaaggcgccguacuguucgggcucgaccccgcagugauuaagguccgccggaguccacugaccuacggcgugggugucuugaacagguauguggaagggaaacaucccccggagaagcugcucgugaaggauggcacucgcugguguaccgacguauuugauaaauucaucagcgccgaccaauccguggcccugggugagcuggucaagcggagcuacaccccagcaaaacccagucaguuggugaucgucauuaauaucuauuccagcgaacacgauaacguguccuuuauuacugaccccggcgugaagaaaugcgggacgcugaggcucgaucugaccggcaccagugggacugccguaccagcgcgccgggagauccagacucucaugcaguucggcgacaccgaaauuaaggccacggcaaucgauauugccaccagcaaauccgucaagguggguaucgacuuucugaacuacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2090 - RNA, 2278 nt, Artificial Sequence
  mRNA product Design1 comprising derived and/or modified sequence from Homo sapiens__NP_443202.3 __HsHSPA12B (opt7)
gggagaaagcuuaccaugcuggccgugcccgagaugggccuccaggggcuguacaucgguagcuccccagaaaggaguccgguccccagcccacccggcuccccacggacccaagagaguugcgggauugcacccuugacuccaagccaguccccgaagcccgaagugcgcgccccacagcaggcgagcuucuccguaguggucgccaucgacuuuggcaccacgaguagcgguuaugcauucuccuuugccagcgaucccgaggcaauucacaugaugaggaaaugggaagggggcgacccaggcguggcccaucaaaagacucccaccugucugcuccugaccccggagggggcguuccacaguuuugguuacacugcccgggauuauuaccaugacuuggaucccgaggaagcacgcgacuggcuguauuucgagaaauuuaagaugaaaauccacuccgccaccgaucucacgcugaagacucagcuggaagccgugaacggcaagaccaugccagcacucgaggucuucgcccaugcgcugagguuuuuccgggagcacgccuugcaggaacugcgcgagcagagccccucccucccagaaaaagacacugugagguggguacugaccgugcccgcaauuuggaagcaaccagccaaacaguuuaugcgggaggcagccuaccuggccggguuggucagucgcgaaaaugcggagcagcuccugaucgcacuggagccggaagccgccagcguguauugcaggaagcuccggcugcaccaguugcuggaucucuccggccgcgcacccggugggggcaggcugggcgagcggcgcagcaucgacaguuccuucaggcaagcccgggaacagcugcgcaggagccggcauaguaggaccuucuugguggaguccggggucggugaacucugggcggagaugcaggccggcgaucgcuacgugguagcagacugugggggcgguacgguggaucugacuguccaccaacuggagcagccacauggcacccucaaagaacuguacaaggccagcgggggccccuauggggcaguggguguggacuuggccuuugagcagcugcucugccggauuuucggcgaagacuuuaucgccacuuucaaaaggcagcgcccagcagccugggucgaucugaccauugcguuugaggcccggaagaggaccgcagggccccaccgcgccggcgcccugaacaucagcuugccguucuccuuuauugacuucuaccggaagcaaaggggucacaauguggaaacugcacuccggcgcaguagcguaaacuuugugaaaugguccagccagggcaugcugaggaugaguugugaggcgaugaaugagcuguuccagccaacggucuccgggaucauucagcauaucgaagcccuccuggcacggcccgaggugcaaggcgucaaguugcuguuucucguagggggcuucgccgaaagcgccgugcugcagcacgcagugcaggccgcgcugggugcccgcggguugaggguggucgugccccaugaugucggccugaccauccucaaaggugcagugcuguuuggccaggccccaggggugguacgggugcgcaggaguccccucacuuauggcgucggggugcugaaccgguucgucccaggcaggcacccgcccgagaaguugcuggugcgcgacggucggagguggugcaccgauguguucgagcgcuuuguagccgcagaacaauccgucgcccucggggaggaagugcggaggagcuacuguccagcgcgccccggccagcggagggugcugauuaaucuguauugcugugccgcagaggacgcccgcuucaucaccgauccaggcguccggaaaugcggggcauugucccuggaacucgagcccgccgacugcggucaggauacugcgggcgccccgccagggaggcgcgagauucgggcagccaugcaguuuggcgacacggaaaucaaggugaccgccguggauguaagcacuaacaggaguguccgcgcauccauugacuuccugagcaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2091 - RNA, 1633 nt, Artificial Sequence
  mRNA product Design1 comprising derived and/or modified sequence from Homo sapiens__NP_008879.3__HsHSPA13 (opt7)
gggagaaagcuuaccauggccagggagaugaccauccugggcagcgcagugcucacucuguugcuggccggguaccucgcgcagcaauaucugcccuugccaaccccgaaggucauugguaucgaccugggcacgacuuacugcuccguggggguauucuuucccggcaccgguaaagugaaggucauuccagaugaaaacgggcacaucaguauucccagcaugguguccuucaccgacaaugauguguaugucggcuacgagaguguggaacucgccgacagcaacccacagaauacuaucuaugaugcaaaacgguuuaucggcaagauuuucaccgccgaggaacuggaggcagagaucgggcgcuaccccuuuaaaguacugaacaagaaugguaugguggaguucuccgucacgagcaacgaaacuauuaccguguccccagaauaugugggcaguaggcuccuguugaagcugaaagagauggccgaggcguaccucgggaugccggucgccaaugcagugaucagcguacccgccgaauuugaccugaagcagcggaacuccacuauugaggccgcaaaucuggccggcuugaaaauccuccgcgugauuaacgaaccaaccgcggccgcaauggccuacggucugcauaaggcagaugucuuccacgugcuggugaucgaccucgggggcggcacccuggaugucagcuugcugaauaaacaaggggguauguuucucacgagggccaugaguggcaacaauaagcucgggggccaggacuucaaccagcggcuguugcaguaucucuacaaacagaucuaucaaacuuacgguuuugugcccucccgcaaggaggaaauucauaggcugcggcaggccguagagauggugaagcugaaucucacccugcaccagagcgcgcaguuguccguccugcucacuguggaggaacaagaucgcaaagagccacauaguagcgacaccgaacugcccaaggauaaacuguccagcgcagacgaccacagggucaacaguggcuucgggcggggcuuguccgauaagaaaagcggggagagucaggugcuguucgaaaccgagaucucccgcaagcuguuugacacucugaacgaggaucucuuccagaagauucuggugccgauccaacagguauugaaagaaggucaccuggagaagacggaaauugacgaggugguccucgugggcgggagcaccaggaucccccggauccgccaggucauucaggaauuuuucggcaaagauccaaauacuagcguggaccccgaucuggccgugguaaccgguguggccauccaagcaggcauugacgggggcuccuggccacugcaggucagugccuuggagauccccaacaagcaucugcagaaaaccaauuuuaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2092 - RNA, 1747 nt, Artificial Sequence
  mRNA product Design1 comprising derived and/or modified sequence from Homo sapiens__NP_057383.2__HsHSPA14 (opt7)
gggagaaagcuuaccauggccgcaaucggcgugcaccuggggugcaccagcgccugugucgcgguguacaaggacgguagggccggcguaguggcaaacgaugccggggaccgggucacucccgcagugguggccuauuccgagaaugaagagauugucggccucgcggccaaacagagucgcaucaggaacauuagcaauaccgugaugaagguaaaacaaauccugggucgguccaguagcgauccacaggcacagaaguacauugccgaauccaaaugcuuggugaucgagaagaacgggaagcugcgcuaugaaaucgacacgggcgaggagacuaaauucgucaauccggaagauguggccaggcucauuuuuagcaagaugaaagagaccgcacauuccgugcugggcagugacgccaacgaugucgugaucaccguacccuucgacuuuggggaaaagcagaaaaaugcguugggugaggccgcacgggccgcaggcuucaacgugcugcgccucauucacgagccaagcgccgcccugcuggcguacgggaucggccaagauucccccacugguaagagcaauauucucgucuuuaaacugggcgggaccaguuugucccugagcgugauggaagugaacuccggcaucuauaggguccucaguacgaauacugacgauaacauugggggugcacauuucaccgagacucuggcccaguaccuggccagcgaauuucagcgguccuucaagcacgacgugcgcggcaaugcaagggccaugaugaaguugaccaacagcgcggagguagccaaacauagucucuccacccuggggagcgcaaauuguuuucuggauagucucuaugaaggccaggacuucgacugcaacgugucccgggcccgcuuugagcuguuguguagcccacuguucaacaagugcaucgaggcaaucaggggucuccuggaucaaaauggcuucacggccgacgauauuaacaaagucgugcugugugggggcagcucccggauccccaaguugcagcagcucauuaaagaccuguuuccagccgucgaacugcucaauaguaucccgcccgaugaggugauuccaaucggggcagccaucgaagcggguauucugaucggcaaggagaacuugcugguggaagacagccucaugauugagugcuccgcccgcgauauccugguaaaggggguggacgagagcggcgcaaguagguucacuguccuguuucccuccgguaccccauugcccgcccggcgccagcacacucuccaagccccgggcagcauuuccagugugugucuggaacuguacgagagcgaugggaaaaauuccgcaaaggaagagaccaaauucgcgcaggucgugcuccaggaccuggauaagaaagaaaacggcuugagggacauccuggccgugcucaccaugaagcgggacgggagccugcacguaacuugcacggaucaagagaccggcaagugcgaggcaaucaguauugaaaucgccuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2093 - RNA, 2794 nt, Artificial Sequence
  mRNA product Design1 comprising derived and/or modified sequence from Homo sapiens__NP_006635.2 __HsHSPH1 (opt7)
gggagaaagcuuaccaugagcguggucggccuggacguggggucccagaguugcuacaucgccguagcaagggccgguggcauugaaaccaucgcgaacgaguucagcgaucgguguacucccuccgugauuaguuuugggagcaagaaucgcaccaucggcgucgccgccaaaaaccaacagauuacgcacgcaaauaacacuguguccaauuucaagagguuucauggucgggcauucaacgacccauuuauccagaaagagaaggaaaaucucagcuaugaucuggugccguugaaaaacgggggcgucggcaucaaggugauguacaugggggaggaacaccuguucuccguagagcagauuaccgccaugcuccugaccaaguugaaagagacugcggaaaauagucugaagaaacccgugaccgacugcgucaucagcgugccauccuuuuucacggaugccgagcgcaggagcgugcucgacgcagcccaaauugucggucugaacugucugcggcucaugaaugauaugacugccguggcacugaacuauggcaucuacaagcaggacuugcccagucuggaugaaaaaccacgcauuguaguguuugucgacauggggcauuccgccuuccaggugagcgcgugcgccuuuaauaagggcaaacucaaggugcuggguaccgcauucgaucccuuccugggcgggaagaacuuugacgagaaauuggucgagcacuucugugccgaauuuaagacuaaauauaagcucgaugcaaaauccaagaucagggcccugcugcggcucuaccaggagugcgaaaagcugaaaaaguugaugaguagcaauuccaccgaccugccacucaacauugaguguuucaugaacgacaaagaugugagcggcaagaugaaucgcagucaauuugaagaacugugcgccgagcuguugcagaaaaucgaaguaccgcucuauucccugcuggagcagacccaucucaagguggaagacgucagcgcgguggagaucgucgggggugcaacgaggauucccgccgugaaggaacggaucgccaaauucuuuggcaaggauauuaguacuacccugaacgcagacgaggccguggcgcgcgggugugccuugcagugcgcaauccuguccccagccuucaaaguaagggaguuuagcgugacugaugcaguccccuucccaauuagccucaucuggaaucacgacuccgaagauaccgagggcgugcacgaagucuuuagucggaaccaugccgcccccuucagcaaggugcugaccuuucugcgcagggguccguucgaguuggaagcauucuacuccgacccccaaggcgugccauaccccgaggccaaaaucgggcgguuuguagugcagaaugucagcgcgcagaaggauggcgagaagagucgcgugaaagucaaggugagggugaacacucacgggauuuucacgaucuccaccgccagcaugguagaaaaagucccaacugaggaaaaugagauguccagugaggcagacauggaaugccucaaccaacggcccccagagaauccggauaccgacaagaacgugcagcaggacaauagcgaagccgguacccagccccaagugcagacugaugcccagcagacgucccaaagcccacccaguccagagcugaccuccgaagagaacaaaauucccgacgcagauaaggcgaaugagaaaaaggucgaccagccgccagaagccaagaaacccaagaucaaaguggugaacguagagcugcccauugaagcaaaucucgucuggcagcugggcaaggauuugcugaacauguauaucgagacugaagggaaaaugaucaugcaggacaagcucgagaaggagaggaacgaugccaaaaaugccguggaagaguacguguaugaauuucgcgacaagcuguguggcccauacgagaaauucauuugcgaacaagaucaucagaacuuucugcgguugcugaccgagaccgaggacuggcucuaugaagagggugaagaucaggcaaagcaggccuacgucgacaaacuggaggagcucaugaagaucggcacucccgugaagguaagguuccaagaagcggaggaacgcccaaaaauguuugaggaacuggggcagcgguugcagcacuaugccaagauugcagccgauuucaggaauaaagacgagaaguacaaccacaucgacgagagcgaaaugaaaaagguggagaaauccgucaaugaagugauggaguggaugaacaaugugaugaacgcccaagcaaagaagagucuggaucaggacccggucgugcgcgcccaggaaauuaaaacgaagaucaaagagcucaauaacaccugugagcccguagugacucagccaaagcccaaaauugaaagcccaaagcuggagcggacccccaauggcccgaacaucgauaagaaagaagaggaccuggaggauaagaauaacuuuggggcggaaccaccccaucaaaauggcgagugcuacccaaacgagaaaaacuccgucaauauggacuuggauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2094 - RNA, 3217 nt, Artificial Sequence
  mRNA product Design1 comprising derived and/or modified sequence from Homo sapiens__NP_006380.1 __HsHYOU1 (opt7)
gggagaaagcuuaccauggccgacaaggugaggcggcagcgccccaggcggcgcgucugcugggcacugguggccguacuccuggcggauuugcuggcccucagcgacacccuggcagugauguccgucgauuugggcagugagagcaugaaaguggccaucgugaagccaggggucccgauggaaauugugcugaacaaagaguccaggcggaagacucccguaaucgugacccucaaagaaaaugagcgcuucuuuggugacagugcagccagcauggcgauuaagaacccaaaggccacgcugagguacuuccaacaucugcucggcaaacaggcagauaauccccacgucgcccuguaucaggcccgguuuccagaacacgaguugacuuucgacccccagcgccaaaccgugcauuuucagaucuccagccagcugcaguucuccccagaggaagugcucgggaugguccugaacuacaguaggagccuggcagaggauuuugccgaacaaccgauuaaggacgcggugaucaccguacccguguucuuuaaucaggccgagcggcgcgcagucuugcaggccgcaaggauggccggccucaaagugcugcagcugaucaacgauaauacugccaccgcgcucuccuaugguguguuccggcgcaaggacauuaacacgacugcacaaaauaucauguuuuacgauauggggagcggcaguaccgucuguacuauugugaccuaucagaugguaaaaaccaaggaggccggcaugcagccacaacugcagaucaggggugugggguucgaccggacguugggcgggcuggaaauggagcuccgccugagggaacggcuggccggcuuguucaacgagcagaggaaaggucagcgcgcaaaggauguccgggaaaaucccagggccauggcgaagcuccugcgcgaggccaaccggcugaaaacugugcucuccgcaaaugccgaccacauggcacaaauugaggggcugauggacgaugucgacuuuaaggccaaagugaccaggguggaguucgaggaauugugcgccgaucuguuugagcgcguaccaggccccgugcagcaggcacuccagagcgccgaaaugucccuggacgagaucgagcaagucauucuggugggcggggcgacucgggucccgagggugcaggaaguguugcucaaggccguagguaaagaggaacugggcaagaacaucaaugcagaugaggccgccgcaaugggggcgguguaccaggccgcagcccugaguaaggccuucaaagucaagcccuuugugguccgggacgcagugguguauccaauccucguagaguucacccgcgaggucgaggaagaacccggcauucauagccugaaacacaacaagaggguguuguuuucccggauggguccauacccccagcgcaaagugaucaccuucaacagguacagccacgauuuuaauuuccauauuaacuauggcgaccugggguuucucggcccagaagaucugcgggucuucgggagucaaaaucugacuacggugaaguugaagggugugggcgacuccuuuaaaaaguacccggauuaugagagcaaagggaucaaggcccacuucaaccuggacgagaguggcguacucucccuggaccgcgucgaaagcguguucgagacccucguggaagauagcgcggaggaagaguccacucugaccaaauuggguaauaccauuaguagccuguuuggcgggggcacuacgcccgacgccaaggagaacgggaccgauacuguccaggaagaggaagaguccccagcagaaggcagcaaggacgagcccggugaacagguggaacucaaagaggaagccgaggccccaguagaagaugggagucagcccccgccacccgagcccaagggcgacgcaaccccagagggugaaaaagccaccgagaaggaaaauggcgauaaauccgaggcgcaaaagcccagcgagaaagccgaagcagggccagagggcguggccccggcacccgaaggggagaagaagcagaaaccagccaggaagcggaggauggucgaagagaucggcguggagcuggugguccuggacuugcccgaucugccagaagacaaacucgcgcaguccgugcaaaagcugcaggaucucacucugcgcgacuuggagaaacaggaacgggagaaggccgcaaacagucuggaagccuucaucuuugagacgcaggauaagcuguaccaacccgaguaucaggaaguaagcaccgaggaacagagggaggagauuuccgguaaacucagcgccgcaaguacuuggcuggaagacgagggggugggcgccaccacugucauguugaaggaaaaacuggcggagcuccgcaagcugugucagggccucuucuuucggguggaagagaggaaaaaguggccggagcgccuguccgccuuggacaaucugcugaaccauagcuccauguuccucaagggggcacggcugaucccagaaauggaucaaauuuuuaccgagguggaaaugacgaccuuggagaaagucaucaaugaaacuugggccuggaagaacgcaacccuggccgagcaggccaaacuccccgcaacugagaagccagugcugcugaguaaagacauugaagcgaagaugauggcccucgauagggagguacaguaccuguugaauaaagccaaguucaccaagccccgcccgcggcccaaagacaagaacgguacgagggcagaaccaccccugaaugccagcgcauccgaucagggcgagaaagugaucccacccgccgggcaaaccgaagacgcggagccaaucagcgagccggaaaaggucgagacuggcagugaacccggugauaccgagccacucgagcugggcgggcccggcgccgaaccagagcagaaagaacaguccacugggcaaaagcgccccuugaagaacgacgagcugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2095 - RNA, 2416 nt, Artificial Sequence
  mRNA product Design1 comprising derived and/or modified sequence from Homo sapiens__NP_005339.3 __HsHSP90AA1 (opt7)
gggagaaagcuuaccaugcccgaggaaacccagacucaagaccagccaauggaggaagaggaaguggagaccuucgccuuucaggcagagaucgcccagcugaugagccucauuaucaacacguucuacuccaauaaggaaauuuuucugagggaguugaucaguaacagcuccgaugcgcuggacaaaauucgguaugaaagucucacugauccgagcaagcuggacuccggcaaagaguugcacaucaaucugauccccaacaagcaagaucgcacccucaccauugucgacacugggaucgguaugaccaaagccgaucugauuaauaaccugggcacgaucgcaaagagcgggacuaaggccuucauggaggcacuccaggccggcgcggacauuuccaugaucggucaguuuggggugggcuucuacagugccuaucugguagcagaaaaagugaccgucauuacuaagcauaaugaugacgagcaguacgccugggaaagcuccgccggcgggagcuuuaccgugaggaccgauacgggugagccaaugggccgggggacuaaagugaucuugcaccugaaggaagaccaaaccgaguaucucgaggaacgcaggaucaaagagauugucaagaaacauagucaguucaucggcuaccccauuacucuguuuguggaaaaggagcgggauaaggaaguauccgacgacgaggcagaggaaaaagaggauaaggaagaggaaaaagagaaggaggaaaaagagagcgaagacaagccagagaucgaggauguggguuccgacgaagaggaagagaagaaagauggggacaagaaaaagaaaaagaagauuaaagaaaaguauaucgaucaggaggagcugaacaaaaccaagcccaucuggacccgcaauccagacgauauuacuaacgaagaguacggcgaguucuacaaaaguuugacgaaugacugggaggaucaccucgccgucaagcauuuuagcguggaaggccagcuggaguucagggcgcuccuguucgugccgcggcgcgcccccuuugaccuguucgagaacaggaagaaaaagaauaacaucaaauuguauguccggcgcguguuuauuauggacaauugcgaagaacugaucccagaauaccucaacuucauuagggguguaguggauuccgaggaccugccccugaacaucagccgggaaauguugcaacagaguaagauccucaaagucauucgcaagaaucuggugaaaaagugucuggagcucuuuaccgagcuggcagaagauaaggagaacuauaaaaaguucuacgaacaguuuuccaaaaauaucaaguuggggauucacgaggacagccaaaacaggaaaaagcugagugagcuccugcgguauuacacuuccgccagcggcgaugaaauggugagccugaaggacuauugcacccgcaugaaagagaaucagaagcacaucuacuacauuaccggggaaacuaaagaucaggucgcaaacuccgccuucguggagagguugcggaagcauggccucgaaguaaucuauaugauugagccaaucgacgaguacugugugcagcaacugaaagaauuugaggguaagacgcuggucagugugaccaaggaaggccucgagcugcccgaagaugaggaggagaaaaagaaacaggaagaaaagaaaacuaaguucgagaauuugugcaaaaucaugaaggacauucuggagaagaaagucgaaaagguggugguaagcaacaggcucgugaccuccccguguugcaucgucaccagcacuuauggguggacggccaauauggagcgcauuaugaaagcgcaggcacugcgggauaacaguaccaugggcuacauggccgccaagaaacaccuggaaaucaaucccgaccauuccauuaucgagacuuugaggcagaaggcagaagccgauaagaacgacaaaagcgugaaggaccuggucauccuccuguaugagaccgcgcuccuguccaguggguuuagcuuggaggauccacaaacucacgccaaucgcauuuaccggaugaucaaacugggucucggcauugacgaagaugaccccaccgcagaugacacguccgccgcagugaccgaggaaaugccaccccuggagggggaugacgauacuagcaggauggaagagguggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2096 - RNA, 556 nt, Artificial Sequence
  mRNA product Design1 comprising derived and/or modified sequence from Homo sapiens__NG_005218__HsHSP90AA3P (opt7)
gggagaaagcuuaccauggacagcuccaagcuggauaguggcaaagggcuccacaucaaccuggugcccaauaagcagaaccaaaccuugacuauugucgacaccaggaucgguaugacgaaaacugaucugauuaauaaccucggcaccgugaccaagagcgggacuaaagccuucauggaggcacugcaggccgacgcggauaucuccaugauuggccauuuugguguaggguucuacagugccuauuugguggcaaagaaggucaccgugaucagcaaacacaauaacgacgaacaguacacgugggaguccagcgccggcggcuccuuuacugugcggaccgaugaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2097 - RNA, 2392 nt, Artificial Sequence
  mRNA product Design1 comprising derived and/or modified sequence from Homo sapiens__NP_031381.2__HsHSP90AB1 (opt7)
gggagaaagcuuaccaugcccgaggaagugcaccauggcgaggaagaggucgaaaccuucgccuuucaggcagagaucgcccaacugaugagccucauuaucaacacuuucuacuccaauaaggagauuuuucugagggaauugaucaguaacgcgagcgacgcccuggauaaaauucgguaugagucccucaccgacccaaguaagcuggauagcgggaaagaauugaagaucgacaucauuccgaauccccaggagcgcacgcugacucucguggauaccgguaucggcaugaccaaagcagaccugauuaacaaucuggggacuaucgccaaguccggcaccaaggcauucauggaggcccuccaggcgggugccgauauuagcaugaucgggcaguuuggcguaggcuucuacuccgcauaucugguggccgaaaaagucguggugauuacgaagcacaacgacgaugagcaauacgccugggaaaguagcgcaggggguuccuuuacugucagggccgaccauggcgagccaaucgggcggggcaccaaagugaucuugcaccugaaggaagaucagacugaguaucucgaggaacgcaggguaaaagagguggucaagaaacauagccaguucauugguuaccccaucacccuguaucuggaaaaggagcgggaaaaggagauuagugacgaugaggcggaagaggaaaaaggggagaaggaagaggaggacaaagacgaugaagagaagccaaaaaucgaagacgugggcuccgaugaggaggacgauagcggcaaggacaagaaaaagaaaaccaagaaaauuaaggaaaaguacaucgaucaggaggaauugaauaaaacgaagcccaucuggacucgcaacccagacgauauuacccaagaggaauacggggaguuuuauaaaucccucacuaaugacugggaggaucaccuggccgugaagcacuucagugucgaaggucagcuggaguuuagggcacuccuguucaucccgcggcgcgcccccuucgacuuguuugaaaacaaaaagaagaaaaauaacauuaagcuguacgugaggcggguauucaucauggacagcugcgaugagcucauuccagaauaucugaauuuuauccgcggcguggucgacuccgaggaucugcccuugaacaucagcagggagaugcuccagcagaguaaaauucugaaggugauccggaaaaauauugugaagaaaugucuggaacucuucuccgagcuggcagaagacaaggagaacuacaagaaauuuuaugaagccuucagcaagaacuugaaacuggggauccaugaggauaguaccaaucgcaggcggcucuccgagcugcugcgcuaccacaccagccaaagcggcgacgaaaugacuuccuugagugaguaugucagcaggaugaaggaaacgcagaaauccauuuacuacaucaccggugagagcaaggaacagguggccaacagugcguuuguagagcgggugaggaagcgcggcuucgaggucguguauaugacugaaccaauugaugaguacugcguccaacagcucaaagaauuugacgggaagucccuggugagcgugaccaaagagggccuggagcuccccgaagaugaggaagagaagaaaaagauggaagaguccaaggcaaaauucgagaaucuguguaaguugaugaaagaaauccuggacaagaaaguagagaaggugaccaucaguaaccggcucgucagcuccccgugcuguauugugacuagcacguauggguggaccgccaauauggaaaggaucaugaaagcccaggcacugcgcgauaacaguacuauggguuacaugauggccaagaagcaucuggagauuaaucccgaccacccaaucgucgagaccuugcggcagaaagcggaagccgauaagaacgacaaagcagugaaggaccuggugguacuccuguuugagaccgcccuccuguccagcggcuucuccuuggaagauccccaaacucacaguaauaggauuuaucgcaugaucaaacuggggcucggcaucgacgaggaugaaguggcagccgaggagccaaacgccgcaguccccgacgaaauuccaccgcuggagggugaugaagacgccagccggauggaggaaguggauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2098 - RNA, 2629 nt, Artificial Sequence
  mRNA product Design1 comprising derived and/or modified sequence from Homo sapiens__NP_003290.1__HsHSP90B1 (opt7)
gggagaaagcuuaccaugagggcccugugggugcucggccugugcugugucuugcugaccuucgggagcgugcgggcagacgaugagguagacguggaugguacugucgaagaggaccucggcaagucccgcgaagggaguaggaccgaugacgagguggugcagcgggaagaggaggccauccaacuggauggcuugaacgcgagccagauucgcgaacugagggagaaauccgaaaaguuugccuuccaggcagaggucaaucggaugaugaaacucaucauuaacagucuguacaagaauaaagagaucuuucugcgcgaacucauuagcaacgccuccgacgcacuggauaagaucagguugaucagccugacggacgagaaugcccucuccgguaacgaagaacugacugugaagauuaaaugcgauaaggagaaaaaucuguugcacguaaccgacaccggggugggcaugacucgggaggagcucgucaagaaccugggcaccaucgcgaaaagugggacgagcgaguuccugaauaagaugacugaggcccaggaagauggucaauccaccagcgagcucauuggccaguuuggggugggcuucuauagugcauuucugguggccgacaaagucaucgugacuuccaagcauaacaaugacacccagcacauuugggaaagcgauuccaacgaguucaguguaaucgccgacccccgcgguaauaccuuggggaggggcacgacuauuacccuggugcucaaggaggaagcaagcgauuaccuggagcuggacacuaucaaaaacuuggucaagaaauauucccaguuuaucaauuucccaauuuacguguggagcaguaagaccgaaaccguggaggaaccgauggaggaggaagaggccgcgaaagaagagaaggaggaauccgaugacgaggccgcagucgaagaggaagaggaggaaaagaaacccaagacuaaaaagguggagaaaacgguaugggauugggaacucaugaacgacaucaagccaauuuggcaacggcccagcaaggagguggaagaggaugaguauaaagccuuuuacaagaguuucuccaaagaaagcgacgauccaauggcauauauccauuucaccgccgagggcgaagucacuuuuaagagcauucuguucgugcccaccuccgccccacgcgggcuguuugacgaguacgguaguaaaaagagcgacuacaucaagcucuaugucaggcggguguucaucaccgaugacuuucacgauaugaugccgaaauaccugaacuucgugaagggcguaguggacuccgaugacuugccccugaaugucagccgcgaaacucuccagcagcauaaacugcugaaggugauuaggaaaaaguugguccggaaaacgcucgauaugaucaagaagauugcggacgauaaauauaacgacaccuuuuggaaggaguucgggacuaauaucaaacugggcgugauugaggaucacaguaaccgcaccaggcuggcaaagcuccugcgguuucaguccagccaccauccaaccgacaucacuuccuuggaucaauacguggaaaggaugaaagagaagcaggacaagaucuauuucauggccgguaguagccgcaaagaagccgaguccagccccuuuguagagcggcugcucaagaaaggcuacgaagugauuuaucugacggagccagucgacgaauacuguauccaggcacugcccgaguucgaugggaagagguuucaaaauguggccaaagaaggcgucaaguucgacgagagugagaagaccaaagaaucccgcgaggcgguggaaaaggaguucgaaccguugcugaacuggaugaaagauaaggcccucaaagacaagauugagaaagcagugguaagccagcggcugacugagucccccugcgcccucgucgcaagucaguacggguggagcgguaauauggaaaggaucaugaaggcccaggccuaucaaaccggcaaggauauuuccacuaacuacuaugcaagccagaaaaagaccuuugagaucaauccacgccacccccugauucgggacauguugaggcggaucaaagaagaugaggacgauaagacggugcuggaccucgccgugguccuguucgagaccgcgacucugcgcaguggguacuugcugccagauaccaaagccuauggcgacaggaucgaacggaugcuccgccugucccucaacauugaccccgaugcaaagguggaggaagaaccagaagaggagccggaagagacugccgaagacaccacggaggauaccgaacaggacgaggaugaggaaauggacguggguacugaugaggaagaggaaaccgccaaggagagcacugcagagaaagacgaacugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2099 - RNA, 2332 nt, Artificial Sequence
  mRNA product Design1 comprising derived and/or modified sequence from Homo sapiens__NP_057376.2__HsTRAP1 (opt7)
gggagaaagcuuaccauggccagggagcugcgggcacuccuguuguggggccgcaggcugcggccccuccugcgcgccccagcguuggccgcagugcccggggguaagccgauccugugcccaaggcggaccacugcccagcucggcccccgcaggaacccagcauggagccugcaagccgggcggcuguucuccacccagacggcggaagacaaagaggaaccccuccacaguauuaucagcuccacugagaguguccagggcagcaccuccaagcaugaauuucaggccgagaccaaaaagcuguuggauauuguggcacgcagccuguacuccgagaaagaaguauucaucagggagcucauuaguaaugccagcgacgcccuggaaaagcugcggcacaaguugguguccgauggucaagcacucccagagauggagauccaucugcagacuaacgccgaaaaagggaccaucacgauucaggacacuggcaucggcaugacccaggaggaacuggucagcaaucucgggacuauugcgcgcagugguuccaaggccuuucuggaugcauugcaaaaccaggccgaggcaagcuccaaaaucauuggccaguucggggugggcuuuuauagugccuucaugguggccgacagggucgaaguguacagccgguccgcggcaccggguagccugggguaucaguggcucagugauggcuccggcguauuugagaucgccgaggccagcggggugcgcaccgguaccaagauuaucauccaccugaaaagugacuguaaggaguucuccagcgaggcaaggguccgggauguggugacgaaauacagcaauuuugucuccuucccccuguauuugaacggccgcaggaugaauacucuccaagccauuuggaugauggacccaaaggaugugcgggaauggcagcaugaggaauuuuacagguauguagcgcaggcccacgacaagccccgcuacacccugcacuacaaaacugaugcaccacugaacauccggaguauuuucuaugugcccgacaugaagccgagcauguucgacgucuccagggagcucgggagcaguguggcccuguacucccgcaaaguguugauccaaaccaaggcaaccgauauucugcccaaauggcuccgguuuaucaggggcgucguggacagcgaggauaucccacugaaucugucccgcgaauugcuccaggagagugcccugauucggaagcugagggacguacuccagcagcggcugaucaaguucuuuauugaucaaagcaaaaaggacgccgaaaaauaugcaaaguucuuugaggauuacgguuuguucaugcgcgaaggcaucgugacugccacggagcaggaggucaaagaagacauugcgaagcugcucagguaugaguccagcgcccugcccagugggcagcugaccuccuugagcgaauacgcaucccggaugcgcgccggcacuaggaacaucuauuaccugugcgccccaaaucggcaucucgcagagcacagucccuacuaugaggcgaugaagaaaaaggauaccgaagugcuguuuuguuucgagcaguuugacgaacucacccuguugcaucugcgcgaguucgauaaaaagaaacucaucagcgucgaaacugacauugugguggaccacuacaaggaggagaaguuugaagauagguccccagccgcagagugccugagcgaaaaagagacggaagaacugauggccuggaugcggaacguauuggggaguagggugaccaaugucaaggugacucugcgccucgacacccacccggccauggucaccgugcuggagaugggugcagcccggcauuuccucaggaugcaacagcuggcgaaaacucaggaggaacgcgcccaguugcugcaacccacgcuggaaaucaacccacggcacgcacucauuaagaaacugaaucaguugagggccuccgagcccggccuggcccagcuccugguggaucagaucuaugaaaacgcaaugauugccgcggggcucguagacgauccacgcgccauggugggccggcugaacgaguugcuggucaaggcacuggagaggcauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2100 - RNA, 679 nt, Artificial Sequence
  mRNA product Design1 comprising derived and/or modified sequence from Homo sapiens__NP_000609.1__HsIGF1 (opt7)
gggagaaagcuuaccaugggcaagaucagcucccugcccacccaacucuucaaaugcuguuuuugcgacuuccugaaggugaaaaugcacacuaugaguagcucccauuuguuuuaccuggcccucugucuguugaccuucacgaguagcgcaacugccgggccagagacccugugcggugcggaacucgucgaugcccugcaguuuguguguggcgacaggggguucuauuuuaacaagccgaccggcuacgguuccagcucccggcgcgcaccccagacugggauuguagaugagugcuguuucaggaguugcgaccugcggcgccucgaaauguauugugccccacugaaacccgcaaagagcgccagguccgugcgggcgcagcgccacaccgauaugccaaagacgcagaaagagguccauuugaagaaugccagcaggggcagugcaggcaacaaaaauuaccggaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2101 - RNA, 760 nt, Artificial Sequence
  mRNA product Design1 comprising derived and/or modified sequence from Homo sapiens__NP_000603.1__HsIGF2 (opt7)
gggagaaagcuuaccaugggcauccccauggguaagagcaugcuggugcuccugaccuucuuggccuuugcauccugcuguauugccgcguacaggccaagugagacucugugcgggggcgaacucgucgacacccugcaguucguguguggggaucggggcuuuuauuucagccgcccggccuccaggguaagucggcgcagcagggguaucguggaggaaugcuguuuucgguccugcgacuuggcacugcucgagacguacugugccacucccgcaaaaagcgaacgcgaugucuccaccccacccaccgugcugccagacaacuuccccagguauccaguggggaaguuuuuccaauacgauacuuggaaacagaguacccagcggcugcgcaggggccucccggcccuguugcgggcgcgcaggggccacguccuggccaaggagcucgaggcauuucgggaagccaaacgccauaggccccugauugcccugccaacgcaggaccccgcacacgggggugccccacccgagauggcgagcaaucggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2102 - RNA, 856 nt, Artificial Sequence
  mRNA product Design1 comprising derived and/or modified sequence from Homo sapiens__NP_000591.1__HsIL6 (opt7)
gggagaaagcuuaccaugaacagcuucuccaccagugccuuuggccccguggcauucagccuggggcuccuguugguccugccagccgcguuuccggcccccgugccacccggugaggacuccaaggauguagcagccccacacaggcagccccucaccaguagcgaacggaucgacaaacaaauucgcuacauccuggauggcauuuccgcauugaggaaggagacuugcaauaaaagcaacaugugugaauccaguaaggaggcccuggcggaaaauaaccucaaucugccaaaaauggccgagaaggacgggugcuuccagagcggcuuuaacgaggaaacgugucuggugaagaucauuacuggucuccuggaguucgaagucuauuuggaguaccugcagaaucgguuugaguccagcgaagaacaggcacgcgccgugcaaaugaguaccaaagugcucauccaguuccugcagaagaaagccaagaaccuggaugcaaucaccacuccggaccccaccacgaaugccuccuugcucacuaaacugcaggcgcaaaaccaguggcugcaggauaugaccacucaucucauucugaggagcuuuaaggaguucuugcaguccagucugcgggcccuccgccaaaugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2103 - RNA, 1498 nt, Artificial Sequence
  mRNA product Design1 comprising derived and/or modified sequence from Homo sapiens__NP_002183.1__HsINHBA (opt7)
gggagaaagcuuaccaugccccugcucuggcugaggggcuucuugcuggccagcugcuggaucauugugcgguccaguccaaccccggggagcgagggucacuccgcagcccccgacuguccaaguugcgcgcucgccgcacugcccaaggaugucccaaacagccagcccgaaaugguggaggccgugaaaaagcauaucuugaauaugcugcaccucaaaaagcgcccagacguaacucaaccgguccccaaagcagcccugcugaacgcgauuaggaagcuccaugugggcaaggugggggaaaauggcuacgucgagaucgaagaugacauuggucggcgcgccgagaugaacgagcugauggaacagaccuccgagaucaucacguuugcagaaagcgggacugccaggaaaaccuugcacuucgagauuuccaaggagggcagugaucugagcgugguagaacgggccgagguguggcucuuucugaaagucccaaaggcaaaucgcaccaggacuaaagugaccauccggcuguuccagcagcaaaagcauccccagggcuccuuggacacgggggaagaggccgaagaggugggucucaaaggcgagcgcagcgaacugcugcucagugagaaggucguggaugcgaggaaguccacuuggcacguauuuccagugagcuccaguauucagcggcuguuggaccaggggaaaagcucccuggauguccgcaucgccugugaacaaugccaggagagcggcgcaagucucgugcugcuggguaagaaaaagaaaaaggaagaggagggggaaggcaagaaaaagggcgggggugagggcggggccggcgcagacgaagagaaagaacagucccacaggcccuucuugaugcuccaggcccggcaaagcgaggaucauccgcaccgcaggcggcgcaggggucuggagugugacggcaaggugaacauuugcuguaaaaagcaguuuuucgucaguuuuaaggauaucggguggaaugacuggauuaucgcccccuccggcuaucaugcgaacuacugcgaaggggaguguccaagccacaucgcagguaccagcggcuccagucugagcuuccacuccacugugauuaaucauuaucggaugagggggcacagccccuuugccaaccucaaaaguugcugcguaccaaccaagcugcgccccauguccauguuguacuaugacgauggccagaauaucauuaaaaaggacauccaaaacaugauuguggaagagugugguugcagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2104 - RNA, 1441 nt, Artificial Sequence
  mRNA product Design1 comprising derived and/or modified sequence from Homo sapiens__NP_002184.2__HsINHBB (opt7)
gggagaaagcuuaccauggacggccugcccgggagggcccucggugcagccugccuguugcugcucgcggccggcuggcuggggccagaggcauggggcagcccgacucccccacccaccccagccgcacccccaccgcccccacccccagguucccccgggggcagucaggauaccuguacgagcugcggcggguuccggcgcccggaagaguuggguaggguggacggcgauuuucuggaagccgucaagcggcacauccucucccgccugcaaaugagggggcggcccaacauuacucaugcggugccaaaagccgcaaugguaaccgcccugcgcaagcuccacgccggcaaagugagggaggacggucgggucgaaaucccccaucuggaugggcacgcaaguccaggcgccgacggccaggagcgcgugagcgagauuaucuccuucgcggaaaccgauggguuggccagcuccagggugcggcuguacuuuuucauuaguaaugaggguaaccagaaucucuuugucgugcaggcaagccuguggcuguauuugaagcuccugcccuacguacuggaaaaaggcucccgcaggaaggugcgggucaagguguauuuccaagagcaggggcauggcgaccgcuggaacaugguggagaaaagggucgaucucaagcggagcgguuggcacacuuuuccacugaccgaagccauccaggcauuguucgagcgcggcgaaaggcggcugaaucucgacgugcagugugauaguugccaagagcuggccguagugccggucuuuguggaccccggggaagagucccacaggccauucguggucgugcaggcccgccugggcgauagccggcauaggauccgcaaacggggguuggagugugacgguaggacgaaccucugcugucgccagcaguuuuucauugacuuccggcugaucggcuggaaugauuggauuaucgcgcccacuggguacuauggcaacuacugcgaagguuccuguccagcauaucuggccggcguacccgggagugccagcuccuuucacaccgcaguggucaaucaauacaggaugcggggccucaacccggggacugugaauagcugcugcauuccaaccaagcugaguaccauguccauguuguacuucgacgaugaguauaacaucgucaaacgcgacgugcccaauaugauuguggaagaguguggcugcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2105 - RNA, 3676 nt, Artificial Sequence
  mRNA product Design1 comprising derived and/or modified sequence from Homo sapiens__NP_000623.2__HsITGAM (opt7)
gggagaaagcuuaccauggcccugagggugcuccuguugaccgcacugacucucugccacggcuucaaccuggacaccgagaaugccaugacguuucaggaaaacgcgcggggguucggucaaagcgucgugcaguugcagggcucccgcguaguggucggggcgccccaggagaucguggcagccaaucaaaggggcagucuguaccagugugauuauagcacugguuccugcgaaccaauucggcuccaggugccggucgaggcagugaacaugagucuggggcugagccucgccgcgaccaccuccccaccccagcuguuggccuguggccccacuguacaucaaaccugcagcgaaaauacguacgugaagggccuguguuuucucuucggguccaaccugcgccagcagccacagaaauuucccgaggcacugagggguugcccacaagaggacagugauaucgccuucuugauugacggcagcggguccaucauuccgcacgauuuucggcgcaugaaggaguucgucagcacugugauggaacagcucaaaaagaguaaaacccuguuuucccugaugcaguauagcgaagaguucaggauccauuuuacuuucaaggaguuccaaaauaaccccaauccacggucccucgugaagcccaucacccagcuguugggccgcacccacacggccacugguauuaggaaagucgugcgggaacuguuuaacaucaccaauggggcacgcaagaacgccuucaaaauucucguagugaucacugacggcgagaaguuuggcgauccacugggguacgaagacgucauucccgaggcggauagggaaggugugauccgguaugugauuggcgucggggacgccuuccgcagugagaaaagcaggcaggagcugaauaccaucgcauccaagccgccccgggaucauguguuucagguaaacaauuucgaagccuugaaaaccauccaaaaccagcuccgcgagaagauuuuugcaaucgaaggcacucagacggguagcaguuccagcuucgagcacgaaaugagucaggagggcuuuuccgccgccauuaccagcaacgggccacugcugagcacugugggcuccuacgacugggccgggggugucuuccucuauaccaguaaggagaaaagcaccuuuaucaauaugacuaggguggauuccgacaugaacgacgcauaccugggcuacgccgccgcaauuaucuugcggaauaggguccaaagccuggugcucggggcgccccgcuaucagcacaucggccugguggccauguuccggcagaacacggguaugugggaaaguaaugccaacguaaagggcacccagauuggggcauacuuuggcgccucccuguguagcguggaugucgacuccaaugggaguacugauuuggugcucaucggcgcaccacauuauuacgagcaaaccaggggugggcaggucagcgugugcccccugccacgcggccgggccagguggcagugugacgccgugcuguauggugaacagggccaaccgugggggcgcuucggcgcagcccucaccguacugggggaugugaacggcgacaaauugacugaugucgcgauuggugcccccggggaggaagacaaucggggcgcaguguaccuguuccacggcacguccgggagcgguaucaguccaucccauagccagaggauugccggcuccaagcucaguccccggcugcaguauuuugggcaaagccuguccggcggucaggauuugaccauggacgggcuggucgaucucacugugggcgcccagggccacgugcugcuccugcgcagccagccaguauugagggucaaagcaaucauggaguucaacccccgggagguggcgcgcaauguguuugaaugcaacgaccaagucgugaaggggaaggaggccggugaagugaggguaugccugcacguccagaaaaguacccgggaccgccucagggagggccagauccaguccguggugacuuacgaucuggcacuggacagcgggcggccgcauuccagggccgucuucaaugagaccaagaacagcacgcgccggcaaacccagguguugggccugacucagaccugugaaacucucaaacugcagcucccaaauugcauugaggaucccguaagucccaucgugcugagguugaacuuuagccuggucgguaccccacuguccgccuucgggaaccuccgccccgugcuggcagaagacgcccaacgguuguuuacggcgcuguucccauuugagaagaauuguggcaacgauaauauuugccaggacgaucucaguaucaccuucagcuuuaugucccuggacugucucguggucggcgggccgagggaguucaacgugacuguaaccgugcgcaaugauggugaagacagcuaccggacucaggucaccuucuuuuucccccuggauuuguccuauaggaaagugaguacgcugcaaaaccagcgcagccagcgguccuggaggcuggccugcgagagugcaagcuccaccgaagugagcggcgcccucaagaguacuuccuguagcauuaaucacccaaucuuucccgagaacuccgaagucaccuucaauauuacuuuugacguggauagcaaggccagucuggggaacaaauugcugcucaaggcaaauguaaccuccgagaacaauaugccacgcacgaacaaaaccgaguuccagcuggaacugcccgugaaguacgccgucuauaugguggugacuagccauggcgucaguaccaaauaccucaauuuuacugcguccgagaacaccagccgggugaugcaacaccaguaucagguauccaaccugggucagaggagcuugccgaucagucugguguuccucgucccagugcgccugaaucaaacugugaucugggaccggccccaggucaccuuuagcgaaaacuuguccaguacgugccauaccaaggagaggcugccaagccacuccgacuuccucgccgaacugcgcaaggcacccgugguaaauuguagcauugccgugugccagaggauccagugcgauauuccguuuuucgggauccaagaggaauuuaacgcaacucugaaaggcaaucucuccuucgacugguacauuaagaccagucacaaccaucuguugaucgucagcacugccgagauccuguucaaugauuccguguuuacccuccugcccggccagggggcguucgugcggagccagacggagaccaaagucgaaccauuugaggugcccaacccauugccccugauuguagguaguuccgugggcgggcuccugcugcucgcccugaucacugcagccuuguauaagcugggcuucuuuaaaaggcaguacaaggacaugaugagcgaagguggcccaccgggggccgagccccaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2106 - RNA, 1621 nt, Artificial Sequence
  mRNA product Design1 comprising derived and/or modified sequence from Homo sapiens__NP_002415.1__HsMMP8 (opt7)
gggagaaagcuuaccauguucagccugaagacccuccccuuucuguugcugcuccacgugcagaucuccaaagccuucccagucaguagcaaggagaaaaacacuaagaccgugcaagacuaccuggaaaaauuuuaucaguugccguccaaucaguaccagaguacgaggaagaacggcacuaauguaauuguggagaagcugaaagaaaugcaacgguucuuugggcucaacgucaccgguaagcccaaugaggaaacccuggauaugaugaaaaagccacgcugcggcgugcccgacagcgggggcuucaugcugacuccagguaaccccaaaugggagaggaccaaucucacguaucggauccgcaacuacacuccacagcuguccgaggcagaaguggagagggccauuaaggaugcguuugaauuguggagcgucgccuccccgcugaucuucacccggauuagucagggggaggcagacaucaauaucgccuuuuaucagcgcgaucauggcgacaacagccccuucgauggcccaaaugggauucucgcacacgccuuucaacccggucagggcaucgggggcgacgcgcauuucgaugccgaggaaacuuggaccaacaccuccgcaaauuacaaccuguuccugguggccgcccacgaguuuggucauagcuuggggcucgcacacaguuccgacccaggcgcccugauguaucccaauuacgcguucagggaaacgagcaacuacucccugccgcaggaugacauugauggcauccaggccauuuaugggcucaguagcaaccccauccaaccaacuggucccuccaccccaaaacccugugacccaagccugacuuuugacgcaauuaccaccuugcggggcgagauccuguucuuuaaggaucgcuacuucuggaggcggcacccgcagcuccagcgcguagaaaugaauuuuaucagucuguucuggcccucccugccaacugggauucaagccgcauaugaggacuuugauagggacuugaucuuccucuuuaagggcaaccaguacugggcccugagcgguuaugauauucugcagggcuaccccaaagacaucaguaauuauggguucccauccagcgugcaggccauugaugcggcagucuuuuaccggagcaagacguacuucuucgugaacgaccaauuuuggcgcuaugauaaucagaggcaguucauggagcccggcuacccgaaauccaucaguggggccuuuccagguaucgaaagcaagguggacgccgucuuccagcaagagcacuuuuuccauguguuuuccggcccccgguauuacgcauucgaucucauugcccagcgcguaaccaggguggcgcgggggaacaaauggcugaauugcagguauggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2107 - RNA, 2341 nt, Artificial Sequence
  mRNA product Design1 comprising derived and/or modified sequence from Homo sapiens__NP_004985.2__HsMMP9 (opt7)
gggagaaagcuuaccaugagccuguggcagccccucgugcuggucuugcuggugcucggcugcuguuucgccgcaccaaggcaacggcaguccacccugguauuguuuccgggggaccugcgcacuaaccucaccgauaggcagcuggccgaggaauaccuguaucgguacgguuauacgcgcguggcggagaugaggggcgaaaguaagagccucgggcccgcccuguugcugcuccagaaacaacugucccugccagagacuggcgaauuggacagugcaacccucaaggccaugcggacccccaggugcggugucccagaucuggggagguuccagacuuuugagggcgaccugaaauggcaccaucacaauaucaccuacuggauucagaacuauagcgaggaucucccccgggcagugaucgacgaugccuucgcgcgcgccuuugcacugugguccgccgugacgccauugacuuucaccagggucuacagccgggacgccgauauugugauccaguuuggcguagcagaacauggggacgguuauccguucgauggcaaggacgggcugcucgcccacgcguuucccccaggccccgguauucaaggggaugcccauuucgacgacgaugagcuguggucccugggcaaaggcguggucgugccaacucgcuuugggaaugcagacggugccgcaugucacuuccccuucaucuuugaaggcaggaguuacagcgccugcaccaccgaugggcgguccgacggcuugccgugguguagcacgacugccaacuacgauaccgacgaucgcuucgguuuuugccccagugagaggcucuauacucaggacggcaaugcggaugggaagccaugucaguuccccuuuaucuuccagggccaauccuacagcgcaugcaccaccgacgggcgguccgaugguuaucgcuggugugccacuacggccaacuacgacagggacaagcuguuuggcuucugcccaacccgggcagauaguacugugaugggcgggaauagcgccggugagcugugcgucuuucccuucaccuuucucggcaaagaauauuccaccuguacuagcgaggggaggggcgacgggcgccuguggugcgcgacgaccaguaacuucgauuccgacaagaaauggggcuuuuguccagaucaggguuacagcuuguuccugguggccgcacacgaguucgggcaugcccucggccuggaccacaguuccguaccggaagcacugauguaucccauguaccgguuuacugaagguccacccuugcauaaggaugacgugaauggcauuaggcaccucuacgggccacgccccgagccggagccacggccacccaccaccacuacgccccagcccaccgccccaccgacugucugccccaccggcccacccacugugcacccaagcgaaaggcccaccgccgggccgacgggcccacccagcgcagguccaaccgggcccccgacugccggccccuccaccgcgacuaccgugccacugagucccgucgaugacgccuguaacgugaauaucuucgaugcaauugccgagaucggcaaccaacuguaucucuuuaaagacgggaaguacuggcgcuucagcgaaggucggggcuccaggccacaggggcccuuucugauugccgauaaauggccagcauugccgcggaagcuggacagcguauucgaggaacgccucaguaagaaacuguuuuucuuuuccggccgccaggugugggucuauacgggugcgagcgugcuggggccccggcgcuuggacaagcugggccucggcgccgaugucgcacaggugaccggggcccugagguccggucggggcaaaaugcuccuguucagugggcgcagguuguggcgguuugacgugaaggcccaaaugguagauccaaggagcgcauccgagguggaccgcauguuccccggcgucccacuggauacucaugacguguuccaguaccgggagaaagccuauuuuugccaggauagguucuacuggcgcgucagcagucgguccgaacucaaucagguggaccaaguggguuauguaaccuacgauauccugcagugucccgaggacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2108 - RNA, 1633 nt, Artificial Sequence
  mRNA product Design1 comprising derived and/or modified sequence from Homo sapiens__NP_002418.1__HsMMP13 (opt7)
gggagaaagcuuaccaugcaccccggcgugcuggccgcauuccucuuucugagcuggacccauugcagggccuugccacugccguccgggggugacgaggaugaccucagugaagaggaucugcaguucgcggaacgguacuugcgcagcuauuaccaccccacuaaccuggccggcauccucaaggagaaugcagccuccaguaugaccgaaaggcugcgggagaugcagagcuuuuucgggcuggaggucacgggcaaacucgacgauaacacucuggacgugaugaagaaaccacgcugugguguacccgaugugggggaauauaaugucuuuccaaggaccuugaagugguccaaaaugaaccugaccuaccggauugugaauuauacucccgacaugacccauagcgagguggaaaaggcauucaagaaagccuuuaaggucugguccgaugugacgccacucaacuucacucgccugcacgacggcaucgcggauauuaugaucaguuuuggcauuaaagagcauggggacuucuacccguuugauggucccagcggccuguuggcccacgcauucccacccgggccaaauuauggcggugacgcccacuucgacgaugacgagaccuggacuuccagcaguaagggguacaaccucuuucugguagccgcacaugaguucggccacucccugggccucgaucauagcaaagaccccggggcccugauguuuccgaucuacaccuauaccgguaagucccacuucauguugcccgaugacgaugugcaaggcauccagagucuguacgggccaggcgacgaggaucccaauccaaaacaccccaagacgccagacaagugcgauccgagccucucccuggacgcgauuacuagccugaggggugaaaccaugaucuuuaaagaccgguucuuuuggcgcuugcauccccagcaagucgaugccgaacucuuccugacuaagaguuuuuggccagaacugcccaacaggauugacgcagccuaugagcacccaucccaugaucucaucuucauuuuucggggccgcaaauucugggcacugaauggguacgacaucuuggagggcuaucccaagaaaauuagcgaacuggggcucccgaaggaggugaagaaaaucagugccgccgugcacuuugaagauaccgguaagacccugcuguucuccggcaaccaggucuggagguacgacgauacuaaucauaucauggacaaagauuauccacgguugauugaggaagacuuccccgggaucggcgauaagguggacgcgguauacgagaaaaacgguuacauuuacuuuuucaauggccccauccaguuugaguauagcauuuggagcaaccgcaucgugagggucaugccagcaaacuccauccucugguguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2109 - RNA, 1285 nt, Artificial Sequence
  mRNA product Design1 comprising derived and/or modified sequence from Homo sapiens__NP_001286.1__HsCCR1 (opt7)
gggagaaagcuuaccauggagacccccaacacuaccgaagacuacgauacgacuaccgaguucgacuauggcgaugccaccccaugccagaaggugaaugaaagggcauuuggggcccaacugcucccgccccuguacagcuuggucuucgugaucggucugguaggcaacauucucgugguccugguguuggugcaguauaaacggcugaagaauaugacuuccaucuaccuccugaaccuggcgauuagugaccuccuguuuuuguucacccugccauuuuggaucgauuauaaacucaaggacgauugggucuucggggacgccauguguaaaauucugagcggcuuuuacuauacgggucuguacuccgagaucuucuuuaucauuuugcucacuaucgaucgcuaccuggcaauugugcacgccguauucgcacugagggcccggaccgugacuuuuggggucaucaccaguauuaucauuugggcgcucgccauccuggcaagcaugcccggcuuguauuucuccaagacccagugggaauuuacgcaucacacuugcagccugcauuuuccacacgagucccuccgcgaguggaagcuguuccaggcccugaaauugaaucucuuuggccuggugcugccccuccuggugaugaucauuuguuacaccgggaucauuaagaucuugcugaggcggccaaacgagaaaaagaguaaagccguccgccucauuuucgugaucaugaucauuuucuuccuguuuuggacuccguauaaucugaccaucuugauuagcguauuccaagacuuucucuucacccaugaaugcgaacaguccaggcaccuggaucuggcagugcaggucacugaggugaucgccuacacgcacuguugcgugaaccccgucauuuaugcguuugugggugagcgguuccgcaaguaccucaggcagcuguuucaucggcgcguagccgugcacuuggucaaauggcugccauuccucagcguggacaggcuggaacgggucaguuccaccagccccuccacuggcgagcaugaacugagugcaggguucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2110 - RNA, 853 nt, Artificial Sequence
  mRNA product Design1 comprising derived and/or modified sequence from Homo sapiens__NP_002598.4__HsPDGFA (opt7)
gggagaaagcuuaccaugaggacccuggccugccuccuguugcugggcuguggguaccucgcacacgugcuggccgaggaagcggagaucccccgggaagucauugagcgcuuggccaggagccagauccauuccauucgggaccugcaacgccuccuggaaaucgauaguguggguagcgaggacucccuggauaccagucucagggcacacggcguacaugccacuaagcacgugccagagaaacggccgcugcccauucgcaggaagcggagcaucgaagaggcagucccagccgugugcaaaacgcgcacugugaucuaugaaauucccaggucccaggucgacccaaccagcgcgaacuucuugaucuggcccccauguguggagguaaagcggugcaccggguguugcaauacuuccagugugaaaugucagccgagccgcguccaucacagguccgugaagguggccaaggucgaguacgugcggaaaaagcccaaacugaaggaaguacaggugcgccucgaggaacaccuggagugcgcaugugccaccacgagccugaacccagauuauagggaagaggacacuggccggccccgcgagagugguaaaaagaggaaacggaagagguugaagccaaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2111 - RNA, 943 nt, Artificial Sequence
  mRNA product Design1 comprising derived and/or modified sequence from Homo sapiens__NP_002599.1__HsPDGFB (opt7)
gggagaaagcuuaccaugaacaggugcugggcccuguuccucagccuguguugcuacuugcggcugguguccgcagagggcgaccccaucccagaggaacucuaugaaaugcugagugaucacagcauucgcuccuuugacgauuugcagaggcugcuccauggggacccgggugaggaagauggcgccgagcuggaccugaauaugacccggagucacagcgggggcgagcucgaaucccuggcgcgcgguaggcggagcuuggggucccugacuaucgccgagcccgcaaugauugccgaauguaagacccgcacggaggucuucgagaucaguaggcggcucauugaucgcacuaacgcaaauuuucugguguggccacccugcguagaagugcaaagguguagcggcugcuguaacaaucggaacguccagugccgcccaacccaggugcagcugaggcccgugcaaguccggaaaaucgagaucgugcgcaagaaaccaauuuucaagaaagccaccguaacuuuggaagaccaucucgcguguaagugcgagaccguggccgcagccaggccggucacgcggucccccggcgggagccaggaacagcgcgccaagacuccacagaccagggugacuauccggaccgugaggguccgccggcccccaaaagguaagcacaggaaauuuaagcauacccacgauaaaacggcacugaaggagacucugggcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2112 - RNA, 1255 nt, Artificial Sequence
  mRNA product Design1 comprising derived and/or modified sequence from Homo sapiens__NP_057289.1__HsPDGFC (opt7)
gggagaaagcuuaccaugagccuguucggccuccuguugcugaccuccgcccucgcagggcagaggcaagguacucaggccgagaguaaccugagcuccaaguuucaguucaguagcaauaaagaacagaacggcgugcaagacccccagcacgagcggaucauuaccgucuccacgaaugggagcauccauuccccacgcuuuccgcacacuuaccccaggaacaccguguugguauggcggcugguggcggucgaagagaauguguggauucagcucaccuucgaugaacgcuuuggccuggaggacccagaggaugacaucugcaaguaugauuucguggaagucgaggaacccagugacgguacuauucuggggaggugguguggcagcggcaccgugccagggaaacagaucuccaaggguaaccaaauccggauucgcuuuguaagcgaugaguacuuccccagugagccaggcuuuugcauccauuauaauauugugaugccgcaguucacggaagccgucucccccagcgugcucccacccuccgcacugccauuggaccugcucaacaaugccaucacugcauuuaguacccuggaggaucugauuagguacuuggaacccgagcgguggcagcucgaccuggaagaucuguaucgcccgacuuggcagcuccuggggaaagccuucguguucggcaggaaaagccgggucguggacuugaaccugcucaccgaggagguacgccuguacuccuguacccccaggaauuuuagcgugaguauccgggaggaacugaagcgcacggauacuauuuucuggccagguugcuugcucgucaagaggugugggggcaacugcgcguguugccugcacaauuguaacgaaugccaaugcgugcccuccaaggugaccaaaaaguaucaugagguccugcagcuccggccaaaaacuggcgugcgcgggcugcacaagagcuugaccgacguagcccuggaacaccaugaggagugugacugcguguguagggguaguaccggcgggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2113 - RNA, 1312 nt, Artificial Sequence
  mRNA product Design1 comprising derived and/or modified sequence from Homo sapiens__NP_149126.1__HsPDGFD (opt7)
gggagaaagcuuaccaugcacaggcugaucuucguguacacccucauuugcgccaacuuuuguagcugccgggacacuuccgcaacgccccagagugccagcaucaaggcgcugcgcaaugccaacuugaggcgggaugaccuguaucgcagggaugagaccauucaagucaaaggcaauggguacgugcaguccccacgguucccgaacaguuauccccgcaaucuccuguugacuuggaggcugcauagccaggaaaacacccggauccagcucguauuugacaaucaauucggucuggaggaagcagagaacgauauuugucgcuacgacuuuguggaagucgaggauaucuccgagaccagcacuaucauuaggggccgguggugcgggcacaaggaagugccaccccgcaucaaauccaggaccaaucagauuaagaucacguucaaaagugacgauuauuuuguggccaagccaggcuucaagauuuacuauagccugcucgaggacuuucagcccgcagccgcguccgaaacuaacugggagagcgucaccaguuccaucagcgguguguccuacaauaguccaagcguaacugauccgacccugauugccgacgcauuggauaaaaagaucgccgaguucgacaccguggaagaccugcucaaauacuuuaaccccgaguccuggcaggaagaucuggagaauauguaucuggacacgccacgguaccgcgggaggagcuaucaugaucggaagaguaaagucgacuuggaucgccucaacgacgaugccaagagguacuccuguacuccccggaauuauagcgugaacaucagggaggaacugaaacuggcaaacguggucuucuucccacgcugccuccuggugcaacgguguggcggcaauugcgggugugguaccguaaacuggaggaguugcacuugcaauuccggcaagaccgugaagaaauaccacgaggucuugcaguuugaacccgggcauauuaagcgccggggcagggccaaaaccauggcgcugguggacauccagcucgaucaccacgagcgcugugacugcauuuguagcagccggccgcccaggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2114 - RNA, 895 nt, Artificial Sequence
  mRNA product Design1 comprising derived and/or modified sequence from Homo sapiens__NP_003946.3__HsSOCS3 (opt7)
gggagaaagcuuaccauggugacccacagcaaguuccccgccgcaggcauguccaggccacuggacaccagucuccggcugaaaacuuuuagcuccaagagugaguaccaguuggucgugaacgccguacgcaaacugcaagaaagcggguucuauugguccgcggugacggguggcgaggccaaucuccuguugagcgcagaaccggccgggacuuuucugaucagggauuccagugaccagcggcauuucuuuacccucagcgucaagacccaguccggcacuaaaaaccugcgcauucagugcgagggugggagcuucagucugcaauccgaucccaggagcacccagccagugccccgguuugacugugugcucaagcugguccaccauuacaugccacccccaggcgcaccguccuuccccaguccacccacggaaccaagcuccgaggugcccgagcagccgagcgcccagcccuugccaggcagucccccacgcagggcguauuacaucuauuccgggggugaaaagauuccccugguacucagccggccacugaguuccaauguggccacucugcaacacuugugccgcaaaaccgucaacggccaucucgauagcuacgagaaggugacucagcugccggggcccaucagggaauuucuggaccaguaugaugcaccacucugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2115 - RNA, 700 nt, Artificial Sequence
  mRNA product Design1 comprising derived and/or modified sequence from Homo sapiens__NP_003227.1__HsTGFA (opt7)
gggagaaagcuuaccauggugcccagcgccggccagcuggcacucuucgcccuggggaucgucuuggcggccugccaagcacuggagaacuccaccaguccacucagcgccgacccgcccguggcagccgcgguagugucccacuuuaaugauuguccagacagucauacucaguucugcuuucacgguaccuguagguuccugguccaggaagauaagcccgccugcgugugucauagcggcuacgugggggcacggugcgagcacgccgacuugcuggccgucguggcagccucccagaaaaagcaagcgauuacggcccucguaguggucagcaucguggcacuggccgugcugauuaucacuuguguccucauucauugcugucaggugcgcaaacacugcgaauggugcagggcacugaucugucggcacgagaagccauccgccuugcugaaaggccgcaccgccugcugucauagugaaaccguagugugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2116 - RNA, 1390 nt, Artificial Sequence
  mRNA product Design1 comprising derived and/or modified sequence from Homo sapiens__NP_000651.3__HsTGFB1 (opt7)
gggagaaagcuuaccaugcccccaagcggccugaggcuccugccguugcugcucccccuguuguggcugcucgugcugaccccagggcggcccgccgcaggucuguccacuugcaagaccaucgacauggagcucgucaaacgcaagaggauugaagccauccggggccagauucugaguaaauugcgccuggcgagcccacccucccaaggggaggugccaccgggcccccucccagaagccguacuggcacuguacaacaguacgagggaucggguggccggugagagcgcagaacccgagccagagcccgaagccgacuauuacgcgaaggaggucacucgcguguugaugguggaaacccacaaugagaucuaugauaaauucaagcaguccacccauagcauuuacauguuuuucaacacuuccgagcucagggaagccgucccggagcccgugcugcugagucgggcagaacuccgccuguugaggcugaagcucaaaguagagcagcacguggaacuguaucagaaguacagcaauaacuccuggcgguaucugagcaaucgcuugcucgccccaagugacucccccgaguggcugagcuuugaugucaccgggguggugaggcaauggcugucccggggcggcgagaucgaaggguuccgccucagugcccauuguagcugcgacuccagggauaacacgcugcaggucgacaucaaugguuuuacuaccggccggcgcggggauuuggcaacuauucacggcaugaacaggccauuccugcuccugauggccacgccccuggagcgggcgcagcauuugcagagcaguaggcaccgccgggcccucgacaccaauuacuguuuuuccagcaccgagaaaaacugcugugugaggcaacuguacaucgauuuccgcaaggaccuggguuggaaauggauucacgaaccaaagggguaucaugcaaauuuuugccucggcccgugucccuacaucuggagucuggauacucaguauuccaaaguauuggcccuguacaaccagcacaauccaggcgcaagcgccgcccccugcugugugccacaggcgcucgaaccccugccgauugucuauuacguggggcggaagccaaagguggagcaacugagcaacaugaucgucagguccugcaaaugcaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2117 - RNA, 1462 nt, Artificial Sequence
  mRNA product Design1 comprising derived and/or modified sequence from Homo sapiens__NP_003229.1__HsTGFB2 (opt7)
gggagaaagcuuaccaugcacuacugcgugcugagcgccuuccucauccugcauuuggucaccguggcacugucccucaguacuuguagcacccuggacauggaucaguuuaugaggaagcggauugaggccauccgcggccaaauuuuguccaaacugaagcucacgagucccccagaagacuauccggagcccgaagagguaccacccgaagugaucagcauuuacaacuccacuagggaucugcugcaggagaaagcgagccggcgcgccgcagccugcgagagggaacgguccgacgaggaauauuacgcaaaggaggucuauaaaaucgauaugccacccuucuuuccaagugagaaugccaucccgcccaccuucuaccgcccauauuuuaggauugugcgguucgacgugagcgcgauggaaaagaacgccuccaaucucgucaaggcagaguuucgcguguucaggcugcagaaccccaaagcccggguaccagaacagcgcaucgaguuguaccaaauucucaagagcaaagaucugaccagucccacucagagguacaucgacuccaagguggucaaaacccgggccgaaggggaguggcugagcuuugaugugacggacgcagugcacgaguggcugcaucacaaggaucgcaauuuggguuucaaaauuucccuccauuguccgugcuguacuuuuguccccaguaacaauuauaucauuccaaacaagagcgaggaacuggaagccagguucgcgggcaucgacgggaccuccacuuacaccagcggcgaucagaagaccaucaaaaguacgcggaagaaaaauuccgguaagacuccccaucugcuccugauguugcugccaagcuaucgccucgagagucagcaaaccaacaggcggaaaaagagggcccuggacgcagccuacugcuuccgcaaugugcaggacaacuguugccugcggcccuuguauauugauuuuaagagggaccucggguggaaauggauccacgaaccaaagggcuacaaugcaaacuucugugccggcgccugcccguaucugugguccagcgauacucagcacagccgcguacugucccucuacaauaccauuaaccccgaggcgagugcaagcccaugcugugugucccaggaccuggagcccuugaccauccuguacuauauugggaaaacuccaaagaucgaacaacucagcaacaugaucgucaaaaguugcaaguguuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2118 - RNA, 1456 nt, Artificial Sequence
  mRNA product Design1 comprising derived and/or modified sequence from Homo sapiens__NP_003230.1__HsTGFB3 (opt7)
gggagaaagcuuaccaugaagaugcaucugcagagggcccucgugguccuggcauugcugaacuucgccaccgugagccucucccugaguacuugcaccacguuggacuuuggccacaucaaaaagaaacggguagaggcgauucgcgggcaaauccugagcaagcucaggcugacuuccccacccgaaccgaccgugaugacccacguccccuaccaggugcuggcccucuauaauaguacucgggagcuguuggaagagaugcauggugaacgcgaggagggcuguacccaggaaaacacggagagcgaauacuaugcaaaagagauucacaaguucgauaugauccaggggcuggccgagcauaaugaacucgcagugugcccaaagggcauuacuuccaaagucuuuagguucaacgugagcuccguagagaagaaucggaccaaccuguuucgcgccgaguucagggugcugcggguccccaauccaaguagcaaacgcaacgaacaaaggaucgaauuguuucagauccuccggcccgacgagcacauugcgaagcagcgcuacaucggugggaaaaaucugccaacuaggggcaccgccgaguggcuguccuucgaugugaccgacacggugcgggaauggcuccugcgcagggagagcaacuugggccuggaaauuaguauccacuguccgugccauacuuuucagcccaauggggauauucucgagaacauccacgaagucauggagauuaaguucaaagguguggacaaugaggaugaccauggccgcggggaucugggccggcugaagaagcaaaaagaccaccacaacccacauuugauccucaugaugauucccccacacaggcuggauaaucccggucaagggggccagcggaagaaaagggcacuggacaccaacuauuguuuucgcaaccucgaagagaauugcuguguacggccgcuguacaucgauuucaggcaggacuugggcuggaagugggugcaugaacccaaaggguauuacgccaacuucugcuccgguccaugucccuaccugcgcagcgccgacacuacccacuccaccguccucggccuguauaauacucugaacccagaggcaagugccagccccugcugcgugccacaggauuuggaaccgcucacgauccuguacuauguggggcggacccccaaggucgagcagcuguccaauauggugguaaagagcuguaaaugcaguugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2119 - RNA, 1603 nt, Artificial Sequence
  mRNA product Design1 comprising derived and/or modified sequence from Homo sapiens__NP_001057.1__HsTNFRSF1B (opt7)
gggagaaagcuuaccauggcccccguggcagucugggccgcgcuggccgugggccucgagcugugggcagccgcacacgccuugccagcgcagguagccuucaccccguacgcacccgaaccagggagcacuugcaggcugcgggaguauuacgaccaaaccgcccagauguguugcuccaaguguagucccggucagcaugccaaaguguuuugcacgaagacuagcgauaccgucugugacuccugcgaagauaguaccuauacucagcucuggaacugggugccagagugucugagcugcggcucccgcuguagcuccgaccaaguggaaacccaggcaugcacgagggagcagaaucggaucugcacuugucgccccgggugguacugcgccuugaguaaacaggagggcuguaggcugugcgcgccacuccggaagugucgcccggguuucggggucgccaggcccggcaccgaaacuagcgaugugguaugcaaaccaugugcacccggcaccuuuuccaacaccacgagcaguacugacauuugccggccacaccaaaucuguaauguggucgccauucccgggaacgcauccauggaugccgugugcaccagcacuuccccgacccgcaguauggcccccggugcggugcaucugccacagcccgucagcaccaggucccagcacacucagccaacgcccgagccaagcaccgcaccgaguacuuccuuccugcuccccaugggcccaagucccccagccgaagggagcaccggcgacuuugcccugcccguggguuugaucguaggggugaccgcacugggccuccugauuaucggcgucgugaauugcgugaucaugacucaagucaagaagaaaccgcuguguuugcagcgggaggccaaggugccacaucuccccgcggauaaagcccgcgggacgcagggucccgagcaacagcaucugcugauuaccgcaccauccagcagcuccaguagccucgaauccagcgccagugcacuggacaggcgggcccccacucgcaaccagccacaggccccgggcguagaggcauccggggccggcgaagcgagggccagcaccgguuccagugauagcucccccggcgggcacggcacccaagugaaugucacuugcaucgugaacgucuguagcaguuccgaccacagcucccagugcaguagccaggcauccagcacgaugggggauaccgacaguuccccaagcgagucccccaaggacgaacaggugccauucagcaaagaggagugugccuuucggagucaauuggaaacucccgagacccugcucgguagcacugaagagaagccgcugccacugggcgugcccgaugccgggaugaaaccauccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2120 - RNA, 730 nt, Artificial Sequence
  mRNA product Design1 comprising derived and/or modified sequence from Homo sapiens__NP_002623.2__HsPGF (opt7)
gggagaaagcuuaccaugcccgugaugaggcuguucccaugcuuucuccagcuguuggccggccuggcacucccggccgugcccccacaacagugggcgcugagcgccgggaacgguuccagugaggucgaaguagugcccuuccaggaggucuggggccggagcuacugucgcgcauuggaaaggcugguggacguggucuccgaguauccaagugaaguggagcacauguuuagccccuccugcguaagccuccugcgguguaccgggugcuguggcgaugagaaucugcauugcgugccagucgaaacugccaacgugaccaugcagcuccugaagauccgcuccggugacaggccgaguuacguggaguugacguucagccaacacguccggugugaaugccgcccccugagggagaaaaugaagccagagcggcgcaggcccaaagggcggggcaagcgcaggcgggaaaaacagcgcccaacugauugucaucucugcggcgacgcagugcccaggcggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2121 - RNA, 1456 nt, Artificial Sequence
  mRNA product Design1 comprising derived and/or modified sequence from Homo sapiens__NP_001020537.2__HsVEGFA (opt7)
gggagaaagcuuaccaugaccgacaggcagacugauaccgcccccagcccauccuaccaucugcucccgggccggcgcaggacgguggacgcagccgcgagucgggggcaaggucccgagccagcccccggcgggggcgucgaaggugugggggcacgcggcguagcccugaaguuguucgugcagcugcucggcugcagcagguuugggggugcagucgugcgggccggcgaggcggaaccauccggggccgcacgcagugccagcuccggcagggaggaaccccagccagaggagggugaagaggaagaggagaaagaagaggaacgggggccgcaguggcgccugggcgccaggaagcccggcagcuggacuggggaggcagccgugugugcggauuccgccccagcagcccgggcaccccaagccuuggcccgcgcgagugguaggggcgggcgggucgcacgcaggggcgccgaagagagcgguccaccccacuccccgagccggcgcggcagugccuccagggcagggcccggccgggccagcgagaccaugaacuuccugcucuccugggugcacuggagucuggcgcugcuccuguauuugcaucacgccaaauggagccaggcagccccaauggcagaaggggguggccagaaucaucacgagguagugaaguuuauggacgucuaccagagguccuauugccaccccaucgaaacccugguggauauuuuccaagaguacccagacgaaaucgaguauauuuuuaaacccagcugugugccacucaugcgcugcgggggcuguugcaacgaugagggucuggaaugugucccgacugaggaaaguaauaucaccaugcagauuaugcggaucaagccccaucagggccagcacaucggggagauguccuuccugcaacauaacaagugcgaauguaggcccaaaaaggaccgcgcccggcaggagaaaaagagcgugaggggcaaagggaagggccagaaacgcaagcggaagaaaaguagguacaaguccuggagcguauaugugggugcccggugcugcuugaugccauggagccucccagggccccacccguguggcccaugcuccgagcgcaggaaacaccuguuuguccaagauccccagacguguaagugcaguuguaaaaauacugacagccggugcaaggcacgccagcuggaacucaacgagaggaccugucggugcgauaagcccaggcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2122 - RNA, 916 nt, Artificial Sequence
  mRNA product Design1 comprising derived and/or modified sequence from Homo sapiens__NP_001165094.1__HsVEGFA (opt7)
gggagaaagcuuaccaugaacuuccugcucagcugggugcacuggucccuggccuugcugcucuaccugcaucacgcaaaguggagucaggccgcgcccauggccgagggcgggggucaaaaucaucacgaagucgugaaauuuauggacguauaucagaggagcuacugccauccaaucgagaccuugguggauauuuuccaggaauauccggacgagaucgaauacauuuuuaagcccuccugugucccacugaugcggugcggcggguguugcaacgaugagggccucgagugugugcccacugaagagaguaauaucaccaugcagauuaugcgcaucaaaccacaccaaggucagcacaucggggaaaugagcuuccugcagcauaacaagugcgaguguaggcccaaaaaggaccgggcacgccaggagaagaaauccgugaggggcaagggcaaagggcaaaagcggaaacgcaagaaaagcagguauaaguccuggagugucuacgugggugcccggugcugucugaugccauggagccucccgggcccccacccaugcgggcccugcuccgaacgcaggaagcaucuguuuguacaggauccacagacguguaaaugcagcuguaagaauacugacagucggugcaaagcacgccaguuggagcugaacgaaaggaccugucggugcgauaagcccaggcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2123 - RNA, 841 nt, Artificial Sequence
  mRNA product Design1 comprising derived and/or modified sequence from Homo sapiens__NP_003368.1__HsVEGFB (opt7)
gggagaaagcuuaccaugagcccccugcucaggcggcuguugcuggccgcacuccugcaguuggccccagcgcaagccccggugucccagcccgacgcaccaggccaccagcgcaaggucgugaguuggaucgauguauacaccagggccacuugccagccccgggagguggucgugccacugaccguggaacucauggggacggucgcaaaacaacuggugcccagcuguguaacugugcagcgcugcgguggcuguugcccagacgaugggcuggagugugucccgaccggccagcaucaggugaggaugcaaauucucaugauccgguaucccuccagucagcugggugaaaugagcuuggaggaacacucccagugcgagugucgcccaaagaaaaaggacagcgccgugaaacccgauagggcggccaccccacaucaccggccccagccgcgcuccguccccgggugggacagugcaccaggcgcccccagcccagccgauauuacucaucccaccccagcaccgggccccuccgcccacgcggccccaagcacgaccagugcacugacucccgggccagccgcagccgccgcggacgcagccgccuccagcguggcaaaggguggcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2124 - RNA, 1477 nt, Artificial Sequence
  mRNA product Design1 comprising derived and/or modified sequence from Homo sapiens__NP_005420.1__HsVEGFC (opt7)
gggagaaagcuuaccaugcaucugcucggcuucuuuagcguggccugcucccuguuggcagccgcgcugcuccccgggccaagggaggccccggcagccgcagccgcguucgaaaguggucuggacuugagcgaugccgagcccgacgcaggcgaagccaccgccuacgcauccaaggaucuggaggaacagcuccggagugucagcuccguggacgagcugaugacuguacuguauccagaguacuggaaaauguauaagugucaacuccgcaaagggggcuggcagcacaacagggaacaggccaaucugaacagccggaccgaggaaacgaucaaguuugcggccgcacacuacaauacugagauuuugaaauccaucgauaacgaguggcgcaagacccagugcaugcccagggaaguguguauugacgucgguaaggaguucgggguggccaccaauacuuucuucaaaccacccugcgugagugucuaucgguguggcggcugcuguaacagcgaagggcugcaaugcaugaauaccuccacgagcuaccucaguaagacucuguuugagaucaccgugccacugucccaggguccgaaacccguaacuauuagcuucgcaaaccauaccuccugucgcugcaugaguaaguuggauguguauaggcagguccacagcaucauccggcgcucccucccagccacccugccccagugccaagccgcgaauaaaacguguccaacuaacuacauguggaauaaccauauuuguaggugccuggcacaggaagacuuuauguucagcagugaugccggcgacgauuccaccgacggguuucacgauaucugcggccccaauaaggagcucgacgaggaaacuugucagugcgugugucgggccggucugcgcccggcaagcugcgggccccacaaagaguuggacaggaacaguugucagugcgugugcaagaauaagcuguucccaucccaauguggcgccaaccgggaauuugaugagaauaccugccagugugucugcaaacgcaccugucccaggaaccagccacucaaccccggcaagugcgcgugugaaugcacugagagcccacaaaaaugucugcugaaggggaaaaaguuucaucaccagacgugcagcuguuaccggcgcccgugcaccaauaggcagaaggccugcgagcccgguuucuccuauagugaagaggugugucggugcguaccaagcuacuggaaaaggccccagauguccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2125 - RNA, 1282 nt, Artificial Sequence
  mRNA product Design1 comprising derived and/or modified sequence from Homo sapiens__NP_004460.1__HsVEGFD (opt7)
gggagaaagcuuaccauguacagggaguggguggucgugaacguauucaugaugcuguaugugcagcucguccaaggcagcuccaaugaacacgggcccgugaagcggaguagccaguccacccuggagcgcagugaacagcagaucagggccgcaagcuccuuggaggaacugcuccggauuacucauagcgaggacuggaaacuguggcgcugcagguugcggcugaaguccuuuaccaguauggauagccgcuccgccagccacaggaguacgcgguucgcggccacuuuuuacgacaucgagacccucaaagugauugaugaagaguggcaacgcacccaguguuccccaagggaaacuugcgucgagguggcaagcgagcuggguaaguccaccaacacguucuuuaaaccgcccuguguaaauguguuccggugcggcggguguugcaacgaagagagucugaucuguaugaauacuagcaccuccuauauuagcaagcagcucuuugaaaucagugucccacugacuuccgugcccgaguuggugccagucaagguggccaaccauaccggcugcaaaugucugcccaccgcaccacgccacccguacagcaucauuaggcggaguauccagauucccgaagaggaccgcugcucccauagcaagaaacucugcccaaucgauaugcugugggacagcaauaaguguaaaugcguacugcaagaggaaaaccccuuggccgguacggaggaucacucccaccuccaggaaccagcgcugugugggccccauaugauguucgacgaggauaggugcgaaugugugugcaagacuccgugucccaaagaccugauucagcacccaaagaauugcaguuguuuugagugcaaggagagccucgaaaccugcugucagaaacauaagcuguuccaccccgauacuugcuccugugaggaccggugcccauuucacacccgccccugugccagcggcaaaaccgcaugcgccaagcauuguagguucccaaaagaaaagcgggccgcacaaggcccgcacaguaggaagaaccccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2126 - RNA, 847 nt, Artificial Sequence
  mRNA product Design1 comprising derived and/or modified sequence from Homo sapiens__NP_061986.1__HsFGF21 (opt8)
gggagaaagcuuaccauggacuccgacgaaaccggcuucgaacacuccggccucugggucuccguccucgccggccuacuacuaggcgccugccaagcccaccccauccccgacucauccccacuucuacaauucggcggacaagucagacaacgauaccucuacaccgacgacgcccaacaaacagaagcccaucucgaaauaagagaagacggcaccgucggcggcgccgccgaccaaucccccgaaucccuacuccaacucaaagcacucaaacccggcgucauccaaauccucggcgucaaaaccucccgcuuccuaugccaacgccccgacggcgccuuauacggcucccuacacuucgaccccgaagccugcucuuuucgcgaacuccuacucgaagacggcuacaacguauaccaauccgaagcccacggccuaccccuacaccuccccggcaacaaaucaccccaccgcgacccagccccacguggccccgcacgcuuccucccacuaccaggccucccacccgcccuccccgaaccacccggcauccucgcaccccaaccacccgacguaggcuccucagacccccucuccauggucggccccucccaaggccgcucacccucauacgccucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2127 - RNA, 1627 nt, Artificial Sequence
  mRNA product Design1 comprising derived and/or modified sequence from Homo sapiens__NP_002412.1__HsMMP1 (opt8)
gggagaaagcuuaccaugcacuccuucccaccccuccuccuacuucucuucuggggcguaguaucccacuccuuccccgccacacuagaaacccaagaacaagacguagaccugguccaaaaauaccuagaaaaauacuacaaccucaagaacgauggacgacaagucgaaaaacgccgcaacuccggcccggucguagaaaagcuaaaacaaaugcaagaguucuucggccuaaaagucacuggcaaaccagacgccgaaacccucaaagucaugaaacaaccacgaugcggcgucccagacgucgcacaauucguccucacagaaggcaacccccgaugggaacaaacccaccucaccuaccgaauugaaaacuacacaccugaccugcccagagccgacguagaccacgccauagaaaaagccuuucaacucuggucaaacgucacaccccucaccuuuaccaaagucucggaaggccaagccgacauaaugauuagcuucguucgaggcgaccacagagacaacucccccuucgacggacccggcggcaaccucgcccacgccuuccaacccggcccggguauaggcggagaugcacauuucgacgaagacgaacgcuggacaaacaacuucagagaauacaaccuccaccguguagcagcccacgaacuaggccacucacucggacucucacacagcaccgacaucggagcccuaauguacccauccuacacuuucuccggagacguucaacucgcccaagacgacaucgacggcauccaagcaaucuacggccgcucccaaaacccaguacaacccaucggaccacagacucccaaagccugcgacuccaaacucaccuuugacgcaaucaccaccauccgaggcgaagucauguucuucaaagaccgcuucuacaugcgcacgaaccccuucuacccagaagucgaacucaacuucauaucagucuucuggccccaacuaccaaacggccuugaagcagcauacgaauuugccgacagagacgaaguccgcuucuucaaaggaaacaaauacugggccguccaaggccaaaacguccuucacggcuaccccaaggacauauacuccuccuucggcuucccccgaacagucaaacacaucgacgcggcacuguccgaagaaaauaccggcaagacauacuucuucgucgccaacaaauacuggcgguacgacgaauacaaacgauccauggaccccggcuaccccaaaaugauagcacacgacuucccgggaaucggccacaaagucgaugcaguauucaugaaagacggauucuucuacuucuuccacggcacacgccaauacaaauucgaccccaaaacaaaacgcauccucacccuccagaaagccaacagcugguucaauugccgcaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2128 - RNA, 1387 nt, Artificial Sequence
  mRNA product Design1 comprising derived and/or modified sequence from Homo sapiens__NP_002412.1__HsMMP1(1-19,100-469) (opt8)
gggagaaagcuuaccaugcacuccuucccuccccuacuacuccuacuauucuggggagucguaucacacuccuucguccucaccgaaggcaacccucgaugggaacaaacccaccucacuuaccgaaucgagaacuacacccccgaccucccacgagccgacgucgaccacgccaucgaaaaagccuuucaacuaugguccaacgucacaccccucaccuucacuaaaguaagcgaaggccaagccgacaucaugaucagcuucguccgcggagaccaccgagacaauucccccuucgacggcccaggaggcaaccuagcccacgccuuucaaccaggacccggcauaggaggcgacgcccacuucgacgaagacgaacgauggacaaacaacuuccgcgaauacaaccuccacagaguagccgcccacgaauuaggccacucccuaggacucucacacucaaccgacauaggugcccucauguaccccuccuacaccuucagcggcgacguccaacuagcccaagacgacaucgacggcauacaggccaucuacggccgaucucaaaauccaguccaacccauaggaccacagacaccaaaagccugugacuccaaacucaccuucgacgccaucaccaccauacgcggagaagucauguucuuuaaagacagauucuacaugcguaccaaccccuucuacccagaaguagaacuaaacuucauaucugucuucuggccacaacuccccaacggccuagaagcagcauacgaauuugcugacagagacgaaguacgauucuucaaaggcaacaaauacugggccguccaaggccaaaacguacuacacggcuacccaaaagacaucuacuccuccuucggcuucccccgcacagucaaacacaucgaugccgcacucagcgaagaaaacaccggaaaaaccuacuucuucgucgccaacaaauacuggcgauacgaugaauacaaacgauccauggaccccggauaccccaaaaugaucgcccacgacuuccccggaauaggccacaaagucgacgcaguuuucaugaaagacggcuucuucuacuucuuccacggaaccagacaauacaaauucgaccccaaaaccaaacgcauccucacccuccaaaaagccaacuccugguucaacugccgcaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2129 - RNA, 3574 nt, Artificial Sequence
  mRNA product Design1 comprising derived and/or modified sequence from Clostridium histolyticum__BAA77453.1__ColG (opt8)
gggagaaagcuuaccaugaagaaaaacauccucaaaauacucauggacucguauucuaaggaauccaaaauccaaaccgucagacgcgucacuagcgucucccuccucgcgguguaccuaacuaugaauacguccagccuaguccucgcaaagccuaucgagaacaccaacgacaccagcauuaaaaacguugagaagcuacgcaacgcgccaaacgaggaaaacucaaagaaagucgaagacagcaaaaaugacaaaguagagcacguuaaaaacauagaagaagccaagguggaacaaguagcaccggaagucaaaagcaaaaguacccuacgcagcgccagcauugccaacaccaacagcgaaaaguacgacuucgaguaucuuaacgggcucagcuacacagaacuaacaaaccugaucaaaaacauaaaauggaaccaaauaaacgguuuguucaacuacagcacagggucacaaaaauucuucggcgauaaaaaccgcguccaggccaucauaaacgcccuacaagaaagcggccgcacauacaccgcgaacgacaugaagggaauagaaaccuucacggagguauuaagggcgggguucuaccuaggcuacuacaaugacggacucucauaccuaaacgaccgcaacuuccaagacaagugcauccccgccaugauagccauacagaaaaacccaaauuuuaaacucggcacggccguccaagacgaaguuauaacauccuuagggaaacucaucggaaacgccucggccaacgccgaaguggugaacaacugcguccccguacuuaagcaauuccgcgaaaaccuaaaccaauacgcacccgacuacguuaaggggaccgcggucaacgaauugauaaaaggaaucgaguucgacuuuagcggagcagcauaugaaaaggacgugaagacaaugcccugguacggcaagauugauccguucauuaacgaacucaaggcccucggacuauacggaaacauaaccucagcaaccgagugggcuucagauguaggcaucuacuaccugagcaaguucggccuauacagcaccaaccgcaacgacauugugcaaaguuuagaaaaagcagucgacauguacaaguacggcaagauugcauuuguagcgauggaacgaauaacgugggacuacgacggcaucggcuccaacggaaagaaagucgaccacgacaaguuccuggaugacgccgagaagcacuaccuccccaagacauacaccuucgacaacggcaccuucaucauccgagccggcgacaaaguaucggaagaaaagaucaagagacuauacugggccuccagagaagucaaaucccaauuccaccgagucgucggaaacgacaaggcccuagaaguaggaaacgccgacgacguauuaacuaugaaaauuuuuaacagcccagaagaauacaaauucaacaccaauauuaacggcguaucaacagacaacggaggacuguacauagaaccccgagggacauucuacacauacgaacggaccccacaacaauccaucuuuagccuggaagaacucuucagacacgaauacacccacuaccuacaggccagauaccuagucgacgguuuauggggacaaggccccuucuacgagaaaaaccgacucacaugguuugacgagggcacagccgaguucuucgcaggaucaacaagaaccagcggcgugcucccgcgaaagucgauccuuggcuauuuagcgaaagacaaaguagaccacagauacagccuaaagaaaacacugaacucaggcuacgacgauagcgacuggauguucuacaacuauggcuucgcaguagcgcacuaccuuuacgaaaaagacaugccgacguucaucaagaugaacaaagcaauacuaaacaccgacguuaaaucguacgacgaaauaaucaaaaagcuguccgacgaugccaacaaaaacacagaauaccaaaaccauauccaggaacucgcggacaaguaccagggggcaggaaucccccuagucucggacgacuaccuaaaagaccacggcuacaagaaagcaagcgaaguauacagugagaucagcaaagccgccucccuaacgaacacaucagugacugcugagaaaagccaguacuucaacaccuucacacuccgaggaacuuacacgggagaaacaucaaaaggcgaguucaaagacugggacgaaaugagcaagaaauuagacggcacccuagaaucacuagcgaaaaacucuuggagcggauacaagacccuuaccgcauacuucacgaacuacagggucaccagugacaacaaagugcaguacgacgucguguuccacggaguucuaacagacaacgccgacaucuccaauaacaaagcaccaaucgccaaggugacggggccaagcacaggagccgucggacgaaacauagaguucucaggcaaagacagcaaggacgaagacgggaagauaguaaguuacgacugggacuucggugacggagcaacaucccgcgguaagaacagugugcacgcauauaagaaggccggaacauacaacguaacccuaaagguaacggacgacaaaggagcgacagcgaccgaaucguuuacuaucgaaauaaagaacgaagacacgaccacuccaauaacaaaagaaauggaaccaaacgaugacaucaaagaagccaacggcccuauagucgaagguguaaccguaaaaggcgaccucaacggcuccgacgacgcagacacguucuacuucgacgugaaagaagacggggacguaacaaucgaacuccccuacuccggcuccucaaacuucaccuggcuaguauacaaggaaggggacgaucaaaaccacaucgcaagcggaaucgauaaaaacaauaguaaaguagggaccuucaaaucgacaaagggaaggcacuacgucuucauuuacaagcacgacagcgccagcaacauaaguuacuccuuaaacaucaaaggacuaggcaacgaaaaacuuaaggaaaaagagaacaacgacucaagcgacaaagcgacuguaaucccaaacuucaauacgacaaugcaagguucccuccucggagacgacucacgggacuacuacagcuucgaagucaaggaagaaggcgaagugaacaucgaacuggacaaaaaggacgaguucggcguaaccuggacccugcaccccgaaagcaacaucaacgacaggaucaccuacggccaaguagacggcaacaaagucagcaacaaagucaaacuccgccccggcaaguacuaccuacuggucuacaaguacagcggcucaggaaacuacgaacuccgcgucaacaaguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2130 - RNA, 3298 nt, Artificial Sequence
  mRNA product Design1 comprising derived and/or modified sequence from Clostridium histolyticum__BAA77453.1__HsALB(1-18)_ColG(111-1118) (opt8)
gggagaaagcuuaccaugaaaugggucaccuucauaagccuccucuuucuguucagcagcgcauacucaauagccaacaccaacucagaaaaauacgacuucgaauaccuaaacggccuaagcuacaccgaacuaaccaaccucaucaaaaacauaaaauggaaccaaauaaacggccuauucaacuacagcaccggcagucaaaaguucuucggugacaagaaccgcguccaggcgauaaucaacgcccuacaagaauccggccgcaccuacacagccaacgacaugaaaggcauagaaacauucacggaaguacuacgugcuggauucuaucuaggcuauuauaacgacggacugagcuaccuaaacgacaggaacuuucaagacaaaugcauccccgccaugauagcaauccagaaaaaucccaacuuuaaacucggaacggcgguccaagacgaggugaucacgucacuuggaaaacucauaggaaacgcgagcgccaacgccgagguaguaaauaacugcguaccaguccugaagcaauuccgugaaaaucuuaaccaauacgccccagacuacguaaaaggaacugcggucaacgagcucauaaaaggaauagaguucgacuucagcggagccgcauaugaaaaagacguaaagaccaugcccugguacggcaaaauagacccguucaucaacgaacucaaggcacuaggccuauacggcaacaucacaagcgccaccgaaugggccucagacgucgggaucuacuaccuaucaaaauucggacucuacagcacaaaccgaaacgacaucguacaaucccuagaaaaagcagucgacauguacaaauacggaaagaucgcauucgucgccauggagcgcaucacgugggauuacgacggaauaggcucaaacggaaagaaagucgaccacgacaaauuccucgacgacgcagaaaaacacuaccugccgaaaacuuauacguuugacaacggcaccuucauuauccgcgcgggcgacaaaguaucugaggaaaagaucaaacgacuauacugggcuagccgagaaguaaaaagccaguuccaccgaguagucggaaacgauaaggcgcucgaaguaggaaacgccgacgacguccuuacuaugaagaucuucaacagccccgaagaauacaaauucaacacuaacaucaacggcguauccacagacaacggaggccuauacaucgaaccuaggggcaccuucuacaccuacgaacgcaccccacaacaaucaaucuucucucuugaagaacucuuccggcacgaguacacccacuaccuacaagcacgauaccucgucgacggccuauggggccaaggaccauucuacgagaaaaacagacucaccugguuugacgaagggaccgcugaguucuucgccggcagcacaagaacaucaggaguccucccccgaaagagcauccuaggauaccuggccaaggacaagguagaucaccgcuacagccuaaagaagacacuaaacagcggcuacgacgacuccgacuggauguucuauaauuacggcuucgcgguagcacacuaccuguaugaaaaagacaugccaaccuucaucaaaaugaacaaagcaauacuaaacaccgaugucaaaagcuacgaugaaauuaucaaaaagcugagcgacgacgcaaauaaaaacaccgaauaucaaaaccacauccaggaacucgccgacaaauaccaaggcgcagggaucccccuggugucagacgacuaccuaaaagaccacggcuacaagaaagccucggaagucuacuccgaaaucaguaaagcagccagccuaaccaauacaucaguuacagccgaaaagagccaguacuucaacacauucacacugaggggcaccuacacaggcgaaacuuccaaaggggaguucaaggacugggacgaaaugagcaagaagcucgacggcacccucgaaucacucgcuaaaaauucauggucgggauacaagacuuuaacggcauacuucacgaacuaccgagugacaagcgacaacaaaguccaauacgacgucgucuuucacggcguccugaccgacaacgcagacauauccaacaacaaagcaccgaucgcaaaagucaccggaccgagcaccggggcagucgggagaaacaucgaguucucaggcaaagacuccaaggacgaggacggcaaaaucgucagcuacgacugggacuucggagacggcgcaacaagccggggcaagaacucaguccacgccuacaagaaagcaggaaccuacaacguaacacuaaaaguaaccgacgacaaaggggcaacagccaccgaaucguucaccauagaaaucaaaaacgaagacaccaccacccccauuacgaaagagauggaaccgaaugacgacaucaaagaggcuaacggcccuaucgucgagggcguaaccguaaaaggcgaccuuaacggaucggaugacgcagacaccuucuacuucgacguaaaagaagauggcgacgucacuaucgagcucccauacuccggcuccagcaacuucaccuggcucguauacaaggaaggugacgaccagaaccacaucgcuucggggauagacaaaaauaacucuaaaguuggcacauucaagagcacaaaaggccggcauuacguuuucauauacaagcacgacuccgcuucaaacaucaguuacagccucaacaucaagggacugggaaaugagaagcucaaagagaaagagaacaacgacuccuccgacaaagccacgguaauacccaacuucaauacgaccaugcaagguucucuacucggcgacgacagcagggacuacuacucguuugaggucaaggaggaaggcgaaguaaacauagagcuugacaagaaagacgaguucggugugacguggacacuacacccagaguccaacauaaaugacagaauaacauacggccagguagacggcaacaaggugagcaacaaagucaaacuccgacccgguaaauacuaccuauuagucuacaaauacuccggaagcgggaacuacgagcuacgcgucaauaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2131 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt8)
gggagaaagcuuaccaugaaauggguaaccuucauaucccuccuguuccuauucucaucagcauacagcaugaagaaaaacauccucaaaauccuaauggauagcuacucaaaggaaaguaaaauccagacgguucgccgagugacguccgucucccuucuagcaguauaccucacuaugaacacaagcucccuaguccuggccaaacccauugaaaacaccaacgacaccucuauaaagaacguagaaaaacuccgaaacgccccaaacgaggaaaacucaaagaaaguagaggauucuaaaaacgacaaaguagaacacgucaaaaacauagaagaggccaaaguagaacaagucgccccggaagucaaauccaaaagcacgcugcggucggcgucucgccggcgacggaaacgcauagcaaacacaaacucggaaaaauacgacuucgaauaccucaacggacucagcuacaccgaacugacgaaccucaucaaaaacaucaaauggaaccaaaucaacggacuguucaacuacuccacaggaucccaaaaguucuucggcgacaaaaaccgaguacaggcgaucauaaaugcccugcaggaaagcggcagaacuuauaccgcaaaugacaugaagggcaucgaaacguucaccgagguccugagagcgggcuucuaccuaggauacuacaacgacggacucagcuaccucaacgaccgcaacuuucaggauaaaugcauaccggcaaugaucgcaauccagaaaaaccccaacuucaaacuuggaacagcgguacaagaugaggucaucacaucgcugggaaagcuaauaggaaacgccuccgcaaacgccgaaguagucaacaacugcgucccuguauuaaaacaauuccgugagaaccucaaccaauacgcccccgacuacgucaaaggcaccgccgucaacgaacugauaaagggcauagaguucgacuucaguggagcagcauacgaaaaagacgucaagaccaugcccugguacggcaaaaucgaucccuucaucaaugaacucaaagcgcuuggccucuacggaaacauaaccucugccacagaaugggcaagcgacgucggaauauauuaccuauccaaauucggccucuacagcacaaacagaaacgacauaguacagucacucgaaaaagcugucgacauguacaaauacggaaagauagcauucgucgcaauggaacgcauaacaugggacuacgacggcauaggguccaacggcaagaaaguagaccaugacaaguuccuagacgacgcagaaaaacacuaccugcccaagaccuacaccuucgacaacggaaccuucauaauccgagcaggcgacaaaguaagcgaagagaaaauaaaacgccuauacugggccagucgagaagucaaaucacaauuccaccgagucguaggcaacgacaaggcacuagaagugggaaacgccgacgauguccuaacuaugaaaaucuucaacagcccggaagaauacaaauucaacaccaacaucaacggggucucaaccgacaacggcgggcuguacauagagccgcgcggcacguucuacacguacgagcgcacaccccaacaaagcaucuuuucgcuagaagaacuuuuccgacacgaauauacccacuacuuacaggcucgauaccucguagauggccuauggggccaaggcccauucuacgaaaagaacagacucaccugguucgacgaaggaaccgcagaguucuucgcaggaucgaccaggacgagcggcguccucccaaggaaauccauacuuggauaccucgcaaaagauaagguagaccaccgguacucacuuaaaaagacucucaacucaggauacgacgacuccgacuggauguucuacaacuacggcuuugccguggcucacuaucuguacgaaaaggacaugcccaccuucaucaagaugaacaaagccauccucaacaccgacguaaaaagcuacgacgaaauaaucaagaaacucucagacgacgcgaauaaaaacacagaauaccaaaaucacauacaagagcucgccgacaaauaccagggcgcggggauaccgcucgucucugacgacuaccucaaagaccacggguacaagaaagccagcgaggucuacagugaaaucagcaaagccgccucgcuaaccaacaccagcguaacggcggagaaaagccaguacuucaacaccuucacacuaagaggaaccuauaccggugagaccagcaaaggcgaguucaaggacugggacgaaauguccaagaaauuagacgggacccuagaaucgcuggccaaaaacuccuggaguggguauaagacccuuaccgcguacuucacaaacuacagagugaccagcgacaauaaaguccaguacgaugucguguuccacggcgugcuaacagacaaugcagacaucucaaacaacaaagccccaaucgccaaagucacgggacccagcacaggcgccguaggccgcaacaucgaauuuucagguaaggauucaaaagacgaagacggcaagaucgucagcuacgacugggacuucggagacggcgccaccagcagagggaaaaacucaguacacgcguacaagaaggccgggaccuacaacgucacccuaaaaguuacggaugacaaaggcgccacagccacggaauccuucaccauagaaaucaagaacgaggacacaacuacccccauaaccaaagagauggagccaaacgaugacauaaaagaagcuaacggcccaaucguggaaggcguuacugucaaaggggaccuaaacggcucagacgacgccgacaccuucuacuuugacguaaaagaagacggggacgucacaauagaacucccauacuccggaaguagcaacuucaccuggcuaguguacaaggaaggggaugaucaaaaccacauagcauccggcauagacaagaacaacucaaaaguugggaccuucaaaucgaccaaaggccggcacuacguauucaucuacaaacacgacuccgcaaguaauauaucauacagccuaaacauaaaggggcugggaaaugaaaaacuuaaggaaaaagaaaacaacgacaguagcgacaaagcaacagugauccccaacuucaauacaaccaugcaaggcucacuccucggagaugacucaagggacuacuacucauucgaagugaaggaagaaggcgaagucaacaucgaacucgacaagaaggacgaguucggcgucaccuggacccuccacccugaaucaaacauaaacgacaggaucaccuacggccaaguagacggaaacaaagugucaaacaagguaaaacucagaccggggaaauauuaccuacugguguacaaauauucuggaagcggaaacuacgaacuacgagucaacaaauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2132 - RNA, 3322 nt, Artificial Sequence
  mRNA product Design1 comprising derived and/or modified sequence from Clostridium histolyticum__BAA34542.1__ColH (opt8)
gggagaaagcuuaccaugaacuuccucaaaauaauccuaaaccgaggcaaaaccaugaagcgcaaaugccucagcaagagacucaugcucgcaaucaccauggcuacaaucuucacaguuaacucaacucuccccaucuacgccgcgguagacaaaaacaacgcaaccgccgccguccaaaaugaaucuaaacgauacacagucagcuaccuaaaaacccuuaacuacuacgaccucguagaccugcucgugaaaaccgaaaucgagaaccucccggaccuguuccaauauuccagcgaugccaaagaguucuacgggaacaaaacacgaaugucguucaucauggacgaaaucggacgccgagcgccccaauacaccgagauugaucauaagggaaucccgacgcucgucgaagucguccgagccggguucuaucucggcuuccacaacaaggaacucaacgagauaaacaaacgcucuuucaaggaacgcgucauaccguccauacuugccauacagaaaaaccccaauuucaagcucggaacagaaguacaagacaaaaucguauccgccaccggccugcuagccggaaacgaaaccgcaccaccagaagucgucaacaacuucacucccauccuucaagacugcaucaagaacaucgacagauaugcauuggacgaccuaaaaucaaaagcacuguucaacguucuagccgcgcccacauaugauauaaccgaauaccucagagcaacaaaggagaaacccgaaaacacucccugguacggcaaaaucgacggcuucaucaacgaacuaaagaaacucgcauuauacggcaaaaucaacgacaacaacaguuggaucauagacaacggcauauaccacaucgcgccacuaggaaaacuacacucuaacaacaaaaucggaaucgaaacacuaaccgaagucaugaagguauaccccuaccugagcaugcaacaccuucaaucugcagaucaaaucaaacgacacuacgacagcaaagacgccgagggaaacaagaucccauuagacaaauucaagaaagaaggaaaagagaaauacugcccaaagaccuacacguuugaugauggcaaaguaaucauaaaggccggcgcacgcgucgaggaagaaaaagucaaacgccuguacugggcgucaaaagaagucaacucccaauucuuccgagucuauggcaucgacaaaccccucgaggaaggcaaccccgacgacauacugacaauggucauuuacaacucgccugaggaauacaaacugaacucagugcuauacggcuacgacaccaacaacggcggcauguacaucgaacccgaaggcacuuucuucacuuacgagagagaggcccaagaauccacguacacacuagaagaacuuuuccgacacgaguacacccacuaccuccaaggccguuacgcagucccgggacaauggggacgaacgaaacucuacgacaacgacaggcugaccugguacgaagagggcggggcggaacuauucgcagggagcaccaggacaucggggauacuucccaggaaauccaucgucuccaacauccacaacacaacacgaaauaaucgguauaaacugagcgauaccguccacucaaaauacggcgcgucauucgaguucuacaacuacgccuguauguucauggacuacauguacaacaaagauaugggaauccucaacaaauuaaacgaccucgcuaagaacaacgacguagacggcuacgacaacuacauaagagaccuauccucaaacuacgcucugaacgacaaauaccaagaccacaugcaggaacgaaucgacaacuacgaaaaccucaccgucccguucgucgccgacgacuaccucgugagacacgccuacaaaaaccccaacgaaaucuacagcgagaucagcgaagucgccaaacucaaggacgcaaaauccgaggucaaaaagucucaauacuucagcaccuucacucuacgcggcucauacacgggcggcgccuccaaaggcaaauuagaagaccaaaaagccaugaacaaguuuaucgacgacagccucaagaaacuugacaccuacucguggaguggcuacaaaacucuaaccgccuacuuuacaaacuacaaagucgacucguccaaccgcgugacauacgacguagucuuccacggguaccuaccgaacgagggagacagcaaaaacagccuccccuacggaaaaauaaacggcacauacaagggaaccgaaaaagagaaaauaaaauucuccuccgaaggcucguucgaccccgaugguaagauaguauccuacgaaugggacuucggagacggcaauaaaagcaaugaggaaaacccagaacacucauacgacaaaguagggaccuacaccguuaaauuaaaagucacggacgacaaaggagagucgagcgucucaaccaccaccgccgagauaaaagaccuauccgaaaacaaacuacccguaaucuauaugcacgucccaaaaucaggcgcacucaaucaaaagguugucuucuauggaaaaggcaccuacgacccggacggcagcauagcgggcuaccaaugggacuuuggcgacgguucggacuucucgucagagcaaaacccuagccauguauacaccaagaaaggagaauacaccguaacccugcgagugauggauucaucuggccaaaugucugagaaaacaaugaaaauaaaaaucaccgacccaguauaccccaucgguaccgaaaaagaaccuaacaacaguaaagaaacugcaagcggacccaucguccccggcauuccugucucaggaaccaucgaaaacaccagcgaucaggacuacuucuacuuugauguaaucacccccggcgaagucaaaaucgacaucaacaaacuaggauacggcggagccacauggguggucuacgacgagaacaauaacgccgucucuuacgcaaccgacgauggacaaaaccucagcgguaaauuuaaagcagacaagcccggacgcuacuacauccaccuauacauguuuaacggcuccuacaugcccuaucgaauuaacauugagggcucaguaggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2133 - RNA, 3283 nt, Artificial Sequence
  mRNA product Design1 comprising derived and/or modified sequence from Clostridium histolyticum__BAA34542.1__ColH (opt8)
gggagaaagcuuaccaugaaaagaaaaugccuauccaaacgccucaugcuugcaauaacaauggccacaauauuuaccgucaacuccacccuaccaaucuacgccgccguagauaaaaacaacgcaacagcagccguccaaaacgagagcaaacgauacaccguaucauaccucaagacccuaaacuauuacgaucuaguggaccuccucguaaagacggagaucgaaaacuuaccggaucuauuucaauacuccuccgacgcaaaagaguucuacgguaacaagacacgaauguccuucaucauggacgaaaucggacggcgcgcaccccaauacaccgaaaucgaccacaaaggcauacccacccuugucgaaguuguacgagccggcuucuacuuaggauuccacaacaaggaacucaacgaaaucaacaaacgcuccuucaaagaacgagucauccccuccauccucgcuauucagaagaacccaaacuucaagcucgggaccgagguacaagauaagauagucagcgccaccggccugcuggccggcaaugagaccgcgcccccagagguaguaaacaauuucaccccaauccuacaagauugcaucaagaauaucgaccgcuacgcccuggacgaccuaaaauccaaggcccucuucaacgugcuggccgcgcccaccuacgauaucaccgaauaccucagagcuaccaaagagaaacccgagaacacucccugguauggcaagauagacggcuuuauaaacgaacucaaaaagcuagcacuguacggcaagaucaaugauaacaauucauggaucaucgacaacgggauauaccacauugccccguuagguaaacugcacagcaacaauaaaauaggaaucgagacccuaacugaggucaugaaaguauaucccuaucuuagcaugcaacaccuacaauccgcggaccaaaucaagcgccacuacgacagcaaagacgcugaggggaacaaaaucccccuggacaaguucaagaaagagggcaaggagaaauacugcccaaaaaccuacaccuucgacgacggcaaagucauaaucaaagccggcgcgagaguagaggaagaaaaaguaaagcggcucuacugggccagcaaagaagucaacagucaauucuuccgcgucuacggcaucgauaaaccacuagaagagggaaaucccgacgacauacuaacaaugguaauauacaacagcccagaggaguacaaacugaacuccguccuuuacggauacgauacaaacaacgggggaauguauauagaaccggaaggcacauuuuucaccuacgaacgcgaggcccaggaaucaacauauacacucgaggaguuauuccgccacgaauacacccacuaccuacagggacgcuacgcaguaccagggcaguggggccgcacaaagcucuacgauaacgaccgccuaacgugguacgaagaagggggcgccgaacucuucgccggauccacccgcaccagcgggauccuaccgcgaaagaguauagugagcaacauccauaacaccacgcgcaacaaccgcuacaagcucucagacacaguccacagcaaguacggagcaucguucgaguucuacaacuacgcauguauguucauggacuacauguacaacaaagacaugggcauccucaacaaacucaacgaucucgcgaaaaauaacgacgucgacggauacgacaacuauauccgcgaccucucauccaacuacgcacucaacgacaaauaccaagaccacaugcaggaacgaauagacaacuacgaaaauuuaaccguaccauucguagccgacgacuaccuaguacgacacgccuacaaaaacccuaacgaaaucuacuccgagaucuccgaaguugccaaacucaaagaugccaaaucagaagucaagaaaucccaguacuucagcacauucacucugagaggcagcuacacgggcggcgcguccaaaggaaaacuagaagaucagaaagccaugaacaaauucaucgacgacucucuaaagaaacucgacacauacucguggagcgguuacaaaacacugacugccuacuuuaccaacuacaaagucgacaguucaaaucgagucaccuacgacgugguauuucacgguuaccuacccaacgaaggggacuccaaaaacucacuaccuuacggaaaaauaaaugggaccuacaaaggcacagaaaaagagaaaaucaaauucuccuccgaaggcagcuucgacccugacggaaagaucgugagcuaugaaugggacuucggcgacggcaacaaaucaaacgaagaaaaccccgagcauucauaugacaagguaggaaccuacacagucaagcugaaaguaaccgacgacaaaggggaaucaagcguaagcacuaccaccgccgagaucaaggacuuaagcgaaaacaaacugccaguaauuuauaugcacgucccaaaaucaggcgcccuaaaccagaaggugguauuuuacgguaaagggacguacgaucccgacggcagcaucgccggcuaucagugggacuucggugacggcagcgacuucucaagcgaacaaaaccccagccacguuuacacgaaaaagggcgaauacacagugacacuuagagucauggauagcucgggucaaaugagugagaaaacgaugaaaauaaagaucaccgaccccguguaccccaucggcaccgaaaaggaaccgaacaacucaaaagaaaccgccuccgggcccaucguacccgggaucccuguaucuggcacaauagaaaacacaagcgaccaagacuacuucuacuucgacgucauaacccccggcgaagucaaaaucgauaucaacaaacucggauacggcggagcgacauggguaguguacgacgaaaacaacaacgcaguauccuacgccacagacgacggccaaaaccucuccggcaaauucaaggccgacaagcccggacgauacuacauacaccucuacauguucaacggaucauacaugcccuaccggauaaacaucgaaggaucggugggacgguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2134 - RNA, 3217 nt, Artificial Sequence
  mRNA product Design1 comprising derived and/or modified sequence from Clostridium histolyticum__BAA34542.1__HsALB(1-18)_ColH(41-1021) (opt8)
gggagaaagcuuaccaugaaaugggucacauuuaucagccuccuuuuccuuuucagcucggccuacagcguccaaaacgaaaguaaaagauauaccguauccuaucucaaaacuuuaaacuauuacgaccuaguagaccuccugguaaagacugaaauagaaaaccugccagaccuauuccaauacagcuccgacgcuaaggaguucuacgggaacaaaacccgcauguccuucaucauggacgaaaucgggcgacgcgcaccacaguacaccgaaauagaccacaaagggauucccacucuagucgaggugguacgagccggauuuuaccuuggauuccacaacaaagaacucaacgaaauaaauaagcgaucauucaaagagcggguuaucccaagcauacuggcaauccaaaagaauccaaacuucaaacuuggcacagaaguccaggacaaaauagucuccgccaccgggcuccucgccgggaaugaaaccgcacccccagaagucgugaauaacuucacccccauucuccaggacuguauaaagaacaucgaccgcuacgcacucgacgaccuuaagucaaaagcgcucuuuaacguccucgcggcgccuacauacgacaucacagaauaccuucgcgcgaccaaggaaaagccagaaaacaccccaugguacggaaaaauagacggguucaucaacgaacuaaagaaacuagcgcuauacggcaaaaucaacgacaacaacagcuggaucauugacaacggcauauaucacauagcaccccugggaaaacuccacagcaauaacaagaucggcaucgaaacccuaaccgaaguaaugaaagucuacccguaccucuccaugcagcaucuccagagcgccgaccagauaaaacgacacuacgacucaaaagacgcagaagguaauaagaucccacuggacaaguucaaaaaggagggcaaagaaaaauacugcccuaaaacauacaccuucgacgacggaaagguaauaauuaaagccggagcacgaguagaagaagaaaaaguaaaacgccucuacugggccucaaaggaaguuaauucacaguucuuccgaguguacgguauagacaaaccacuggaggagggaaacccagaugacauacugacgaugguaauauacaacuccccggaagaauacaaacuaaauucaguacuguacggauacgacaccaacaaugggggaauguacaucgaaccagaaggcaccuucuucaccuacgagcgcgaagcccaggagucgacauauacccuagaagaacuguuucgccacgaguacacgcacuacuuacaagggcgcuacgccguccccgggcaguggggccgaaccaaacuguacgacaacgaccgccucaccugguacgaagaagggggagcagaacucuucgcaggaucgacccgcaccagcggaauacucccccgcaagaguauagucagcaacauccacaacaccaccaggaacaacagauacaaacuuucagacaccguucacagcaaguacggggccuccuucgaguuuuacaacuacgcaugcauguucauggauuauauguacaacaaagacaugggaauacuaaacaaacucaaugaccucgccaaaaacaacgacgucgacggcuacgacaacuacauccgagaccucagcagcaacuacgcccuaaacgacaaauaucaagaccacaugcaggagaggauagauaacuacgaaaaucucaccgugccauucguagccgacgacuaccucguacgucacgccuacaaaaaccccaacgaaaucuacagcgagaucucggaaguagcaaaacuaaaagaugcuaaaucagaggugaagaaaucccaauacuucucgaccuucacucuccgcggcuccuacacaggaggagccagcaaagguaaacuagaggaccaaaaagcaaugaacaaauucaucgacgacucccucaagaaacucgauaccuacagcuggagcggauacaaaacguuaaccgcauauuucaccaauuacaaaguggacaguuccaaccgaguaaccuacgauguaguguuccauggcuaccuacccaacgagggcgacagcaaaaacucacuccccuacggaaagaucaacgggacauacaagggcacggaaaaagagaaaaucaaauucagcucagaaggcuccuucgaccccgacggcaagauugucuccuacgagugggacuucggggacggcaacaaaucgaacgaggagaacccagaacacagcuacgacaaggucggcacguacaccgucaagcucaaaguaacagacgacaagggggaauccagcguaagcacgacaacagcagaaaucaaggaccuauccgaaaauaaacuaccggugauauacaugcaugucccuaaauccggcgcucugaaucagaaggugguauucuacgggaagggcacguacgaccccgacggauccauagcaggcuaccaaugggacuucggcgaugguucggacuuuucguccgagcagaacccaagccacguauacacaaagaaaggggaguauaccgucacacuucgagucauggacagcaguggccagaugagugagaaaacaaugaaaaucaaaaucacagaucccguuuacccgaucggcacagaaaaagaaccaaacaauuccaaagagacggcgucaggcccaaucgugcccggaauccccguuucgggaaccauagagaacacaagcgaccaagacuacuucuacuucgacgucaucaccccaggcgagguaaaaauagacauaaacaaacuaggauacggaggcgcaacaugggugguauacgacgaaaacaacaacgcggucagcuaugcaacggacgacggccaaaaccuaucaggaaaguucaaggccgacaagcccggaagguacuauauacauuuguacauguucaacggcagcuacaugcccuacagaaucaacaucgaaggcagcgucggccgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2135 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt8)
gggagaaagcuuaccaugaaaugggugaccuucauaucacuccuuuuccuauucucaucagcauacucgaugaaacgcaaaugccucagcaaacgacucaugcuagcuaucaccauggccacaauauucaccguaaacuccacccuacccaucuacgcggcaguggacaaaaacaacgccaccgccgcacgucgccgccggaaacgcguccaaaacgaaaguaagcgcuauacggugagcuaccucaaaacucucaacuacuaugaucuaguagaccuccuagucaaaacggaaauugaaaaccuccccgaccuauuccaguacucaucagacgcgaaagaguucuacggcaacaaaacccggauguccuucauaauggacgaaaucggaaggcgagcaccccaguauaccgagaucgaccacaagggcauccccacgcucguagaaguaguuagagcaggcuucuaccucggguuccacaacaaagaacuaaaugagaucaacaaacgcuccuucaaagaacgcgucauccccucaauacuagcaauccagaaaaaccccaauuucaaacuaggcaccgagguacaagauaaaaucguguccgcaacaggccuccuggcagguaaugaaaccgcgccgccagaaguagucaacaacuucacacccauccuucaggacugcaucaaaaacauagacagauacgcacucgacgaccucaaaagcaaagcacuauucaacguccucgcagcacccacauaugacauaacggaauaccuuagagcaaccaaagaaaaacccgaaaacacacccugguaugggaaaauagacggcuucaucaacgagcuuaaaaagcuggcacuuuacgggaaaauaaacgacaacaacagcuggaucauagacaacggcauuuaccacaucgcaccccuggggaaauugcacagcaacaacaaaaucggcauagaaacccucacggaggucaugaaaguuuacccauaccugucaaugcaacaccuccaauccgccgaccagaucaaacgacacuacgacagcaaagacgccgaaggcaacaagauaccacuagacaaguucaagaaagaaggcaaagaaaaauauugcccuaaaaccuacacauucgacgacggaaaaguaaucauuaaagccggcgcccguguagaagaagaaaaggucaaacgccuauacugggccagcaaagaaguaaauagccaauucuuccgcguauacgggauagacaaaccgcuagaagaaggaaaccccgacgacauacugaccaugguaauauauaacucaccggaagaauacaaacucaacagcguacuauacggcuaugacaccaauaacggaggaauguacaucgagccagaaggaacauucuucacguacgaacgugaagcacaagaauccacauacacccucgaggaacucuuccgucacgaguacacccacuaccuacaggggcgauacgccguacccggccaauggggccgcaccaaacuguaugacaacgaccggcucaccugguacgaagaagggggcgccgaacucuucgccgguucgaccaggacuucaggaauacugccccgcaagagcaucguaagcaacauccacaauacaacccgcaacaaccgcuacaaacuaucagacacaguccacuccaaauacggagcgucauuugaguucuacaacuacgcuugcauguuuauggauuauauguacaacaaagauauggggauccugaauaaacuaaacgaccuagcgaaaaacaacgacguugacggcuacgacaacuacauacgugaccucucaucaaacuacgcccuaaacgacaaauaccaggaccacaugcaagaacgcaucgacaauuacgaaaaccuaacagugccuuuugucgccgacgacuaccucguacggcacgcuuacaaaaaccccaacgaaaucuauucagaaaucucagaagucgccaaauuaaaagacgcuaaauccgaagucaagaagucccaauacuucuccacauuuacccucagaggcucauacaccggaggcgcauccaaaggcaaacuggaggaccaaaaagccaugaacaaauucaucgaugacagucuaaagaaacucgacaccuacuccugguccggauacaaaacgcuaacagccuacuucacaaacuacaaaguagacagcuccaaccgagucaccuacgacgucgucuuccaugguuaccuccccaacgaaggugacagcaaaaauucacuccccuacggcaaaauaaacggcaccuacaaaggcaccgaaaaggagaaaaucaaauucucaucggaaggcagcuucgacccagacgggaagauaguaucguaugaaugggacuucggggacggcaacaaauccaaugaagagaaccccgaacauuccuaugacaaaguggggaccuacacaguuaagcuaaaaguaaccgacgacaaaggcgaaucauccguaucaaccacaacggccgagauaaaagaucuaagcgaaaacaaacuccccguaauauacaugcacgucccuaaaucgggagcucucaaccaaaaagucguauucuacggaaaaggaacauacgacccugacggcuccauagccggcuaccaaugggacuuuggcgacggcagcgacuucuccagugagcaaaaccccucacacgucuacacgaaaaagggcgaauacaccgugacacuucgcguaauggacagcagcggccagauguccgagaaaaccaugaaaaucaagauuaccgacccagucuaccccauaggcaccgaaaaggaaccgaacaauagcaaggaaacagccagcggcccaauagucccggggauccccgucuccggcacgaucgaaaacacuuccgaccaggacuacuucuacuucgacguaauaacccccggcgaaguaaaaaucgacaucaacaaacuaggauacggaggcgccaccugggucgucuacgaugaaaacaacaacgccguauccuaugccacagacgauggccagaacuugucaggcaaguucaaagcugacaagcccggacgcuacuacauccaccuguacauguucaauggcuccuacaugccauaccgaauaaacaucgaaggaucggucggacgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2136 - RNA, 793 nt, Artificial Sequence
  mRNA product Design1 comprising derived and/or modified sequence from Homo sapiens__NP_001133.1__HsAMELX (opt8)
gggagaaagcuuaccaugggcaccuggauccuauucgcaugccuccucggagccgccuucgccaugccccuccccccccaccccggccaccccggcuacaucaacuucucuuacgaaguccucaccccccuaaaaugguaccaaucaauucgcccccccuauccauccuacggcuacgaacccaugggcggcuggcuacaccaccaaauaauacccguccucucccaacaacacccccccacccacacccuccaaccccaccaccacauccccgucguccccgcacaacaacccgucaucccccaacaaccaaugaugccagucccaggccaacacucuaugacccccauccaacaccaccaacccaaccuccccccccccgcacaacaaccauaccaaccccaacccguccaaccacaaccccaccaacccaugcaaccccaaccccccguccaccccaugcaaccccucccaccccaaccaccccucccccccauguuccccaugcaaccccucccccccaugcuacccgaccuaacccucgaagccuggcccuccacagacaaaacaaaacgagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2137 - RNA, 352 nt, Artificial Sequence
  mRNA product Design1 comprising derived and/or modified sequence from Homo sapiens__NP_001133.1__HsAMELX-TRAP (opt8)
gggagaaagcuuaccaugccccucccaccccaccccggccaccccggauacauaaacuucuccuacgaaguccuaacaccccuaaaaugguaccaauccauacgcccacccuaccccuccuacggcuacgaacccaugggcggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2138 - RNA, 385 nt, Artificial Sequence
  mRNA product Design1 comprising derived and/or modified sequence from Homo sapiens__NP_001133.1__HsAMELX-LRAP (opt8)
gggagaaagcuuaccaugccccucccaccccaccccggccaccccggcuacauaaacuucuccuacgaaguccucacaccacucaaaugguaccaauccauccgcccaccacccaugcuccccgaccucacccucgaagccuggcccuccaccgacaaaacaaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2139 - RNA, 424 nt, Artificial Sequence
  mRNA product Design1 comprising derived and/or modified sequence from Homo sapiens__NP_001133.1__HLA-A2-SP_HsAMELX(17-60) (opt8)
gggagaaagcuuaccauggccgucauggcaccccgaacccuaguccuacuccuauccggcgcccuagcccucacccaaaccugggccaugccacuaccaccccacccaggccaccccggcuacaucaacuucuccuacgaaguacucacaccacuaaaaugguaccaauccauccgaccacccuaccccuccuacggcuacgaacccaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2140 - RNA, 457 nt, Artificial Sequence
  mRNA product Design1 comprising derived and/or modified sequence from Homo sapiens__NP_001133.1__HLA-A2-SP_HsAMELX(17-47,168-191) (opt8)
gggagaaagcuuaccauggccguaauggcaccccgaacacucguacuccuccucuccggagcacuagcccucacccaaaccugggccaugccccuccccccacaccccggccaccccggcuacauaaauuucuccuacgaaguccucaccccccucaaaugguaccaauccauccgccccccccccaugcuccccgaccuaacacucgaagccuggcccucaaccgacaaaacaaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2141 - RNA, 796 nt, Artificial Sequence
  mRNA product Design1 comprising derived and/or modified sequence from Homo sapiens__NP_001134.1__HsAMELY (opt8)
gggagaaagcuuaccaugggcaccuggauccuauucgcaugccuagucggcgccgccuucgccaugccccucccaccccaccccggccaccccggcuacaucaacuucuccuacgaaguacucaccccacucaaaugguaccaauccaugauacgcccacccuacuccuccuacggauacgaacccaugggcggcuggcuccaccaccaaauaauccccgucguuucccaacaacacccccucacccacacccuccaaucacaccaccacauccccguaguccccgcccaacaaccccgaguccgccagcaagcccucaugcccguaccaggccaacaaucaaugacccccacccaacaccaccaacccaaccucccccuccccgcccaacaacccuuccaaccccaacccguccaaccccaaccacaccaaccaaugcaaccccaaccacccguccaacccaugcaaccccuucucccccaaccuccccuaccacccauguucccccuccguccucucccacccauccuccccgaccuccaccucgaagccuggcccgccaccgacaaaaccaaacaagaagaaguagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2142 - RNA, 355 nt, Artificial Sequence
  mRNA product Design1 comprising derived and/or modified sequence from Homo sapiens__NP_001134.1__HsAMELY-TRAP (opt8)
gggagaaagcuuaccaugccccuaccaccccaccccggccaccccggcuacauaaacuucuccuacgaaguccucaccccacucaaaugguaccaaucaaugauacgaccacccuacuccucauacggcuacgaacccaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2143 - RNA, 388 nt, Artificial Sequence
  mRNA product Design1 comprising derived and/or modified sequence from Homo sapiens__NP_001134.1__HsAMELY-LRAP (opt8)
gggagaaagcuuaccaugccccuccccccacaccccggccaccccggcuacauaaacuucuccuacgaaguccuaacaccacucaaaugguaccaauccaugauccgccccccccccauacuccccgaccuccaccucgaagccuggcccgccacagacaaaaccaaacaagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2144 - RNA, 427 nt, Artificial Sequence
  mRNA product Design1 comprising derived and/or modified sequence from Homo sapiens__NP_001134.1__HLA-A2-SP_HsAMELY(17-61) (opt8)
gggagaaagcuuaccauggccgucauggccccacgcacacucguccuccuacucucaggagcccucgcacucacacaaaccugggccaugccacucccaccacaccccggccaccccggcuacaucaacuucucauacgaaguccucaccccacucaaaugguaccaaucaaugauacgcccacccuacuccuccuacggcuacgaacccaugggcggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2145 - RNA, 460 nt, Artificial Sequence
  mRNA product Design1 comprising derived and/or modified sequence from Homo sapiens__NP_001134.1__HLA-A2-SP_HsAMELY(17-48,169-192) (opt8)
gggagaaagcuuaccauggcagucauggcaccccgcacccucguccuacuacucuccggcgcccucgcccucacccaaacaugggccaugccacucccaccccaccccggacaccccggcuacaucaacuucucauacgaaguccucaccccacucaaaugguaccaauccaugauccgacccccacccauccuacccgaccuccaccucgaagccuggcccgccaccgacaaaaccaaacaagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2146 - RNA, 787 nt, Artificial Sequence
  mRNA product Design1 comprising derived and/or modified sequence from Sus scrofa__NP_999071.1__SsAMELX-001-1 (opt8)
gggagaaagcuuaccaugggcaccuggauccucuucgcaugccuccucggcgccgccuucuccaugccucuaccaccccaccccggccaccccggcuacauuaacuucuccuacgaaguccuaacuccccuaaaaugguaccaaaacaugauccgacaccccuacaccuccuacggauacgaacccaugggcggauggcuccaccaccaaaucauccccgucgucucccaacaaacaccccaaucccacgcccuacaaccccaccaccacauccccaugguacccgcccaacaacccgguauaccccaacaacccaugaugccccuccccggccaacacucaaugacccccacccaacaccaccaacccaaccuaccccuacccgcacaacaacccuuccaaccccaaccaguccaaccccaaccccaccaaccacuccaaccccaaucccccaugcaccccauccaaccccuccucccacaaccaccccucccacccauguucuccaugcaaucacuccuccccgaccucccccucgaagccuggcccgcaaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2147 - RNA, 355 nt, Artificial Sequence
  mRNA product Design1 comprising derived and/or modified sequence from Sus scrofa__NP_999071.1__SsAMELX-TRAP (opt8)
gggagaaagcuuaccaugccccuaccaccccacccaggccaccccggcuacaucaacuucuccuacgaaguccucacaccacucaaaugguaccaaaacaugaucagacacccauacaccucauacggcuacgaacccaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2148 - RNA, 388 nt, Artificial Sequence
  mRNA product Design1 comprising derived and/or modified sequence from Sus scrofa__NP_999071.1__SsAMELX-LRAP (opt8)
gggagaaagcuuaccaugccacuacccccacaccccggccaccccggcuacauaaacuucucauacgaaguacucaccccacucaaaugguaccaaaacaugauccgacaccccucccuccuccccgaccucccccucgaagccuggcccgccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2149 - RNA, 427 nt, Artificial Sequence
  mRNA product Design1 comprising derived and/or modified sequence from Sus scrofa__NP_999071.1__HLA-A2-SP_SsAMEL(17-61) (opt8)
gggagaaagcuuaccauggcagucauggcaccccgcacacucguccuccuacuaucaggagcccucgcacucacacaaacaugggccaugccccuaccaccccaccccggacaccccggcuacauaaacuucuccuacgaaguccuaacaccccuaaaaugguaccaaaacaugauccgacaccccuacaccuccuacggcuacgaacccaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2150 - RNA, 460 nt, Artificial Sequence
  mRNA product Design1 comprising derived and/or modified sequence from Sus scrofa__NP_999071.1__HLA-A2-SP_SsAMEL(17-49,167-189) (opt8)
gggagaaagcuuaccauggccgucauggccccacgcacccuaguccuccuccuauccggcgcacucgcacucacacaaaccugggccaugccccucccaccacaccccggccaccccggcuacaucaacuucuccuacgaaguccucacaccccucaaaugguaccaaaacaugauccgccacccaucacuccucccagaccucccacucgaagccuggcccgccaccgacaaaaccaaacgcgaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2151 - RNA, 751 nt, Artificial Sequence
  mRNA product Design1 comprising derived and/or modified sequence from Sus scrofa__P45561-2__SsAMELX-001-2 (opt8)
gggagaaagcuuaccaugggcaccuggauacucuucgcaugccuccucggcgccgccuucuccaugccccucccaccccaccccggccaccccggcuacaucaacuucuccuacauccgccacccauacaccuccuacggcuacgaacccaugggcggcuggcuacaccaccaaaucauccccgucgucucccaacaaacaccccaaucccacgcccuacaaccccaccaccacaucccaaugguccccgcccaacaaccaggcaucccacaacaacccaugaugccccuacccggccaacacucaaugaccccaacucaacaccaccaacccaaccuaccccuacccgcccaacaacccuuccaaccccaacccguccaaccccaaccccaccaaccccuccaaccccaaucccccaugcaccccauccaaccccuccuaccccaaccaccccucccacccauguucucaaugcaaucccuacuccccgaccuaccccucgaagcauggcccgcuacagacaaaacaaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2152 - RNA, 787 nt, Artificial Sequence
  mRNA product Design1 comprising derived and/or modified sequence from Sus scrofa__NP_998965.1__SsAMELX-001-3 (opt8)
gggagaaagcuuaccaugggaaccuggaucuucuucgccugccuccucggcgccucccucgcaaugccccucccaccccaccccggccaccccggcuacaucaacuucuccuaugaaguacucacaccccucaaaugguaucaaaacaugauccgccaccccuacacauccuacggcuacgaacccaugggcggcuggcuacaccaccaaaucauacccgucgucucacaacaaacaccccaaucacacgcccuccaaccccaccaccacauccccaugguccccgcccaacaacccggcaucccccaacaacccaugaugccccuaccaggacaacacuccaugaccccaacccaacaucaccaaccuaaucucccccuccccgcccaacaacccuuccaaccccaacccguccaaccccaaccccaccaaccccuccaaccccaaucccccaugcacccuauccaaccccuccucccccaaccaccccucccacccauguucuccaugcaaucacuccuacccgaccucccccucgaagccuggccugccaccgacaaaacaaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2153 - RNA, 436 nt, Artificial Sequence
  mRNA product Design1 comprising derived and/or modified sequence from Sus scrofa__K7GPB2__SsAMELX-002 (opt8)
gggagaaagcuuaccaugggcaccuggauacucuucgccugccuccucggcgccgcauucucaaugccccucccaccacacccaggccaccccggauacaucaacuucuccuacgaaguacucaccccacucaaaugguaccaaaacaugauccgacaccccucacuccuccccgaccucccccuagaagccuggccagccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2154 - RNA, 829 nt, Artificial Sequence
  mRNA product Design1 comprising derived and/or modified sequence from Sus scrofa__K7GLD0__SsAMELX-003 (opt8)
gggagaaagcuuaccaugggcaccuggauccucuucgccugccuccuaggcgcugccuucuccaugccacucccaccccaccccggccaccccggcuacaucaacuucuccuacgaagaccuauaccucgaagccauacgcaucgaccgcaccgcauuuguccuaaccccacucaaaugguaccaaaacaugauccgacacccauacaccuccuacggcuaugaacccaugggaggcuggcuacaccaccaaaucaucccagucgucucacaacaaaccccucaaucucacgcccuccaaccacaccaccacauccccaugguccccgcccaacaacccggcaucccccaacaacccaugaugccccuccccggccaacacuccaugacccccacccaacaccaccaacccaaccucccccuccccgcacaacaacccuuccaaccccaaccaguccaaccccaaccacaccaaccccuucaaccccaaucccccaugcaccccauccaaccccuccuaccacaaccacccuuaccucccauguuuucuaugcaaucccuccuccccgaccucccccucgaagccuggcccgccaccgacaaaacaaaacgcgaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2155 - RNA, 715 nt, Artificial Sequence
  mRNA product Design1 comprising derived and/or modified sequence from Sus scrofa__K7GPE9__SsAMELX-004 (opt8)
gggagaaagcuuaccaugggaaccuggauccuauucgccugccuccuaggagccgccuucucaaugccccuaccaccccaccccggccaccccggcuacaucaacuuuuccuacgaaguccucaccccacucaaaugguaccaaaacaugauacgccaccccacaccccaaucccacgcccuacaaccccaccaccacauccccaugguccccgcccaacaacccggcaucccccaacaacccaugaugccccuccccggccaacacuccaugacccccacccaacaccaccaacccaaccucccccuccccgcccaacaacccuuucaaccccaacccguccaaccccaaccacaccaaccacuccaaccccaaucccccaugcacccaauccaaccccuccucccccaaccaccccucccacccauguucucaaugcaaucacuacuccccgaccucccccucgaagccuggcccgccaccgacaaaaccaaaagagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2156 - RNA, 739 nt, Artificial Sequence
  mRNA product Design1 comprising derived and/or modified sequence from Sus scrofa__J9JIM4__SsAMELX-201 (opt8)
gggagaaagcuuaccaugccucucccaccccaccccggccaccccggcuacaucaacuucuccuacgaaguccucacaccccucaaaugguaccaaaacaugauccgccaccccuacaccucauacggcuacgaacccaugggcggcuggcuccaccaccaaaucauccccgucgucucccaacaaacaccccaaucacacgcacuccaaccccaccaccacauccccaugguccccgcccaacaacccggcaucccccaacaacccaugaugccacuccccggccaacacucaaugacccccacccaacaccaccaacccaaccucccacuccccgcacaacaacccuuccaaccacaacccguacaaccccaaccccaccaaccacuccaaccccaaucccccaugcaccccauccaaccccuacucccccaaccaccccuacccccaauguucucaaugcaaucccuccuccccgaccucccccucgaagcauggccagccacagacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2157 - RNA, 3178 nt, Artificial Sequence
  mRNA product Design1 comprising derived and/or modified sequence from Homo sapiens__NP_006120.1__HsBMP1 (opt8)
gggagaaagcuuaccaugccaggcguugcaagacuaccacuacucuuaggacuacuacuacuaccgcgaccaggacgaccccucgaccuagcagacuacaccuaugaccucgccgaagaagaugauagcgaaccgcuaaauuacaaagacccguguaaagcagcagcuuuucuaggcgacauagcccuggacgaggaagaccuucgggcguuccaaguacaacaggcaguagauuuacgccgacacacggcucgaaaaucaucaaucaaagcagccguuccaggaaacacgucaaccccaagcugucagucaacaaaugggcaaccccaacgcggagcgugcggacgauggcgaggccgcagcaggucccgcagagcagccaccucccgccccgaaagagucuggcccgauggaguaauaccguucguaauaggcggcaauuucaccggaucccagcgcgcggucuuccgccaagccaugagacacugggagaaacauaccugcgugacauuccucgaaagaacagacgaagacucauacauaguauucaccuaccgaccgugcggcugcugcagcuacguaggccgcagaggcggcgggccacaagcgaucagcaucggcaaaaacugcgacaaauucggaauagucguccacgaacucggccacguaguaggcuucuggcacgagcacacccgaccugaccgagaccgacacgucagcaucguaagagaaaacauacaaccagggcaagaauacaacuuccugaaaauggagccccaagaaguggaauccuuaggagaaaccuacgacuuugacucaaucaugcacuacgcaaggaacacauucucacgaggaauauuccucgacacaauaguucccaaguacgaagugaacgggguuaaaccuccgauuggccaaaggacaagacuaucaaagggcgacaucgcacaggcacgaaaacuguacaaaugccccgcaugcggggagacacuacaagacagcaccgggaacuucucaaguccggaauacccaaacggauacagugcucacaugcacugcguauggcggauaagcgucaccccgggcgagaaaauaauacuaaacuucacaagucuggaccuauaccggagccgccuuugcugguacgauuacguagaaguccgcgacggauucuggcgcaaagcgccacugaggggacgcuucugcggaucaaaacucccggaaccgauaguaucaaccgacucacgccucugggucgaguucagaagcagcucaaacugggucggaaaaggauucuuugcaguguacgaagcuaucugcggaggagacguaaagaaagacuaugggcacauacaaagccccaacuaccccgacgacuaccgcccuagcaaaguuugcaucuggcgcauacaagucagcgaaggcuuccacgucggccugacauuccagaguuucgaaauagaacgccaugacagcugcgccuacgauuaccucgaaguccgcgacggccacucggaaagcagcaccuuaaucggcagguacugcgguuacgaaaaaccagacgacauaaagagcaccucgagccgacucuggcuaaaauucguaagcgacggcagcauaaacaaagcgggcuuugcaguuaacuucuucaaagaaguggacgaaugcuccaggccaaaccgaggcgggugcgaacaaagaugucuaaauacacucggcagcuacaaaugcagcugcgacccgggauacgaacucgcccccgacaaaagaaggugcgaagccgccugcggaggguuccucacaaaacuaaacgggagcaucacuucaccgggauggccaaaagaauacccaccaaauaagaacugcaucuggcaacucgucgcacccacccaauaccgcaucagccuacaauucgacuucuucgaaaccgaaggcaacgacgucugcaaauacgacuucguugaaguccgcuccggacuaacagcagacagcaaacuacacgguaaauucugcggcuccgaaaagccagaagucauaacaagccaauacaacaauaugagagucgaguucaagagcgacaacaccgucagcaaaaagggauuuaaggcacacuucuucucagacaaagacgaaugcucaaaagacaacggcggcugccaacaagacugcguuaacacauucggcucauacgaaugccaaugcagaucagguuucgugcugcacgacaacaaacacgacugcaaagaagccggcugcgaccauaaaguuaccagcaccaguggaaccauaacaagccccaacuggccagacaaauacccaucgaagaaagaaugcacgugggcuaucuccagcacacccgggcaccgggucaaacucaccuucauggaaauggauaucgaaagccaaccggaaugcgcauacgaccaucuagaagucuuugacggccgagacgccaaagccccaguacucggcagauucugcggauccaagaaaccagaaccaguacucgcgaccgggagccgaauguuccuccgcuucuacagcgacaacuccgugcaacgcaaaggcuuccaagccucccaugcgacggaaugcggcggacaaguucgcgcggacgucaaaaccaaagacuuauacagccaugcacaguucggugacaacaauuaccccggaggcguagacugcgaaugggucauaguagccgaagaaggauacggcgucgagcucguauuccagacauucgaaguagaagaagaaaccgacugcggcuacgauuacauggaacuuuucgacggguacgacagcacagcgccacgccucggacgcuacugcggaucaggcccgccagaagaaguauacagcgcaggcgacuccguccuagucaaauuccauucugaugacaccaucacaaagaaaggcuuccacuugagauacacaaguacaaaauuccaagacaccuuacauucaagaaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2158 - RNA, 1408 nt, Artificial Sequence
  mRNA product Design1 comprising derived and/or modified sequence from Homo sapiens__NP_001191.1__HsBMP2 (opt8)
gggagaaagcuuaccauggucgccggaacucgcugccuccuagcccuccuacucccccaaguacuacucggcggcgccgccggccucguucccgaacucggacgacgaaaauucgccgccgcauccucuggaaggcccagcucccaacccuccgacgaaguucucuccgaguucgaacuccgccuccucucaauguucggccucaaacaacgccccacaccaucacgcgacgcagucgucccgcccuacaugcucgaccuauaccgucgucacucaggccaacccggaucccccgcccccgaccaccgucucgaacgcgcagccucgcgcgccaacacaguccgcuccuuccaccacgaagaaucccucgaagaacuacccgaaaccuccggcaaaacaacccgacgcuucuucuucaaccucagcuccauccccacagaagaguucauaaccuccgccgaacuacaaguauuccgcgaacagaugcaagacgcccucggaaacaacagcucauuccaccacagaaucaacauuuacgaaauaaucaaacccgccaccgcgaacagcaaauuucccgucacccgucuccucgacacccgccucgucaaccaaaacgccucccgcugggaaucuuuugacguaacacccgcagucaugcgcuggacagcacaaggccacgccaaccacggauucgucguagaaguagcccaccuagaagaaaagcaaggaguauccaaacgucacguacgaauaucacgcucccuacaccaagacgaacacuccuggucccaaauccgaccccuacucgucaccuucggccacgacggaaaaggacacccccuucacaaaagggaaaaacgccaagccaaacacaaacaacgcaaacgacucaaauccucaugcaaaagacacccccucuacguugauuucucagacgucggcuggaacgacuggaucguagccccacccggcuaccacgccuucuacugccacggcgaaugccccuucccccucgcagaccaccuuaauucaaccaaccacgcaaucguccaaacccucgucaacuccgucaacucaaaaauccccaaagccugcugcguccccaccgaacuaucagccaucuccauguuauaccuagacgaaaacgaaaaagugguccucaaaaacuaccaagacauggucgucgaagguugcggcugccgauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2159 - RNA, 1444 nt, Artificial Sequence
  mRNA product Design1 comprising derived and/or modified sequence from Homo sapiens__NP_001193.2__HsBMP4 (opt8)
gggagaaagcuuaccaugauacccggcaaccgcaugcucauggucguccuccucugccaaguacuccucggaggagccucacacgccucacucauaccagaaacuggcaaaaaaaaagucgcugaaauccaagggcacgccggcggccgccgcuccggccaaucccacgaacuucuuagagacuucgaagccacccuacuccaaauguucggacuccgccgccgcccccaacccuccaaaucugcaguuauacccgacuacaugcgcgaccuauaccgucuacaaucaggcgaagaagaagaagaacaaauccauaguaccggccucgaauaccccgaacgccccgccucccgcgcaaauacaguccgcucauuccaucacgaagaacaccucgagaacauccccggaacguccgaaaacuccgccuuccgauuccucuucaaccuaucauccauccccgaaaacgaagucaucuccuccgccgaacuccgccuuuuccgcgaacaagucgaccaaggccccgacugggaacgcggcuuccaccgcauaaacaucuacgaaguaaugaaaccacccgccgaggucguccccggacaccuuaucacacgccuccucgacacccgacuaguccaccacaacgucacccgaugggaaaccuucgacguaucccccgcaguccuccgcuggacccgcgaaaaacaacccaacuacggacucgccauagaaguuacacaccuccaccaaacccgaacacaccaaggccaacacguccgaaucucccgcucccucccacaaggcuccggcaacugggcccaacuccgcccccuccucguaaccuucggacacgacggacgcggacacgcccucacccgacgccgccgagccaaacgcucccccaaacaccacucacaaagagccaggaaaaaaaauaaaaauugccgccgccacucacucuacguagacuucagcgacgucggcuggaacgacuggauagucgccccccccggcuaccaagcauucuacugccauggcgacugccccuucccacucgccgaucaccuaaacagcaccaaccacgccauaguccaaacccuaguaaacuccgucaacuccagcauacccaaggcaugcugcguacccacagaacugagcgcaaucuccauguuauaccucgacgaauacgacaaaguaguacucaaaaacuaccaagaaaugguaguagaaggaugcggcugccgcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2160 - RNA, 1759 nt, Artificial Sequence
  mRNA product Design1 comprising derived and/or modified sequence from Homo sapiens__NP_001709.1__HsBMP6 (opt8)
gggagaaagcuuaccaugcccggauuaggucgccgagcacaguggcucugcuggugguggggacuccucuguagcugcugcggaccccccccccuacgcccaccucuccccgccgcugccgccgccgccgccggcggccaacuacucggagacggcggaucacccggccgaacugaacaaccaccccccucaccccaauccucaagcggguuccucuaccgucgccugaaaacccaagaaaaacgcgaaaugcaaaaagaaauccuauccguccucggccucccccaccgcccccgcccccuacacggacugcaacaaccccagccaccagcccuacgucaacaagaagaacagcagcaacaacaacaauuaccaagaggagaaccacccccuggccgacugaaauccgccccacuauucaugcucgaccuauacaacgcacucagcgcagacaaugacgaagacggcgcaucagaaggagaaagacaacaaucauggccacacgaagcagccucaagcucccaacgaagacaaccaccacccggagcagcgcacccccuaaaccgcaaaucccuacuggcccccggauccggcagcggcggcgccuccccacuaaccagcgcccaagacucugcauuccuuaacgacgcagacauggucaugucauucguuaaccuggucgaauacgacaaagaauucucgccccgacaacgacaucacaaggaauucaaauucaaccucagccagauacccgaaggcgaaguagucaccgccgccgaguuccgcaucuauaaagacugcgucaugggaucauucaaaaaccaaacauuccuaaucuccaucuaccaaguacuccaagaacaccagcaccgcgacagcgaccucuuccuauuagacacccgcguagucugggccucagaagaaggcuggcucgaauucgacauaacugccaccucaaaucuuugggucgucacaccacaacacaacaugggccuccaacucuccguagucacccgugacggaguccacguacacccccgagcugccggccucgucggacgagacggccccuacgacaaacaacccuucauggucgcauucuucaaagucuccgaaguccacguccgaaccacccgcucagccuccucccgucgcaggcaacaaucccgaaaccgauccacacaaucccaagauguagccagaguauccuccgccuccgacuauaacuccuccgaacucaaaacagcaugccgcaaacacgaacucuauguauccuuccaagaccuuggauggcaagacuggaucaucgccccaaaaggauacgccgccaacuacugcgacggcgaauguucauucccucuaaacgcccacaugaacgcaaccaaccacgccaucguacaaacacuuguccaccucaugaaucccgaguacguccccaaacccugcugcgcacccaccaaacucaacgccauaucagucuuauacuucgacgacaacucaaacguaauccugaaaaaauaccgcaacauggucguucgcgcaugcggcugccacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2161 - RNA, 1513 nt, Artificial Sequence
  mRNA product Design1 comprising derived and/or modified sequence from Homo sapiens__NP_001710.1__HsBMP7 (opt8)
gggagaaagcuuaccaugcacguccguucccugagagccgccgccccccacucguuugucgcccuaugggcaccccuauuccuccuucgaucagcacuugcagacuucucccuugacaacgaaguccacucguccuucauccaccgccgccucagaucacaagaacgacgagaaaugcaacgcgaaauacuuagcauccuaggccucccccaccguccccgaccacaucuccaaggcaaacacaacucagccccaauguucaugcucgaccucuacaacgccauggccgucgaagagggcggcggacccggcggucaaggcuucuccuacccauacaaagccgucuucagcacucaaggaccaccccucgcuucccuucaagacucccacuuccuaaccgacgcagauauggucauguccuucgucaaccuagucgagcacgacaaagaauucuuccacccccgcuaccaccaccgagaauuccgcuucgaccucuccaaaauacccgaaggcgaggccgucacagcugccgaauuccgcaucuacaaagacuacauccgcgaacgcuucgacaacgaaaccuucaggaucucagucuaucaaguccuacaagaacaucucggccgcgaauccgacuuauuccuccuagacucacgcacccucugggccucagaagaaggauggcucguauucgacaucacagccacaucaaaccacugggucgucaacccccgccacaaccucggccugcagcuaucaguagaaacccucgacggacaauccaucaaccccaaacucgccggucucaucggccgacacggcccacaaaacaaacagcccuucauggucgccuucuucaaagccaccgaaguccacuuccgaagcauccgcuccaccggauccaaacaacgcucccagaaucguuccaaaaccccgaaaaaccaagaggcccuacgcauggccaacgucgcagaaaacuccucaucagaccaacgccaagccugcaaaaaacacgaacuauacgucuccuuccgcgaccucggauggcaagacuggaucaucgcaccagaaggcuacgccgccuacuacugugaaggagaaugcgccuuuccucucaacuccuacaugaacgccaccaaccacgcaauuguacaaacccuaguucacuucaucaacccagaaacagucccaaaacccugcugugcccccacacaacuaaacgcaauauccguccucuacuucgacgauuccucgaacguuauccucaaaaaauaccgcaacaugguaguccgagccugcggaugccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2162 - RNA, 517 nt, Artificial Sequence
  mRNA product Design1 comprising derived and/or modified sequence from Homo sapiens__NP_006264.2__HsCCL7 (opt8)
gggagaaagcuuaccaugaaagccucagccgcccuccucugccuccuccucacagcagccgccuucuccccccaaggccucgcccaaccagucggcaucaacaccuccacaaccugcugcuaccgcuucauaaacaaaaaaauacccaaacaacgccuagaauccuaccgcagaaccacauccucacacugcccccgcgaagccgucaucuucaaaaccaaacuagacaaagaaaucugcgccgaccccacccaaaaauggguccaagacuucaugaaacaccuagacaaaaaaacacaaacccccaaacucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2163 - RNA, 3841 nt, Artificial Sequence
  mRNA product Design1 comprising derived and/or modified sequence from Homo sapiens__NP_001954.2__HsEGF (opt8)
gggagaaagcuuaccaugcuguuaacgcuaaucauccuacuaccagucguaagcaaguucucuuuugucucccugagcgcgccccagcauugguccugcccagaaggcacccucgcaggcaauggaaacagcacaugcguaggcccggcuccauuccuaaucuucagccauggcaacagcaucuuuagaaucgacaccgagggcaccaacuacgaacaacucgugguagaugccggagugagcguaauaauggacuuccacuacaacgaaaaacgcauauauugggucgaccuagaacggcagcuccuccaaaggguauuucucaacggaucccgacaggagcgggugugcaauaucgagaaaaacgucuccggaauggcaaucaacuggaucaacgaagaagucaucuggagcaaucagcaggaaggaaucauaacagucacugauaugaagggcaauaacucccacauacuacucucagcacuaaaauaccccgccaacguagcaguagauccuguggaacgcuucaucuucuggagcucagagguagccgguagccucuacagagcggaucuugacggagugggugugaaagcacuuuuagaaacaagcgagaaaauaaccgcaguaucccuugacgugcucgacaaacgacuauuuuggauucaguacaaucgggaaggcucgaacucccuaauaugcucgugcgauuacgacggcggaagcguacacauaagcaagcaccccacgcagcacaaccucuuugcaaugucccuguucggugaccgaaucuucuacuccaccuggaaaaugaagaccauauggaucgcgaacaaacauacagggaaagauauggucagaaucaaccuacacagcuccuucgucccccuaggagaacuaaaggucguacauccacucgcccaacccaaagcggaagacgacaccugggaaccggaacaaaaauugugcaaauuaagaaaggguaauugcuccagcacugucugcgggcaagaccuccaaucacaccucugcaugugcgcggaaggguaugcccugagccgggaccgcaaauauugcgaagacgucaaugaaugcgccuucuggaaccacggauguacgcuugguugcaaaaacacacccgggagcuacuacuguaccugccccguaggcuucguccuacugccggacggcaagcggugucaucagcuagucaguugcccacgcaacguuucagaaugcagccacgacugcguccuaacauccgagggaccacucuguuucugcccagaaggcucagugcuagaaagagacggaaaaacaugcagcgggugcucaagcccagauaauggcgggugcucgcaacuaugugugccacuauccccugucuccugggaaugcgacugcuuccccggauacgaucuccaacucgacgaaaagucaugcgccgccaguggcccccaacccuuucuucuauucgccaacagccaagacauucgccacaugcacuucgacggaacagacuacggaacccucuuaucucaacagaugggcaugguuuacgccuuagaucacgacccuguggaaaacaaaauauacuucgcccacacagcacuaaaauggaucgaaagagcaaauauggacggcucacaacgagaacgccucauagaagagggcguagacguacccgaaggccuagcgguugacuggauaggcagaagguucuacuggacugaccgaggcaagucucugauagggcgcucggaccugaacggcaaacgcuccaaaaucauaacaaaggagaacaucucccaacccagaggaaucgcaguucacccaauggccaaacgacuguucuggaccgacacuggaaucaacccgcggaucgaaucuuccagucuacaggggcuggggcgucucguuauugcaucgagcgaccugauauggcccagcggcauaacgauagacuuccugacagacaaacuguacuggugcgacgcaaaacaaagcgugaucgaaauggccaaucucgacggaucaaaaagacgcagacucacacagaacgacgugggccacccuuucgcuguagccguauucgaagacuacgucugguucucagacugggccaugcccagcguaaugcgaguuaacaaacgcaccgguaaagacagaguccgucuccaaggcucaaugcuaaagccuaguucccuuguaguaguacauccacuagcuaaacccggugcagacccgugccuauaccagaacgguggaugugaacacauuugcaaaaagcgauugggaaccgccuggugcagcuguagagaaggauucaugaaagcgagugacggaaaaacaugccucgcacucgacggccaccagcuccuagccggaggggaaguagaucucaaaaaccaagugacgcccuuagacauacuaagcaaaaccagaguaucggaggacaacaucacggagagccaacacaugcuuguagcugaaaucaugguaagcgaccaagacgauugcgcgccagucggaugcagcauguacgcacggugcaucuccgaaggugaagaugcuaccugccagugccuaaaaggauuugcgggagacggcaaacuauguagcgauaucgacgaaugcgaaaugggagucccugucuguccgccagcaagcuccaaaugcaucaacaccgagggagguuacguaugccgaugcuccgagggauaucaaggagacggcauacacugccucgacauagacgaaugccaacugggagagcacuccugcggcgaaaacgcaagcuguaccaacacagagggcggcuacacaugcaugugcgccggccgccuaucugaacccggacucaucugccccgacucgaccccuccuccgcaccuacgugaggacgaccaccauuacagcgugcgaaauuccgacucggagugcccccuaucccacgacggauacugccuucaugacggcgucugcauguauaucgaagcccuagacaaauacgcguguaauugcguugucggcuacaucggggaacgaugccaguaccgcgaccuaaaauggugggaacuaaggcacgccgggcauggccagcagcagaaagucauagucguggcagucugcguaguggugcucgucaugcuacuccuacuaucacucuggggagcgcacuacuaccgcacccaaaaacuucuaagcaaaaaucccaaaaacccauacgaggaaucaagccgggauguucgaucgaggcgaccagcggacacagaagauggcaugagcucgugcccgcagcccugguucguggugaucaaggagcaucaagaccugaaaaacgggggacaaccaguagccggugaagacggccaagcagccgacgguagcaugcagccaaccucauggagacaagaaccacaacucugcgguaugggcacagaacagggcugcuggauucccgucucauccgacaagggcagcugcccccaaguaauggagcgauccuuccacaugccaagcuacggaacgcagacccuagaaggcgggguagaaaagccgcauucccugcugucugccaacccccuguggcaacagcgcgcacucgacccaccucaccagauggaacucacacaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2164 - RNA, 727 nt, Artificial Sequence
  mRNA product Design1 comprising derived and/or modified sequence from Homo sapiens__NP_001423.1__HsEREG (opt8)
gggagaaagcuuaccaugaccgccggccgacgaauggaaaugcucugcgccggccguguccccgcacuucuccucugccucggauuccaccuacuccaagccguccucuccaccaccgucauccccucaugcauccccggagaauccuccgacaacugcaccgcccuaguacaaacagaagacaacccccgcgucgcacaaguuuccaucaccaaaugcuccucagacaugaauggcuacugccuccacggacaaugcauauaccuagucgacaugucccaaaacuacugccgcugugaagucggauacacaggcguccgcugcgaacacuucuuccucaccguccaccaaccccuauccaaagaauacgucgcccucaccgucauccucauaauccuauuccucaucacaguugucggcuccaccuacuacuucugccgcugguaccgcaauagaaaauccaaagaaccaaaaaaagaauacgaacgcguaaccucaggcgaccccgaacucccacaagucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2165 - RNA, 685 nt, Artificial Sequence
  mRNA product Design1 comprising derived and/or modified sequence from Homo sapiens__NP_000791.1__HsFGF1 (opt8)
gggagaaagcuuaccauggcagaaggcgaaauaaccacauucaccgcccucaccgaaaaauucaaccuccccccaggcaacuacaaaaaaccaaaacuccuauacugcuccaacggcggacacuuccuccgcauccuccccgacggcacagucgacggaaccagagaccgcucagaccaacacauccaacuccaacucuccgccgaaucagucggagaaguauacaucaaaagcaccgaaaccggacaauaccuagccauggacaccgacggcuuacucuacggcucacaaacccccaacgaagaaugccucuuccucgaacgccucgaagaaaaccacuacaacacauacaucuccaaaaaacacgcagaaaaaaacugguucgucggccucaaaaaaaacggcuccugcaaacgcggcccccgcacccacuacggccaaaaagccauacucuuccucccccuccccgucucaucagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2166 - RNA, 1084 nt, Artificial Sequence
  mRNA product Design1 comprising derived and/or modified sequence from Homo sapiens__NP_001997.5__HsFGF2 (opt8)
gggagaaagcuuaccaugguggggguagggggaggggauguggaggauguaacgccgaggccagggggaugccaaauaaguggaagaggggccaggggauguaacgggaucccgggagcggcagcgugggaggcagcgcugccgagaaggagaccgagaaggcacccgagugugaacccgaggagcagggcggcagggagcccgagaacaagagggagaaggacagaggaaagaccaucggggagcagguugggggaucgagggcgaggaagggcgcugccgggagggagauugggagggagagggagggggagagcgccagagagggugggaggaagggggagaggaagagggacggcggcaccgagggcggcgccggcggcaaggggaagcagaccagggccggcgggaacgauggcggcggggagcauaacgacgcuaccagcauugcccgaagacggaggaucgggcgcauucccgccagggcauuuuaaagauccgaagaggcuguacuguaaaaauggaggguucuuucugagaauacauccggauggacggguagauggagugagagagaagagugacccgcacauaaaguugcaacugcaagcggaagagagaggaguagugagcauaaaagggguaugugccaacagauaucuagcaaugaaggaagauggaaggcuacuggcaagcaaguguguaacggacgagugcuuuuucuucgaaaggcuagagaguaacaacuauaacacguacagaagcaggaaauauacaaguugguauguggcgcuaaagaggacgggacaauacaagcuggggagcaagacagggccggggcaaaaggcaauacuguuuuuaccaaugagugcgaagaguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2167 - RNA, 802 nt, Artificial Sequence
  mRNA product Design1 comprising derived and/or modified sequence from Homo sapiens__NP_002000.1__HsFGF7 (opt8)
gggagaaagcuuaccaugcacaaauggauccuaaccuggauccuacccacccuucucuaccgauccugcuuccacaucaucugccuaguaggaaccaucucacucgcaugcaacgacaugacacccgaacaaauggccaccaacgucaacugcuccuccccagaacgccacacacgcagcuacgacuacauggaaggcggagacauccgcguccgccgccucuucugccgaacacaaugguaccuccgcaucgacaaacgcggcaaaguaaaaggcacacaagaaaugaaaaacaacuacaacaucauggaaauacgcacaguagccgucggaaucguagcaaucaaaggcgucgaauccgaauucuaccucgccaugaacaaagaaggcaaacuauacgccaaaaaagaaugcaacgaagacugcaacuucaaagaacucauccuagaaaaccacuacaacacauacgcaucagccaaauggacccacaacggaggcgaaauguucgucgcccucaaccaaaaaggcauccccgucagaggcaaaaaaaccaaaaaagaacaaaaaacagcacacuuccuccccauggccaucaccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2168 - RNA, 844 nt, Artificial Sequence
  mRNA product Design1 comprising derived and/or modified sequence from Homo sapiens__NP_001936.1__HsHBEGF (opt8)
gggagaaagcuuaccaugaaacuacuccccuccgucguccuuaaacucuuccucgccgccguacucuccgcacucgucacaggcgaaucacucgaacgacuccgccgaggccucgccgcaggcaccucaaaccccgaccccccaaccguguccacagaccaacuacuaccacucggcggaggacgcgaccgcaaaguccgcgaccuccaagaagcagaccuagaccuccuccgagucacccucuccuccaaaccccaagcccuagccacccccaacaaagaagaacacggcaagcgaaaaaaaaaaggcaaaggccuaggcaaaaaacgcgacccaugccuacgcaaauacaaagacuucugcauccacggcgaaugcaaauacguaaaagaacuccgagccccaucaugcaucugccaccccggcuaccacggagaacgcugccacggccuaucccuacccgucgaaaaccgccucuacaccuacgaccacacaacaauccucgccgucgucgcagucguccucucauccguaugccuccucgucaucgucggccuacucauguuccgcuaccaccgacgaggcggcuacgacgucgaaaacgaagaaaaagucaaacucggaaugacaaacucccacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2169 - RNA, 2404 nt, Artificial Sequence
  mRNA product Design1 comprising derived and/or modified sequence from Homo sapiens__NP_000592.3__HsHGF (opt8)
gggagaaagcuuaccaugugggucaccaagcuacuccccgcucuccugcuacaacacguccugcuccaccuccuacuccuccccauagccauaccauacgccgaaggacaacgcaagcgccguaauacaauacaugaguucaagaaaagcgccaaaaccacccuuaucaaaaucgaccccgcccuaaaaaucaagaccaaaaaggugaacaccgccgaccaaugcgccaacagaugcaccagaaacaagggccuccccuucacaugcaaagccuucguauucgacaaggcccgcaaacaaugccuaugguucccauucaacuccauguccuccggcgucaagaaagaguucggccacgaauuugaccucuacgaaaauaaagacuacauccgaaacugcaucaucggcaaaggacgcucauacaaaggcaccguauccaucaccaaaucaggcauaaaaugccaacccuggagcucaaugaucccccacgaacacucauuucuaccauccuccuaccgaggcaaagaccuccaggaaaauuacugcaggaacccgcgcggggaagaaggcggacccuggugcuuuaccuccaaccccgaaguacgguacgaagucugcgacauaccccaaugcuccgaaguagaaugcaugacaugcaacggagaauccuaucggggccucauggaucacacagaaucagguaaaaucugccagcgcugggaccaccagaccccucaccgccauaaauuccucccagaacgcuacccagacaaaggguucgacgacaacuacugcagaaacccugacggccagccacgcccaugguguuacacacuagacccccacacccgaugggaauacugcgccaucaaaacaugugcagacaauacaaugaaugacaccgacgucccacucgaaaccaccgaaugcauccaagggcagggagaaggauaccgaggcacggucaacaccaucuggaacggcauacccugccaacggugggacagccaauauccgcacgaacacgacaugacuccagaaaacuucaaaugcaaagaccucagagagaacuacugcagaaaucccgacggauccgaaucacccuggugcuucaccacggaccccaacauccgcguaggcuacugcucacaaauaccaaacugcgauaugagccacggucaagacugcuaucgcggcaacggcaaaaacuacaugggaaaccucucacagacccgcucaggccuaacguguagcaugugggacaaaaacauggaggaccuucaucggcacaucuucugggaacccgacgcauccaaacuuaacgagaacuacugccgaaacccagacgacgacgcccacgggccauggugcuacacaggcaacccacucaucccgugggacuauugccccauaagccgcugcgagggcgacacaaccccaacaaucgugaaccuggaccacccugucaucucgugcgcaaaaacaaaacagcuucgggucgucaacggcaucccaacacgaacaaacauaggguggauggucucucuacgcuacagaaacaaacacaucugcggcggcucacucaucaaagaaagcuggguccucacagcucgccaaugcuucccaucaagagaccucaaagauuacgaagccuggcuaggcauacacgacguacauggaaggggagacgaaaaaugcaaacaaguacuuaacguaagccaacucgucuauggcccagaaggaagcgaccucguccucaugaaacuagcacgcccagccguccucgacgacuuuguaagcaccauagaccuccccaacuauggcugcaccaucccagagaaaacgaguugcucagucuacggcuggggauacacgggacugaucaauuacgacggacuacuccgggucgcacaccucuacaucaugggcaacgaaaaaugcucccaacaccaccgcggcaaaguaacucucaacgaaagcgaaaucugcgccggagccgagaaaaucggcucaggcccaugcgaaggcgacuacggcggaccccuuguuugcgaacaacacaaaaugaggaugguacucggcguaauaguucccggcagggggugcgccaucccaaaccgacccggaauauuugucagaguagcauacuacgcgaaauggauucacaaaaucauacuaaccuacaaagucccccagucguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2170 - RNA, 2143 nt, Artificial Sequence
  mRNA product Design1 comprising derived and/or modified sequence from Homo sapiens__NP_005336.3 __HsHSPA1A (opt8)
gggagaaagcuuaccauggccaaagccgccgcaaucggcauagaccucgguacgacguacagcugcguaggcgucuuccaacacggcaagguggaaauaaucgcuaacgaccaaggcaacagaaccacaccgucguacgucgcauucaccgacaccgaacgacucaucggggacgcggccaaaaaccaagucgcacuaaacccccaaaacacaguguucgacgccaaacgacucaucgggagaaaauucggcgaccccguaguccaguccgacaugaaacacuggcccuuccaaguaaucaacgacggagauaaacccaaaguacaagucagcuacaaaggagagaccaaggccuucuacccagaggaaaucucaagcauggugcugacaaaaaugaaagaaaucgcagaagccuaccuaggauacccagucacgaacgccgucaucaccguccccgcauacuucaacgacagccaaagacaggccaccaaagacgccggagucaucgcaggacucaauguccuacgaauaauaaacgagccaaccgcagccgccauagcauacggacucgaccgaacaggcaaaggagaacgcaacguccuaaucuucgaccucgggggcgggaccuucgacgucuccauccuaacaauagaugacggcaucuucgaagugaaagccaccgccggcgacacacaccucgggggagaagacuucgacaaccgccucguaaaccacuucgucgaagaauuuaagcgaaaacacaagaaagacaucagccaaaauaagcgcgcggugcgacgccugagaaccgcaugcgagcgagccaaacgaacgcucucauccucaacccaagcgucacucgaaaucgacucacucuucgagggaaucgacuucuacaccucaaucacgcgagcccgcuucgaagaauuaugcucagaccucuuccgaucaacacuagaacccgucgaaaaagcccucagagaugcaaaacuggacaaagcacaaauccaugaccuuguccuaguaggaggcucaaccaggauccccaaaguacaaaaacugcuccaagacuucuucaaugggcgagaccucaacaaguccauaaaccccgacgaagcagucgcauacggggcagcaguccaagcagcaauauuaaugggcgacaagucggaaaacguccaagaccuccuacuacuagacgucgcgccacuaagucuagggcucgaaaccgcgggaggcgucaugacugcccuaaucaaacgcaacuccaccauccccacaaaacaaacccaaauauucaccacauacuccgacaaccaaccaggaguacugauacaaguauacgaaggcgaacgagccaugaccaaagacaacaaccuacuaggacgcuucgaacucagcggaaucccacccgcccccagaggaguaccccaaauagaagucacauucgacaucgacgcaaacggcauccuaaacguuacagcgaccgacaaauccaccggaaaagcaaacaagauaacgaucacaaacgacaaaggcagacucuccaaagaggagaucgagagaaugguccaagaagcagagaaauacaaagcagaagacgaaguccaacgugaacgcgucagcgccaagaacgcacucgagucguacgccuucaacaugaaaagcgccgucgaggacgaaggacucaaggggaaaaucucagaagccgacaaaaagaaaguacucgacaaaugccaagaaguaaucagcuggcuagaugccaacacacucgccgaaaaagacgaguucgaacacaaacgcaaagaauuagaacaagucuguaaccccaucaucuccggacucuaccaaggcgcaggcggaccaggccccggcggcuuuggcgcacaaggccccaaaggcggcagcgguuccggccccacaauagaagaaguagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2171 - RNA, 2143 nt, Artificial Sequence
  mRNA product Design1 comprising derived and/or modified sequence from Homo sapiens__NP_005337.2 __HsHSPA1B (opt8)
gggagaaagcuuaccauggcaaaagcggcagcaaucggaaucgacuuaggcaccaccuacucgugcgugggagucuuccaacacggcaagguggaaaucaucgcaaacgaccagggcaaccgcaccacccccagcuacguagccuucacagacaccgaacgccugauaggagacgcagcgaaaaaccaggucgcacucaacccacaaaacacagucuuugacgcaaaacggcucauaggaagaaaauucggcgacccggugguccagagcgacaugaaacacuggcccuuccaggugauuaacgacggagacaagccgaaaguccaagucucguacaaaggcgaaaccaaggcauucuacccggaagaaaucuccuccaugguccuaaccaaaaugaaagaaauagccgaagcauaccucggcuaccccgucaccaacgcgguaauaaccguccccgcauacuuuaacgacagucaacgucaggccaccaaagacgcaggggucauagcagggcucaacguccuccgaaucaucaacgaacccaccgcagcagccauagcauacggucucgaccgcacaggcaaaggcgaacgaaacguccuaaucuucgaccuaggugggggcaccuucgacgucucaauccuaacaauagacgacggcauauucgaaguaaaggcaaccgcaggcgacacccaccuaggcggcgaagacuucgauaaccggcucgugaaccacuucgucgaagaguucaaacgcaagcacaagaaagacauaucgcaaaacaaacgagcaguaaggcgacuccgaaccgcgugcgaacgagcaaaaagaacccuaagcucgagcacgcaggccagccucgaaauagacucccucuucgaagggaucgacuucuacacaucaauaacacgagcacgauucgaagaacucugcagcgaucuauuucgcucaacccucgagccggucgaaaaagcccuccgcgacgcgaaacuagacaaagcccagauacacgaccuaguccuaguagggggaucaaccaggauaccaaaaguacaaaaacuacuccaagacuucuucaacgggcgcgaccugaacaaaucuaucaacccagacgaagccgucgcguacggcgccgcuguccaagccgcaauucugaugggagacaaaagugaaaacguacaagaucuccugcuacuagacguagccccacuaucacugggauuagaaaccgcgggcggagucaugaccgcccuaauaaaaagaaacucaacaaucccaacgaaacaaacacaaaucuucaccaccuacagcgacaaccaacccggagugcucauccaaguguacgaaggcgaacgcgcaaugacaaaagacaacaaccuccuaggaagauucgaacuauccggcaucccaccagccccacgcggagucccacagauagaagucacauuugacauagacgcgaacggaauacuaaacguaacagcgaccgacaaaucgacgggcaaggcaaauaaaauaaccaucacgaaugacaaagggcgccuaagcaaggaagagaucgaaagaauggugcaggaagccgaaaaguacaaggccgaggacgaaguccaaagagaacgggucagcgccaaaaacgcacuagaaucguacgccuucaacaugaaauccgcggucgaagacgaaggacucaaaggaaaaauaagcgaagcugacaaaaagaaaguacucgacaaaugccaagaaguaaucuccuggcucgacgcaaacacauuagccgagaaggacgaguucgaacacaaacgaaaagaacuugaacaaguaugcaaccccauuauuucaggccuauaccaaggagcaggagggcccgggcccggaggcuucggcgcgcaaggcccaaaaggaggauccggaagcggaccgacaaucgaagaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2172 - RNA, 2143 nt, Artificial Sequence
  mRNA product Design1 comprising derived and/or modified sequence from Homo sapiens__NP_005518.3 __HsHSPA1L (opt8)
gggagaaagcuuaccauggcaaccgccaagggcaucgccaucgggauagaccucggaacaaccuacucaugcgucggagucuuccaacacggcaaaguggagauaaucgccaacgaccaaggaaaccgaacgacacccucauacguggcguucacagauacagagcgguuaaucggcgacgcagccaaaaaccaagucgccaugaacccacaaaacacggucuuugacgccaaaaggcuaauuggcagaaaauucaacgaccccguaguccaggccgacaugaaacucuggcccuuccaagucauaaacgaaggcggcaaacccaaaguccuagucucauacaaaggcgaaaacaaagcauucuacccggaagaaaucucgagcauggucuuaacaaaauuaaaagaaacggccgaagcauuccuuggacaccccgucacgaacgcaguaaucacaguccccgcauacuucaacgacucccaacgccaggcgacaaaagacgccggggucauagccggccuaaacguucugaggauaaucaacgagccgaccgccgcagccauagcguacggacuugacaaaggaggacaaggcgaacgccacguacucaucuucgaccugggcggcggcaccuuugacgucuccaucuuaaccaucgacgacggcaucuucgaaguaaaagccacggccggagacacacaccuuggcggagaagacuucgacaaccggcucgucagucacuuugucgaagaguucaagcgcaaacacaagaaagauaucucgcaaaacaaaagagcaguccgaagacuccgcaccgccugcgaacgcgccaagagaacacucagcagcucaacacaggcaaaccuggaaaucgacucacucuacgaaggcauagacuucuacaccucaauaacacgagcgcgcuucgaagaacuaugcgccgaccucuucagagggacccuggaaccggucgaaaaagcccuccgagacgccaaaauggacaaagcaaaaauccacgacauaguccuaguaggugggucaacccgaauccccaaagugcaacgacuccuccaagacuacuucaacgggcgcgaccucaauaaaucaaucaaccccgacgaagcaguagcauacggcgcagcaguccaagcagcgauccuaaugggggacaagagcgaaaaaguccaggaucuccuccuccuugacgucgcaccucuaucucuaggacuagaaaccgcaggggguguaaugacagcacucaucaaaagaaacucaacaauacccaccaaacaaacacaaaucuucacaaccuacuccgacaaccaaccaggaguacuaauacaagucuacgaaggggaacgcgccaugaccaaagacaacaaccuccugggccguuucgaccuaaccgguaucccaccagcaccacgcggaguaccgcaaauagaagugacguucgacauagacgcaaacggaauccucaacgucaccgcgaccgacaaaucaaccggcaaagugaacaaaaucaccaucacaaacgacaaagggcgauuaagcaaagaagaaaucgaacgaaugguccucgacgcagaaaaauauaaggccgaagacgaaguccaacgagagaaaauagccgccaaaaacgcauuagaaucauacgccuucaauaugaaaagcguaguaucagacgaaggccuaaaaggcaaaaucagcgagagcgacaaaaacaagauacuagacaaaugcaacgaacuccuaagcuggcucgagguaaaccaacucgcagaaaaggacgaguucgaccacaaaagaaaagaacuagagcaaauguguaacccaaucauaacaaaauuauaccaaggaggcugcacggggcccgccugcggaacaggcuaugucccaggaagacccgccaccggccccacgauagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2173 - RNA, 2137 nt, Artificial Sequence
  mRNA product Design1 comprising derived and/or modified sequence from Homo sapiens__NP_068814.2 __HsHSPA2 (opt8)
gggagaaagcuuaccaugagcgcccggggacccgcaaucggcaucgaccuaggaaccacauacagcugcguaggcguguuccaacacggaaaagucgagauaaucgccaacgaccaaggaaaccgaaccaccccaucauacguagcguucaccgacaccgaaagacucaucggggaugcagcgaagaaccagguggcuaugaaccccacaaacacaaucuucgacgccaaacgccuaauagggagaaaauucgaagacgcaacaguccaaucagacaugaaacacuggcccuucagggucgucucagaaggaggaaaacccaaaguacaagucgaauacaaaggcgaaacaaaaacguucuucccagaagagaucucauccaugguccucacaaagaugaaggaaauagccgaagccuaccuaggcggcaaaguccacagcgcagucauaaccguaccagcauacuucaacgacagccaacggcaagccacaaaagacgcaggaaccaucaccggguuaaacguacuacgaauaauaaacgaacccacagcagcagccaucgcguacggccucgacaagaaaggcugcgccggaggcgagaaaaacguacucaucuucgaccucggcggaggcacauucgacguaucgauacucacaauagaagacggcauauucgaagucaaaucaaccgccggagauacacaccuuggaggggaggacuucgacaacagaauggugagccaccuagcagaggaguucaaacgaaaacacaagaaagacauaggacccaacaaaagggccguacgcagacucagaacagcaugcgaaagagccaaacgaacacuaucauccuccacacaggccagcauagaaauagacucacuauacgaaggagucgacuucuacaccagcaucacacgcgccagauucgaagaacucaacgccgaccuauuccgaggcacccucgagccggucgagaaagcgcuccgagacgcaaaacucgacaaaggacaaauacaagaaauaguccucgucggaggcuccacccgaaucccuaaaauacaaaaacuacuccaagacuucuucaacggaaaagaacuaaacaaaucaaucaaccccgaugaagccguugcauacggcgccgcuguccaagcagcaauccuaauaggagauaaaagcgaaaacguacaagaccuccugcuacuagacgucaccccacucucacucggaaucgagaccgccggcgguguaaugaccccacucauaaaacgaaacaccaccauccccaccaaacaaacacagacguucaccaccuacuccgacaaccaaucauccgugcuagugcaagucuacgaaggcgaaagagccaugaccaaagacaacaaucuccucggcaaauucgaccugacgggcauacccccagccccacgaggcgucccccaaaucgaggucaccuucgacauagacgcgaacggcauccucaacgucacugcugcagacaaaucgacaggaaaggaaaacaaaaucaccaucacaaacgacaaggggcgccucagcaaagacgacaucgaccgaaugguacaagaagcagaacgcuacaagagcgaagacgaagccaacagagaccgcgucgccgccaaaaacgcccucgaauccuacacauacaacauaaaacaaaccgucgaagacgaaaaacuacgcggaaaaauaagcgagcaagacaaaaacaaaauauuagacaaaugccaagaaguaaucaacuggcucgaccgcaaccaaauggccgaaaaagacgaauacgaacacaaacaaaaagaacucgaacgaguaugcaacccgauaaucaguaagcuguaucaaggaggcccaggaggcggaagcggcggcggagguucgggcgcguccggaggcccaacaauagaagaagucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2174 - RNA, 2740 nt, Artificial Sequence
  mRNA product Design1 comprising derived and/or modified sequence from Homo sapiens__NP_002145.3 __HsHSPA4 (opt8)
gggagaaagcuuaccaugagcgugguaggcauagaccugggcuuccagagcuguuaugucgcaguagcccgcgcaggcggcauagaaacaaucgcaaacgaguacagcgaccgcugcacaccggcaugcaucucguucggacccaaaaaccguagcaucggcgcggcagcgaaaagccaggucauaagcaaugcgaaaaacacaguccagggauucaaacgcuuccacggccgagcauucuccgacccauucgucgaagcagagaaaagcaaccuggcauacgacaucguccaguuaccgaccggccuaaccgggaucaaagucaccuacauggaagaggaacgcaacuucaccacagaacaagucaccgccaugcugcuaagcaaacugaaagagacugcagaguccguacucaagaaaccagugguggacugugucguaagcgugccgugcuucuacacggacgccgaacgacguagcgugauggacgcaacacaaauagcgggacugaacugucuccgccuaaugaaugaaacgacagcaguagcccucgcuuacggaauauacaaacaagaccuacccgcgcucgaagagaaaccccgcaacgucgucuucguggacaugggacacucggccuaccaagucuccgucugcgccuucaaccggggcaaacugaaaguccucgccaccgcauucgacaccacacuuggaggccgaaaauucgacgaaguucucgucaaccacuucugcgaagaguucgggaagaaauacaaacuugacauaaaauccaaaauccgagcacugcuccgacucagucaagaaugcgaaaaacuaaagaagcucauguccgcgaacgccagcgaccucccccuauccaucgaaugcuuuaugaacgacgucgacgucuccggaaccaugaaccgagggaaauuccuagaaaugugcaacgacuuacuagcgagaguagaaccaccccuacgaagcguacuagaacagaccaaauuaaagaaagaagauaucuacgcaguagaaauagugggcggagcaacccgcauacccgccguaaaagagaaaaucucaaaauucuuuggcaaagaacucucgacaacacuaaacgccgacgaagcagugacccgcgggugcgccuugcaaugcgcaauucucagccccgcuuucaaaguaagagaauuuucaauaacagacgucguaccauaccccauaucacuccgcuggaacuccccagcagaagaaggaagcuccgacugcgaagucuucuccaaaaaccacgcagcccccuucucuaaaguccucaccuucuaccggaaagaacccuucacccuagaagccuacuacucgucaccacaggaccuaccauaucccgaccccgcaaucgcgcaauucuccguccaaaaaguaacaccccagagcgacgggagcagcagcaaaguuaaaguaaaaguacguguaaacguacacggaaucuucucagucuccucagccucccucgucgaaguccacaaaagcgaagaaaacgaagaaccaauggaaaccgaccagaaugcaaaagaagaagagaaaaugcaagucgaccaagaagaaccccacgucgaggagcaacaacaacaaacuccagccgaaaacaaggccgaaucagaagaaauggagaccucacaagccgggucaaaagacaagaaaauggaucaaccgccccaagcgaagaaagcgaaagucaaaacauccacagucgaccuccccauagagaaccaacugcucuggcaaaucgaccgcgagaugcucaaccucuacaucgagaacgaaggaaaaaugaucaugcaggacaaacuagaaaaagaaaggaacgacgccaaaaacgccguggaagaguacgucuaugaaaugcgcgacaaauuaagcggagaguacgagaaauuugucuccgaagacgacagaaacuccuucacacuuaaacucgaagacaccgaaaacuggcuauacgaagacggcgaggaccagcccaaacaaguauacguggacaaacucgcagagcugaaaaaccuaggacaacccaucaaaauccgauuucaagaaagcgaagaacgccccaagcuguucgaggaacucggaaaacaaauccaacaauacaugaaaaucauaucauccuucaaaaacaaagaggaccaauacgaccaccucgacgccgcagauaugacgaaaguagaaaaguccaccaacgaagcgauggaauggaugaacaacaaacucaaccuacaaaacaaacaaucgcucacaauggaucccgugguaaagagcaaggagaucgaggcaaaaauuaaagaacucacauccacaugcagccccauaaucucaaaacccaaaccaaaggucgaaccgccaaaagaagaacagaagaacgccgagcaaaacggcccaguagacggccaaggcgacaacccaggcccccaagcagcggaacagggaaccgacacggccguccccucagauucggacaagaaacucccagaaauggacaucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2175 - RNA, 2737 nt, Artificial Sequence
  mRNA product Design1 comprising derived and/or modified sequence from Homo sapiens__NP_055093.2 __HsHSPA4L (opt8)
gggagaaagcuuaccaugucaguggucggcaucgaccuaggcuuccucaacugcuacaucgccgucgcccgcuccggcgggauugaaacaaucgcaaacgaguacucggacaggugcacacccgcuugcauaucacugggaucgcggacgcgcgccauaggaaacgcagccaaaagccagaucguaacaaacgugcgcaacaccauccauggcuuuaaaaagcuccacggcaggagcuucgacgaccccaucguucaaaccgagcgcaucagacuaccauacgaauuacagaaaaugcccaacggcagcgccgggguaaaaguccgcuaccucgaagaagaacgaccuuucgcgaucgaacaaguuaccggaauguuacuagcaaaacugaaggaaaccucagagaacgcccucaagaaacccguggcagacugcguaauaucaaucccuagcuucuucacagacgcagaaagacguucaguaauggcggcagcccaaguagcagggcucaacugccuccgacuaaugaacgaaacaacagccguggcccucgccuacggcauauacaaacaagaccugccgccacuagacgaaaagccccgcaacgucguguucauagacaugggacacagcgccuaccaaguccucgucugcgccuuuaacaagggcaaacucaaaguccucgccacgacauucgaccccuaccugggcggacgcaauuucgacgaagcucucguagacuacuucugcgacgaguucaaaacaaaauacaaaaucaacgucaaggaaaacucaagagcccugcuccgacuauaucaagaaugcgagaaacuaaagaaacucauguccgcgaacgccagcgaccucccacuaaacaucgaauguuuuaugaacgaccuggacgucagcuccaaaaugaaccgcgcccaguucgaacaacucugcgccagccuacuagcacgcguggagccaccccucaaagccguaauggaacaagcgaaccuccagcgcgaggacauaucaagcaucgagauaguaggcggcgcgacgcgcauccccgccguaaaagagcaaaucacaaaauucuuccucaaagacauuucaacaacacuuaaugcagacgaagcaguagccaggggaugcgcucuacaaugcgccauccucagcccggcauucaaaguacgcgaguucuccaucacagaccuaguccccuacucaaucacacucagauggaaaaccucauucgaagacgggagcggagaaugcgaaguauucugcaaaaaccacccugccccauucagcaaagugauaacguuccacaagaaagaacccuucgaacuugaagcguucuacacaaaccuucacgaaguccccuacccugaugcgcgaaucgguucauucacaauacagaacguauucccccaaagcgacggcgacucgagcaaaguaaaagucaaaguccgcguaaacauccacggcaucuucucaguagcaagugccagcgugaucgaaaaacaaaaccucgaaggcgaccacagcgacgcccccauggagacagaaacaucguucaaaaacgaaaacaaagacaacauggacaaaaugcagguagaccaagaagaaggccaccagaagugccacgccgaacacacacccgaagaagaaaucgaccacaccggcgccaaaacaaaaucggcagucuccgacaaacaagaccggcuaaaccaaacccucaagaaaggcaaaguaaaaucaaucgaccuacccauacaguccucacucugccgccaacugggccaagaucuccuaaacucauacaucgaaaacgaaggaaaaaugauaaugcaagacaaacucgaaaaagaacggaacgacgccaaaaacgcgguagaggaguacgucuacgacuuucgggaccgacugggcacgguuuacgaaaaauucaucacacccgaagaccuaagcaagcuaucugcgguccuggaagauaccgagaacuggcucuacgaagacggcgaagaccaaccaaaacaaguguacguagacaagcugcaggaacugaagaaauaugggcaaccaauccaaaugaaauacauggaacacgaagaaaggcccaaagcacugaacgaccuaggcaagaaaauucaauuagucaugaaagugaucgaagcguacagaaacaaagacgaaagauacgaccaccucgacccuacagagauggagaaaguagagaagugcauaucagacgccauguccuggcuaaacagcaagaugaacgcccaaaacaaacucagccuuacgcaagaccccguggucaaagucucagaaauaguugcgaaaucaaaggagcuagauaacuucugcaaccccauaauauacaaaccgaagcccaaagccgaaguccccgaagacaagcccaaagccaacagugaacauaacgggccgauggacggacagucaggcacugagaccaaaagcgacucgacaaaagacagcagucaacacacaaagucguccggagagauggaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2176 - RNA, 2182 nt, Artificial Sequence
  mRNA product Design1 comprising derived and/or modified sequence from Homo sapiens__NP_005338.1__HsHSPA5 (opt8)
gggagaaagcuuaccaugaaacucagccuagucgcagccaugcugcugcuccucagcgcagcacgggcagaagaggaagacaagaaagaagacgugggaacaguaguaggcauagaccucggaacgacauacagcugcguagggguauucaaaaacggacgagucgagaucauagccaacgaccagggcaacagaauaaccccaaguuacguagcguucacacccgagggugaacgacugaucggagacgcagcgaaaaaccaacucacaagcaaccccgaaaacacaguauucgacgcaaagcgacuaauaggccgcaccuggaacgaccccucgguccagcaagacaucaaauuccugccauucaaagucgucgagaagaaaacaaaacccuacauacaaguagacauagggggcgggcagacgaaaacguucgcgccagaagaaauaagcgcaaugguacugacgaaaaugaaagagaccgcagaagcguaccugggcaagaaagucacccacgcagucguaacagugccagccuacuucaaugacgcgcaacgacaagcaacaaaggacgcaggaacaaucgcgggacugaacgugaugcgaaucauaaaugaacccaccgccgccgcaauagcguacggacuagacaaacgggaaggcgagaaaaacauccuagucuucgaccugggcggagguaccuucgacguaagucuccugacaaucgacaacggcguauucgaagucguagcaacaaacggggacacacaccugggaggagaagacuucgaccagcgaguaauggagcacuucauaaaacuauacaagaagaaaaccggaaaagacguaaggaaagacaacagagccguacaaaaacucaggcgggaggucgaaaaagccaaacgcgcccuauccagccaacaccaagcgcgcaucgaaauagaaucauucuacgagggggaagacuucagcgaaacccuaacacgcgcaaaauucgaagaacugaacauggaccuauuccgcagcacgaugaaaccaguacaaaaaguccuagaggacagcgaccuaaagaaaagcgacauagacgaaauaguauuagugggcggcucgaccaggauaccaaaaauacaacaacugguaaaagaguucuucaacggcaaagaaccaucgcgagggaucaacccagacgaagccgucgcauacggagccgcaguucaagcaggaguacugagcggcgaccaagacacaggagaccucguacuacuggacgugugcccacucacccuaggcauagaaacaguaggcgggguaaugacaaaacucauaccaagaaacacggucgugcccaccaagaaaagccagauauucagcacggcaagcgacaaccaacccaccguaacgaucaaagucuaugaaggagaacgaccccucacaaaagauaaccaccuacugggcaccuucgaucuaacaggcauaccaccagccccaagagggguaccacaaauagaagugacauuugaaaucgacguaaacgggauucuccgagugaccgcggaagacaaaggaaccggaaacaaaaacaaaauaacgauaaccaacgaccaaaacagacucacaccggaagaaaucgaaagaauggucaacgacgcagagaaauuugccgaagaggacaagaaauugaaagagcgaauagacaccagaaacgaacucgaaagcuacgccuacucacucaaaaaccagauaggugacaaagaaaaacuaggagggaaacuaagcagugaagacaaagaaaccauggaaaaagccgucgaagagaaaaucgaauggcuagaaucacaccaagacgcagacauagaagacuucaaagccaaaaagaaagaacuagaagaaauaguacaaccaaucauauccaaacuauacggaagcgcagggcccccacccacaggagaagaggacacagcggaaaaagacgaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2177 - RNA, 2149 nt, Artificial Sequence
  mRNA product Design1 comprising derived and/or modified sequence from Homo sapiens__NP_002146.2__HsHSPA6 (opt8)
gggagaaagcuuaccaugcaagcaccccgggagcucgcagucggcauugaucucggaacaacauacuccugcguaggaguguuccagcaagggcgcguggaaauacucgcaaacgaccaaggcaaccggaccaccccaagcuacguggccuucaccgacacagagcggcugguaggagacgcagcaaaaagccaagccgcgcugaauccccacaacacagucuucgacgcaaaaaggcuaauuggaagaaaauucgcagacacaacaguacaaagcgacaugaaacauuggcccuuccgagucgucucagaagggggcaaacccaaggucagagucugcuacagaggugaagacaaaacauucuaccccgaagagauaucaagcauggugcucagcaaaaugaaagagacggccgaggcauaccucgggcaaccggucaaacacgcgguaauaacagucccagcauacuucaacgauagccaacgccaagccacaaaagacgccggagcaaucgccgggcucaacguccuacgaauaaucaacgaaccaacagcggcagcaaucgcuuacgggcuagacagaagaggcgcaggcgaacggaacguccugauauucgaccuaggaggaggaacauucgacguaucagugcuaagcaucgacgcaggaguauucgaagucaaagccacggcaggagacacacaccugggcggggaagacuucgacaacaggcuaguaaaccacuucauggaagaguuccggcgcaaacacgggaaagaccuaucagggaacaaaagagcccugcgaaggcugagaacagccugcgaacgcgcaaaaaggacacuaagcagcuccacacaagcaacacuagaaauagacucccucuucgaaggagucgacuucuauaccucgaucacgcgcgcacgauucgaagaacuaugcagcgaccucuuccgaucgacccuggaaccgguagaaaaagcccuaagagacgcgaagcuagacaaggcccaaauacacgacguaguccucguaggaggaucgacacgcaucccaaaaguacaaaaacuccuacaagacuucuucaacgggaaagaacucaacaagucaauaaaccccgacgaagcaguggccuacggugccgcaguucaggccgcaguccugaugggcgacaagugcgaaaagguucaagaccuacuacuccuagacguggcaccccucucccucggacuagagacagcgggcggagucaugacuacacuaauccaaagaaacgcaaccaucccaacaaagcaaacacaaacauucacaaccuacucagacaaccaaccaggcguauucauccaagucuacgagggcgaacgcgcaaugaccaaagauaacaaccuacugggccgauucgagcucucaggcauacccccagcaccccgaggagucccacaaauagaaguuacauucgacaucgacgccaacgggauauugagcgugaccgcaacagaccgcucaaccggaaaggcaaacaaaauaacaauaacaaacgauaaaggacgacuaagcaaagaagaaguggagcgcaugguacacgaggcggaacaauacaaggccgaggacgaagcccaacgggacagaguagccgccaaaaacagccuggaagcgcacgucuuccacgucaaaggaucacuacaggaagaaucccuccgagacaaaauacccgaggaagacagacgaaaaaugcaagacaagugccgagaaguccuagccuggcucgaacacaaccaacuggccgaaaaagaagaauacgaacaccaaaagcgagaacuagagcaaauaugcagaccaauauucucgagacuauacggcgggccgggcguaccuggcggaucgagcugcggcacccaagcccgacaaggcgacccaucaaccgggccuauaaucgaggaaguggacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2178 - RNA, 1321 nt, Artificial Sequence
  mRNA product Design1 comprising derived and/or modified sequence from Homo sapiens__P48741__HsHSPA7 (opt8)
gggagaaagcuuaccaugcaagcaccacgcgaacucgcagucggaaucgaccuaggcaccacauacucaugcgucggcguauuccaacaaggaagagucgaaauccucgccaacgaccaaggaaaccgaaccacgccaagcuacgucgcauucacagacacagaacgccuggucggcgacgcagccaaaagccaagccgcacucaacccacacaacacaguauucgacgcaaaacggcucauaggccgcaaauucgccgacaccaccguccaaagcgacaugaaacauuggccauuccaagucguaagcgaaggcggcaaacccaaaguccgagucugcuacagaggcgaggacaaaacauucuacccagaagaaaucuccagcaugguacuaaguaaaaugaaagaaaccgcagaagcauaccuaggccaacccguaaaacacgcaguaauaaccguaccaaccuacuucucaaacagccaacgccaagcaacaaaagacgcaggagccaucgccggccucaaaguccucccaauaauaaacgaagcaaccgcagccgcaaucgccuacggacucgaccgacgaggcgccggcaaacgaaacguacucauauucgaccucggcggcggcaccuucgacguaagcguacuaagcaucgacgcaggagucuucgaagucaaagcaacggccggcgacacacaccuuggaggagaagacuucgacaacagguuagucaaccacuucauggaagaguuccgccgcaaacacggaaaagaccucucaggaaacaaacgcgcacugcgacggcuacgaacagcgugcgaacgcgcaaaacgcacccccuccagcagcacacaagccacucucgaaaucgacucacuguucgaaggcgucgacuucuacaaauccauaacacgcgcacgcuucgaagaacucugcagcgaccucuuccgcagcacccucgaacccguugaaaaagcccuacgcgacgccaaacuagacaaagcccaaauccacgacuucguccugggcggcggccuccacucacacccccaaggagccgaaguagcagcaggacuccugcaacgccaaggagcagaacaagaacaccaacccuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2179 - RNA, 2158 nt, Artificial Sequence
  mRNA product Design1 comprising derived and/or modified sequence from Homo sapiens__NP_006588.1 __HsHSPA8 (opt8)
gggagaaagcuuaccaugagcaaaggaccagcaguagggauagaccucggaaccacauacuccugcguagggguauuccagcacggcaaaguagaaauaauagcgaacgaccaaggcaaccggaccaccccuuccuacguagccuucaccgacacagagcgccucaucggagacgcggccaaaaaccaagucgcaaugaaccccaccaacacaguauucgacgcaaaaagacucauaggcaggcgguucgacgacgcagucguacaaagcgacaugaagcacuggcccuucauggucguaaacgacgcaggacgcccaaaaguccaaguagaauacaagggcgagacaaaauccuucuacccagaagaggucuccagcaugguacugaccaaaaugaaagagauagcagaagccuaccucggaaaaacuguaaccaacgcaguagucacagucccagccuacuucaaugacagccaacgccaggccaccaaagacgccggaaccaucgccggacuuaacguacuacgcaucaucaaugagccaacggcggccgcaaucgcguacgggcucgacaaaaagguaggagccgaaagaaacguccugaucuucgaccuaggaggaggaacauucgacgucucaauccucacaauagaagacggcauauucgaaguaaagagcacggccggcgacacacaccugggaggagaagacuuugacaacagaaugguaaaccacuucauagcagaguucaagcgcaagcacaagaaggacaucagcgaaaacaaaagagcaguacgccgccuccgcaccgccugugaaagagcaaaacgcacccucagcuccagcacccaagcaaguauagaaauugacucacuauacgaaggcaucgacuucuacaccagcaucacccgagcaagauucgaagaauuaaacgcagaccucuucagaggaacccuggacccagucgagaaagcacuacgagacgcaaaacuagacaaaagucaaauacacgacauaguccuagucggaggcagcacacgaaucccgaagauacagaaacuccuccaagacuucuucaacggaaaagaacuaaacaaaagcauaaauccagacgaagcagucgcauacggcgcagcgguccaagcggccauacuuucaggcgacaaaagcgagaacguacaagaccugcugcuccuggacgucacgccgcucucacuaggcaucgaaacagccggcggcguaaugaccgugcucauaaaacgcaacacaaccauaccaacaaaacagacccagaccuucacgacauacuccgacaaccagccaggcguacucauacaggucuacgaaggagaacgcgcaaugacaaaagacaacaaccuccuaggcaaauucgaacucacagggauacccccagcaccgcgcggagucccacaaauagaagucaccuucgacaucgacgcaaacggaauccuaaacguauccgccguagacaaaucaaccggaaaagaaaacaaaauaacgaucacaaacgacaaaggccgccuaagcaaggaggacaucgagagaaugguccaggaggccgaaaaauacaaagccgaagacgaaaaacaacgcgacaaaguaaguagcaagaacagccuggaaagcuacgcauucaacaugaaggcgacggucgaagacgaaaaacugcagggaaaaauaaacgacgaagacaaacagaaaauccuagacaaaugcaacgaaaucauaaacuggcuggacaaaaaucaaaccgccgaaaaagaagaauuugaacaccaacaaaaggagcucgaaaaagugugcaaucccauaaucaccaaacuauaccaaucagcgggaggaaugcccggagggaugccgggcggguucccaggagggggagcacccccaagcggaggcgcaagcucgggccccacgauagaggaggucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2180 - RNA, 2257 nt, Artificial Sequence
  mRNA product Design1 comprising derived and/or modified sequence from Homo sapiens__NP_004125.3 __HsHSPA9 (opt8)
gggagaaagcuuaccaugauaucagccagccgcgcggccgccgcaagacuggugggagcagccgcgagccgcggaccaacagcagcgcggcaccaagacagcuggaacggacugucacacgaagcauuccgacucgugaguagaagagacuacgcgagcgaagccauaaaaggggccguagucggaaucgaccucggaacaacaaauaguugcguagccgugauggagggaaaacaagccaaaguacuagagaacgcggagggagcgagaaccacaccaagcgucguagccuucaccgcagauggagaaaggcucguaggcaugcccgcaaaaagacaagcagugacgaacccaaacaacaccuucuacgcgacaaagcgccucaucggccgacgcuacgacgaccccgaggugcaaaaagacaucaaaaacguaccauucaaaauagugagagcaagcaacggcgacgccugggucgaagcccacggcaaacuauauagccccagccagauaggggccuucgucuugaugaaaaugaaagagaccgcagaaaacuaccuaggacacacagccaagaacgcaguaauaaccguaccugcauacuucaacgacagccagagacaagccacaaaggacgccggccagauaagcggacuuaauguacuacgcguaauaaacgaaccgacagccgccgcgcucgcauacggccuagacaaaagcgaggacaaaguaauagcaguauacgaccuaggagggggaacuuucgacaucucgauacuagaaauacaaaagggaguuuucgaggucaagucaacaaacggggacaccuucuuaggcggagaagacuucgaccaagcgcugcuacgccacaucgugaaagaguucaaaagagaaacaggggucgaccucacgaaagacaacauggcacuccaaagagucagagaagcggcagaaaaagcgaaaugcgaacuaagcagcagcguccaaacagacauaaaccuacccuaccuaacaauggauagcucaggcccaaaacaccugaacaugaagcucacgcgcgcgcaauucgaggggauagugacugaccucaucagaagaaccauagcaccaugccaaaaagcaaugcaagaugccgaaguaagcaaaagcgacauaggggaagucauccuagucggaggaaugacgaggaugccaaaaguacaacaaacaguacaagaccucuucgggagagccccguccaaggccguaaacccggacgaggcaguagccauaggagcggccauacaaggaggaguccuagccggggacguaacagacgugcugcugcucgacguaacaccccugucucugggcauugaaacccuaggaggcguuuucacaaaacucaucaacagaaacacgacgauaccgacuaagaaaucccaagucuucuccacagccgccgacggucaaacccaaguagaaaucaaagucugccaaggagagagggaaauggccggggacaacaaauuacucgggcaauucacccucaucggaaucccacccgcgccccgaggcgugccccagauagaggucacauucgacaucgacgccaacggaauaguacacguaagcgccaaagacaaaggaacaggccgggaacaacagauagucauacagucaagcggaggccucagcaaggacgacaucgaaaacauggucaaaaacgcagagaaguacgcagaagaggaccggagaaagaaagaacgcguggaagcaguaaacauggccgaagggauaauacacgacaccgagacaaaaauggaggaguucaaagaccagcugcccgcggaugaauguaauaaacuaaaagaagaaauaagcaaaaugagggaacuacucgcacgaaaggacucugaaacgggcgagaacauuagacaagcggcaagcagccuccaacaagcaucccugaagcucuuugaaauggcauacaagaaaauggcgucggaaagggaaggguccgggagcucaggcacgggagagcaaaaggaagaccaaaaggaggaaaaacaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2181 - RNA, 2245 nt, Artificial Sequence
  mRNA product Design1 comprising derived and/or modified sequence from Homo sapiens__NP_079291.2__HsHSPA12A (opt8)
gggagaaagcuuaccauggcggacaaagaagccggaggaagcgacggcccccgcgaaaccgccccaacauccgccuacagcucgcccgcccgcagccuaggagacaccggaaucacaccccucucucccucccacauugucaacgacaccgacuccaacguaucugaacaacaaucauuccucguaguagucgcaguagacuucggcaccaccucguccggauacgcauacucguucaccaaagaacccgaauguauccacguaaugagacgcugggaaggcggcgaccccggggucuccaaccagaaaaccccaaccaccauacuacucaccccagaaagaaaauuccacuccuucggauacgccgcccgcgacuucuaccacgaccucgaccccaacgaagccaagcaauggcucuacuuggaaaaauucaaaaugaaacuccauacaaccggagaccucaccauggacaccgaccucacagcugcaaacggcaagaaagucaaagcacucgagaucuuugccuacgcgcugcaauacuucaaagaacaagcccucaaagaacucuccgaccaagcagggucagaguucgaaaauagcgacguccgaugggucaucaccgucccagcaauuuggaaacaacccgcaaaacaauucaugcgccaagccgccuaccaagcuggccuagcuucaccagaaaacucagaacaacuaaucauagcacucgaaccggaagcagcaagcaucuacugcagaaaacuacgccuccaccaaaugaucgaacucagcucaaaagccgccgugaacggcuacuccggauccgacaccguaggcgcgggcuucacacaagccaaagaacacauccgucggaaccgccaaucacgaacauuccuagucgaaaacgucauaggcgaaaucuggagcgaacuagaagaaggcgacaaauacgucguagucgacucaggcggaggcacaguggaccucaccguacaucaaauccgccuaccagaaggccaccucaaagaacucuacaaagcuacaggcggaccauacggaucacugggcgucgacuacgaguucgaaaaacuacuauacaagaucuucggcgaagacuuuaucgaacaauucaaaaucaaaagacccgccgccuggguagaccucaugaucgccuucgaauccagaaagagggcagccgcgcccgaccgcacuaacccccugaacauaacacucccauucagcuucaucgacuauuacaagaaauuccgcggccacucaguugaacacgcccuccgcaaauccaacguagacuuuguaaaauggucaucccaaggcaugcuccggaugucccccgacgccaugaacgcccuauucaaaccaaccauagauuccauaaucgaacaccucagagaccucuuccaaaaacccgaagucucaaccguaaaauuccuuuuccuagucgggggauucgccgaagcgcccuuacuacaacaagcggugcaagcugcauucggcgaucaaugccgaauaauaaucccccaagacguaggccuaaccauacugaaaggggcaguacucuucggccucgaccccgcaguaaucaaaguccgacgcuccccacuaaccuacggcguaggcguacucaacagauacguagaaggaaaacauccaccagagaaacuccugguuaaagacggaaccagauggugcaccgacguauucgacaaauucaucagcgccgaccaaucaguugcacucggcgaauuaguuaagcgaagcuacacccccgcgaaaccaucccaacucgucaucgucauaaauaucuacagcucagaacacgacaacgucucguucaucaccgaccccggggucaaaaagugcggcacgcucagacucgaccucaccggcaccagcgggacggcaguaccagcgcgacgcgagauacaaacccucaugcaauucggcgacacagagaucaaagccaccgcgauugacauagcaacaucaaaaucugucaaagucggaaucgacuucuuaaacuacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2182 - RNA, 2278 nt, Artificial Sequence
  mRNA product Design1 comprising derived and/or modified sequence from Homo sapiens__NP_443202.3 __HsHSPA12B (opt8)
gggagaaagcuuaccaugcucgccguccccgagaugggcuugcagggccuauacauaggcagcucacccgaaagaagcccagucccauccccaccuggaucccccagaacccaagaauccugcggaaucgcuccccucaccccaucacaauccccaaaaccggaaguccgcgcaccccaacaggccucauucucaguuguugucgccauagacuucggcacaaccucaagcggauacgccuucagcuucgccucagaccccgaagccauacauaugaugcgcaaaugggaggguggcgaccccggcgucgcccaccagaaaacgcccacuugccuacuccucaccccagaaggcgccuuccacuccuucggcuacacggccagagacuacuaccacgaccucgaccccgaagaagcaagggacugguuguacuucgaaaaauuuaaaaugaaaauucauagcgccacagaccuaacccuaaaaacgcaauuagaagcuguaaacggcaaaaccaugcccgcccucgaagucuucgcccacgcacuccgcuucuuccgagaacacgcacuccaagaacuaagagagcaaucacccagccuccccgagaaagacacaguacgcuggguacugaccguacccgccauauggaagcaaccagcgaaacaauucaugagagaggccgcauaccucgcagggcuaguaucccgggaaaacgcagaacaacuccucauagcauuagaaccagaagcagccucagucuauugcagaaaacuccgccugcaccaauugcucgaccucagcggccgcgccccaggaggcggucgacucggcgaacgacgaagcauagacucaucauuccgccaagccagagaacagcuccgccgauccagacacucacgaaccuuccuuguagaauccggcgucggagagcuuugggccgaaaugcaagccggggaccgauacgucguagccgacugcggcggcggaaccgucgaccuaacaguacaccaacuagaacaaccacaugguacccucaaagaacucuacaaagccuccggcggucccuacggagccguuggcguagaccucgcauucgaacaacuacucugcagaauauucggagaagacuuuauagcuaccuuuaaaagacaacgacccgcagccugggucgaccuaacuauagccuucgaagcacgcaaacgaacagccggcccacacagagccggcgcacucaacauaagccuaccauucucguucauagacuucuaccgcaagcaaagaggccacaacgucgaaaccgcccucagacgaucauccguaaacuucguaaaauggucaagucaaggaaugcugcgaaugucaugcgaagcaaugaacgagcuauuccaaccgacaguaagcggaaucauccaacacaucgaagcgcuccuagcgcgcccugaaguccaaggcguaaaacuucuauucuuaguuggaggauucgcagaaagcgccguacuucaacaugcaguccaagcagcacucggcgcacgcgggcuccgagucgucgucccccacgacguuggccuaaccauacucaaaggagccguccucuucggacaagccccaggggucguccgagugcgcagaucaccgcuaacauacggcguaggcgugcucaaucgcuucguaccaggcagacacccgcccgaaaaacuccuaguccgagacggacggcgcuggugcaccgacgucuucgaaagauucgucgcggcugaacaauccguagcccucggcgaagagguacgucgcagcuacugcccagcccgacccggacagagacgaguucucaucaaccucuacugcugugcagcagaagacgcccgguucauaacagaccccggcguaagaaaaugcggagcacucucccuugaacuagaaccggcagacugcggacaagacaccgccggcgccccacccggaagacgcgaaaucagagccgcaaugcaauucggagacacagaaaucaaagucacagcaguagacguaagcaccaacagaagcgucagagcaagcauagacuuccucucaaacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2183 - RNA, 1633 nt, Artificial Sequence
  mRNA product Design1 comprising derived and/or modified sequence from Homo sapiens__NP_008879.3__HsHSPA13 (opt8)
gggagaaagcuuaccauggcccgcgaaaugaccauacuaggcuccgccguauuaacccuccuccuugcaggcuaccuagcacaacaauaccucccacuaccaaccccaaaagucauuggcauugaccucggaaccacguacugcagcgucggcgucuucuucccuggaaccggcaaagucaaaguaauacccgacgaaaacggccacaucuccauaccauccaugguuuccuucaccgacaacgacguguacgucggauacgaauccgucgaacucgccgacagcaacccacagaacaccaucuaugacgcaaaacgauucaucggaaaaauauucacagccgaagaacucgaagccgaaaucggacgcuauccauucaaaguacuaaacaaaaacggcaugguagaguucuccgucacaagcaacgaaaccaucaccgucagccccgaguacguaggaucuagacugcuucuaaaacuaaaagaaauggccgaagccuaucugggcaugcccgucgccaacgcaguaaucucgguccccgcagaguucgaccuaaaacaacgaaacucaaccauagaagcggccaaccuagccggccucaaaauacuaagagucauaaacgaacccacugccgcggcuauggccuacggucuccacaaagccgacgucuuccacguccucgucaucgaccucggcggcggaaccuuagacgucagccuacucaacaaacaaggcggcauguuccucacccgcgcaaugagcggcaacaacaaacucggaggccaagacuucaaccaacgccuacuccaauaccucuacaaacagaucuaccaaaccuacggcuuuguaccaucccgcaaagaagaaauacaccgacuccgacaagccgucgaaauggucaaacucaaccugacccuacaccaaagcgcccagcuaucuguacuacuaaccgucgaagaacaagaccgcaaagaaccccacucaagcgacaccgaacuccccaaggacaaacucagcucugcggacgaccaccgcgucaacuccggcuucggccgaggcuuaucagacaagaaauccggagaaagccaaguccucuucgaaaccgagauaucccgcaaacuauucgacacacucaacgaagaccuauuccagaaaaucuuaguacccauacaacaaguccucaaagaaggccaccuggagaaaacagaaauagacgaagucguccuaguaggcggcagcacacgcaucccccgcauuagacaagucauccaagaguucuucggcaaagaccccaacaccuccgucgaccccgaccuagccgucgugaccgggguagcaauccaagccggcaucgacggaggcuccuggccacuacaggucucggcacuugaaaucccgaacaaacaccuccagaaaaccaacuucaauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2184 - RNA, 1747 nt, Artificial Sequence
  mRNA product Design1 comprising derived and/or modified sequence from Homo sapiens__NP_057383.2__HsHSPA14 (opt8)
gggagaaagcuuaccauggcagcaaucggcguccaccucggaugcacaucagccugcgucgccgucuacaaagacgggcgcgccggcgucgucgcaaacgacgcgggcgaccgcgucacaccagccgucgucgcauacuccgaaaacgaagaaauaguaggccuagccgccaagcaaucccgcauacgcaacaucagcaacacagucaugaaaguaaaacaaauauuaggccgcuccuccuccgacccacaggcccaaaaauacaucgcagaaucaaaaugccucguaaucgagaaaaacggcaaacuacgcuacgagaucgacacuggcgaagaaaccaaguucguaaacccagaagacgucgcccgccuaaucuucucaaaaaugaaagaaacggcccacucaguccucggcuccgacgccaacgaugucgucauaaccguaccauucgacuucggcgaaaaacaaaagaacgcacuaggcgaagccgcccgcgcagcgggauucaacguccuacgccucauacacgaaccauccgcggcccucuuagcuuacggaaucggacaagacucccccaccggcaagucaaacauccuaguauucaaacuaggaggaaccucacuaucacucucagucauggagguaaacucaggcaucuaccgcguccucagcaccaacacagacgacaacaucggaggagcccacuucaccgaaacacucgcccaguaccucgccuccgaguuccagcgaucguucaaacaugacguacgaggaaacgcacgcgcaaugaugaagcucacgaacagcgcagaagucgcaaagcacucccuaagcacacuaggcagcgcaaacugcuuccuggacucauuauacgaaggacaggacuucgacugcaacguaagccgcgccagauucgaacuccucugcucaccccucuucaacaaaugcaucgaagccauacgcggacuacuagaccaaaacggguucaccgccgacgacaucaacaaagucguucucugcggcggauccagccgcauccccaaacugcaacaacucaucaaggaccuauuccccgccgucgagcugcuaaacuccauaccacccgacgaaguuauacccauuggagcagcaauagaggccggcauccucaucggcaaagagaaccuccucgucgaagacucccugaugaucgagugcuccgccagagacauacucgucaaaggcgucgacgaaucaggagcaucacgcuucacaguccuauuccccucuggaacaccccuuccagcacgacgacaacacacccuacaagcaccaggcagcauuuccuccgucugccuagaacucuacgaauccgauggcaaaaacucggccaaagaagaaaccaaguucgcacaagucguacuccaagaccucgacaagaaagaaaacggacuccgcgacauccuggccgugcucaccaugaagcgagauggaucacuacacgugaccugcaccgaccaggaaaccggcaaaugcgaagccaucagcaucgaaaucgcauccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2185 - RNA, 2794 nt, Artificial Sequence
  mRNA product Design1 comprising derived and/or modified sequence from Homo sapiens__NP_006635.2 __HsHSPH1 (opt8)
gggagaaagcuuaccauguccgucgucggacuggacgugggaagccaaagcugcuacauagcagucgcccgggcagggggcaucgaaacaaucgccaaugaguucagcgacagaugcacuccaagcgucaucuccuucggauccaaaaacagaacaauaggagucgccgccaaaaaccaacagauaacccacgcaaacaacaccgucucaaacuucaaacgguuccacggcagagcauucaacgaccccuucauacaaaaagaaaaagaaaaccuaucauacgaccucgucccacucaaaaacggaggagucgguaucaaagucauguacaugggcgaagaacaccuuuucucaguagagcaaauaacagcaaugcuacuaaccaaacucaaagagacagcagaaaacucgcugaagaaaccagucacagauugcgucauaagcgucccgagcuucuucaccgacgccgaacgacgcucaguacuagacgcagcccaaaucgucggccugaacugucucagacuaaugaacgauaugacggcagucgcccuaaacuacggcauauacaaacaggaccucccaucacuggaugaaaaaccacguaucguggucuucgucgacaugggccacucagcauuccaagucuccgcaugcgccuucaacaaaggcaaacucaaaguacuaggcacagccuucgacccauuccuugggggcaaaaacuucgacgaaaaacuggucgagcacuuuugcgcagaguucaaaaccaaauacaaacucgacgccaaaagcaaaauccgagcacuucuacgauuauaccaagaaugcgaaaaacucaagaaacucaugagcagcaacucgacagaccuccccuugaacaucgaaugcuucaugaaugacaaggacgugucagggaagaugaaccggucacaguucgaagaacugugcgccgaacuccugcagaaaaucgaagucccacuguacucccuacucgaacaaacccaccugaaagucgaagacgucucagcaguagaaaucgugggaggggcaacccgaauaccugccgucaaagaacguaucgcgaaauucuucggaaaagacaucaguacaacgcucaacgccgacgaagcagucgccagagggugcgcacuccaaugcgcgauccuaucccccgcguucaaaguacgcgaguucuccgugacugacgccgucccauucccaaucucacuaaucuggaaccacgacucagaagacacggaaggaguccacgaagucuucagccgcaaccacgcugcccccuucucuaaaguauuaaccuuccuccgccgagguccauucgaacucgaagcguucuacucagacccacaagggguacccuacccggaggcgaaaaucggccgcuuuguaguacaaaacgucucagcccagaaagacggcgaaaaaucccgggucaaagucaaaguccgcgucaacacccacggcauauucaccaucucaacugccagcauggucgagaaaguaccaacagaggagaacgaaaugucaagcgaagccgacauggaaugccuaaaucaaagaccgccagaaaacccugacaccgacaaaaacguacaacaagacaauuccgaagcagggacccagccacaaguccagacagacgcacaacagaccagccaaucacccccauccccagagcucacgagcgaagaaaacaaaauaccagacgcagacaaggcaaacgaaaagaaagucgaccagccgccagaagcgaaaaagccgaaaaucaaaguagucaacgucgaacuccccauagaagcaaaccucguauggcagcucgggaaagaccuccuaaacauguacaucgagacagaaggcaaaaugauaaugcaagacaaacuagaaaaagaaagaaacgacgcuaaaaacgcaguagaagaguacgucuacgaguuccgcgacaaacucugugggcccuacgaaaaauucaucugcgaacaagaccaccaaaacuuccuaagacuccuaaccgaaacggaagacuggcucuacgaagaaggcgaggaccaagcaaaacaagccuacgucgauaaacucgaggagcuaaugaaaaucggcacgcccgucaaaguccgcuuccaagaagcagaagaacgaccgaagauguucgaagaacugggccagcgcuugcaacacuacgcgaaaauagcggccgacuuccgcaacaaagacgaaaaauauaaccacauagacgaaucagagaugaaaaagguagagaaaagcguaaacgaaguaauggaauggaugaacaacgucaugaacgcccaagccaagaaaucacuagaccaagaccccguugucagagcccaagaaauaaaaaccaaaauuaaagaacucaacaacacaugcgagccagucgucacccaaccgaaaccaaaaauagaaucuccaaaacucgaaagaaccccaaacggcccuaacaucgauaagaaagaagaggaucucgaagacaaaaacaacuucggggcagaacccccgcaccaaaacggcgaaugcuaccccaacgagaaaaacucugugaacauggaccuagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2186 - RNA, 3217 nt, Artificial Sequence
  mRNA product Design1 comprising derived and/or modified sequence from Homo sapiens__NP_006380.1 __HsHYOU1 (opt8)
gggagaaagcuuaccauggccgacaaaguccgacgacaacgaccgcgccgacgaguauguugggcgcucgucgccguacugcucgccgaccuacuggcccuaagugacacccucgcagugaugaguguagaccuaggcuccgaauccaugaaggucgcgauagucaaaccaggagugccgauggaaauaguccucaacaaggaauccaggcgaaaaaccccaguaauaguaacccucaaagaaaacgagcgguucuuuggagacucagcagcaagcauggcaaucaagaauccaaaagccacccuacgauacuuccaacaccuacuaggaaagcaggcagacaacccacacgucgcacuauaccaggccagguucccggaacacgagcugaccuucgacccccaaaggcaaacgguacacuuccaaaucagcagccaacuacaauucagcccagaagaaguccucggaaugguccuaaacuacagcagaagccucgcagaggauuucgccgaacagccaauaaaagacgccguaauaacagucccaguauucuucaaccaagccgagcgacgagccguccuacaggcagcacgcauggccgggcucaagguacuccagcuaauaaacgacaacacggcaacggcccuauccuacggagucuuucggagaaaagacauaaacacaaccgcacaaaacauaauguucuacgacaugggcucaggcucgacagucugcacaauagucacauaccagauggucaaaacaaaggaagccgggaugcaaccgcaacugcaaauacgaggagucggauucgaccgaacacugggaggacuagaaauggaacuacgacuccgagagaggcuggccggccuauucaacgaacaaagaaaaggccaacgcgcaaaagacguaagggaaaacccacgagcaauggcuaaacuacuccgagaagccaaccgacugaaaacaguacuaagcgcaaacgcagaccacauggcgcaaauugaagggcuaauggacgacguagacuucaaagcaaaagucacccgcguggaguucgaggaacucugcgcagaccuguuugaacgcguccccggccccguacaacaagcacugcaaagcgcagaaaugagccuagacgagauagaacaaguaauccuaguaggcggcgccacacgaguacccagaguucaagagguacuacugaaagcugucgggaaagaggaacuaggcaaaaacaucaacgccgacgaggccgcagcaaugggagccguauaucaagcagcagcauuaaguaaagcauucaagguaaagccguuuguaguacgggacgccgucguauacccaauuuuagucgaguucacgcgggaagucgaagaggaacccggaauacacucacugaaacacaacaaacgcguccuauucucacgaaugggucccuacccacaaagaaaaguaauaaccuucaaccgauacagccacgacuucaauuuccacaucaacuacggcgaccuuggauuccuagggcccgaagaccugagagucuucggaagccagaaccucaccacagucaaacugaaaggagugggggacagcuucaagaaauacccagacuaugaaucaaaaggaauaaaggcacacuucaaccucgaugaaagcggaguacugagccuggacaggguagaaagcguuuucgagacacugguggaagacagugccgaagaagagagcacacuaacaaaacugggcaacacaaucaguagccucuucgggggcggaacaacgccagacgcaaaagaaaacgggaccgacaccguacaagaagaagaagaaagcccagccgaaggaagcaaggacgagccaggagagcagguagagcucaaagaagaagcagaggcgcccguagaagacggcucucagccaccuccgcccgaacccaaaggagacgcaacaccagagggagagaaggcgaccgaaaaagaaaacggcgacaaaagcgaggcgcaaaaaccgucggagaaagccgaggcgggaccagaaggaguagccccagcacccgaaggcgaaaagaaacaaaaaccagcgagaaaaagaaggaugguggaggaaaucggcguggaacugguagugcuagauuuacccgaccucccagaagacaaacucgcgcagucgguacagaaauuacaagaccugacacuaagagaucuugaaaaacaagaacgagagaaggcggcaaacagucuggaagcguucaucuucgagacgcaggacaaacuauaccagccggaguaccaagagguaucaaccgaagaacaaagagaggaaaucuccggcaagcuaucggcggccucaacauggcucgaggaugaagggguaggcgccaccacagugaugcuaaaagaaaagcuagcugaacuaagaaaacuaugccaaggucuauuuuuccgagucgaggaaaggaagaaauggccagaaagacuaucggcccucgacaaccuacuaaaccacuccagcauguuucuaaaaggcgcgagacuaauaccagagauggaccaaaucuucacggaagucgaaaugaccacacuagaaaaagugauaaacgagacgugggcauggaaaaaugccacacucgcagaacaagccaaacuacccgcaacggaaaagcccguccuacucagcaaagacaucgaagcaaaaaugauggcguuagaccgcgaaguacaguaccuacuaaacaaagcgaaauucaccaaaccacgaccccgccccaaagacaaaaacggcacacgggcagagccaccacugaacgcaagcgccucagaccaaggggaaaaggucauacccccggccggacaaaccgaagacgcggaaccaauaagcgagcccgaaaagguggagacgggaagcgaacccggcgacacagagccacuggaacuaggaggcccgggcgcagaaccagagcaaaaggaacaaagcacagggcaaaagaggccacucaaaaacgaugaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2187 - RNA, 2416 nt, Artificial Sequence
  mRNA product Design1 comprising derived and/or modified sequence from Homo sapiens__NP_005339.3 __HsHSP90AA1 (opt8)
gggagaaagcuuaccaugccagaagaaacgcaaacgcaagaccaaccaauggaagaggaggaaguagaaacguucgccuuccaggcagagaucgcccaacuaaugagccugauaauaaacacauucuacucgaacaaagagauauuccucagagagcucauaagcaacagcucggacgcacuggacaaaauacgauacgaaucccuaaccgacccgagcaaacucgacuccggcaaagaacuccacaucaaccuaauaccaaauaaacaggaccggacacucaccaucgucgacacagggauaggaaugacaaaagcggaccugaucaacaaccuaggaacgauugcaaaaagcggaacaaaagcguucauggaagcccuccaagcaggcgccgauauauccaugauaggacaauucggcgugggguucuacucagcauacuuagucgcggaaaaagucacgguaauaacgaaacacaacgacgacgaacaguacgcgugggagagcuccgcaggcggcagcuucacaguuaggacagacaccggagagcccauggggcgagggaccaaggucauccuucaccucaaagaagaccaaacggaauaccucgaagaaaggcgcauaaaggaaaucgugaagaaacacucccaauucauaggauacccuaucacacuauucguagaaaaagaacgcgacaaagagguaagcgacgacgaagcggaagagaaggaagacaaggaagaggaaaaagagaaggaagagaaagaaagcgaagacaagcccgaaauagaagacguaggcucggacgaggaagaagaaaagaaagacggcgacaaaaagaagaaaaagaaaauaaaagaaaaauacauugaccaggaggaacucaacaaaacgaaaccgauauggaccaggaacccggacgacaucacaaacgaagaauacggggaguucuacaaaucgcucacaaacgacugggaagaccaccuagcggucaaacacuucaguguggagggacaacuagaguucagagcacuccuguucgucccaaggcgagccccauucgaccuauucgaaaaccgcaaaaagaaaaacaacauaaaacucuacgucagaagagucuuuauaauggacaacugcgaggaacuaauccccgaauaccuaaauuucauccgaggggucguggacucugaagaccucccacuaaacaucucaagagaaaugcugcagcaaaguaagauccuaaaagugauccgcaaaaaccuaguaaagaaaugccuggaacuguucacggaacuggcggaggauaaagaaaacuacaaaaaguucuacgaacaauucuccaagaacauuaaacuggggauccacgaagacucccaaaacagaaagaaacugagcgaacuccugcgauacuacaccagcgcguccggagacgagauggucagccuaaaggacuacugcaccagaaugaaagaaaaccaaaaacacaucuacuauauaacaggggaaaccaaggaccaagucgcaaacagcgccuuuguagagcgccugagaaaacacggacucgaagucauauacaugauagaaccaaucgacgaauacugcguacagcagcugaaggaguucgaaggaaaaacgcuaguaucgguaacgaaagagggacuagagcuacccgaagacgaggaagagaaaaagaaacaagaagaaaagaaaaccaaauucgagaaccucugcaaaauaaugaaagacauccuagaaaagaaaguagaaaaagucguagugucaaaccgccucgucacgagcccauguugcauagucacgucaaccuacggauggacagccaacauggagaggauaaugaaagcccaagcccuacgagacaacucaacaaugggauacauggccgccaagaaacaccuagaaauaaaccccgaccauucgauaauagagacucuccgacaaaaagccgaggccgacaagaacgacaagagcguaaaagaccugguaauccuccucuacgaaacggcccuccuaucaagcggguucagccuagaagacccacaaacccacgccaaccgcaucuacagaaugauaaaacuaggacucggaaucgacgaagacgacccgaccgcggacgacaccucagcagcgguaacagaggaaaugcccccacuagaaggggacgacgacacgagcagaauggaggaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2188 - RNA, 556 nt, Artificial Sequence
  mRNA product Design1 comprising derived and/or modified sequence from Homo sapiens__NG_005218__HsHSP90AA3P (opt8)
gggagaaagcuuaccauggacuccucaaaacuagacuccggcaaaggacuccacaucaaccucguccccaacaaacaaaaccaaacacucaccauaguagacacacgcaucggcaugaccaaaacagaccucaucaacaaccucggcaccgucaccaaauccggaacaaaagccuucauggaagcacuccaagccgacgcagacaucuccaugaucggacacuucggcgucggcuucuacucagcauaccucgucgccaaaaaagucaccguaaucucaaaacacaacaacgacgaacaauacaccugggaauccuccgcaggcggcuccuucaccguacgaacagacgaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2189 - RNA, 2392 nt, Artificial Sequence
  mRNA product Design1 comprising derived and/or modified sequence from Homo sapiens__NP_031381.2__HsHSP90AB1 (opt8)
gggagaaagcuuaccaugcccgaagagguacaccauggugaagaggaagucgagaccuucgccuuccaagccgaaauagcacaauuaaugagccugauaaucaacaccuucuacucgaacaaagaaaucuuccugcgcgaacucaucucgaacgcaagcgacgcccuagacaagauaagauacgaaucacugacagaccccagcaagcuagacucagggaaggagcucaaaaucgacaucauuccaaacccccaagaacggacacuaacccugguggacacagggaucgggaugaccaaggccgaccugauaaacaaccucgggacaaucgccaaaagcggcaccaaagcguuuauggaggcccuacaagccggagccgacaucagcaugaucgggcaauucggcgucggauucuacagcgccuaucuaguagcggaaaaaguaguagugaucacaaaacacaacgacgacgaacaauacgccugggaaagcagugcaggaggcagcuucacggugcgagccgaucacggagaacccauaggacggggcaccaaggugauacugcaccucaaagaagaccaaaccgaauaccuggaagaacgacgaguaaaggaggucguaaagaagcacagccaauucauaggcuacccaauaaccuuguaccuagagaaagaacgggaaaaagagauaagugacgacgaagcugaagaagaaaaaggcgaaaaagaagaagaagacaaagacgacgaagaaaagcccaaaaucgaggacguaggcagcgacgaagaagacgacagcggaaaagacaagaaaaagaaaacaaagaaaauaaaagagaaguacaucgaccaagaagaacucaacaaaacgaagcccauauggacaagaaauccagacgauaucacgcaagaagaauacggagaguucuauaagagucuaaccaacgacugggaagaccaccuagcggucaaacacuucagcgucgaaggacagcuagaguuccgagcccugcuauucaucccccgaagggcacccuucgaccuauuugaaaacaaaaagaagaaaaacaacauuaaacucuacguacgccgcgucuucauaauggacagcugcgacgaacuaauaccagaauaccugaacuucauccgcggagucgucgacagcgaagaccuaccacugaacauaucacgagaaaugcugcaacaaagcaaaauccucaaagucauacgcaaaaacaucguaaagaaaugccuugaacuauuuucggaacuggcagaagacaaagaaaauuacaagaaauucuacgaagccuucagcaaaaaccucaaacugggaauccacgaagacuccacaaaccgaagaagacuaagcgaacuccuaagauaccacaccagucaaagcggcgacgaaaugacaagccucucagaauacgugucccgaaugaaagaaacccagaaaagcaucuacuacaucacgggcgaaagcaaagaacaaguagcaaacagugcuuucguagaacgggugagaaagcgaggauucgaagucguguauaugaccgaaccaaucgacgaauacugcguacaacaacuaaaagaguucgauggcaagucccucguaucagucacgaaagaaggccuagaacugccggaagacgaagaagagaaaaagaaaauggaagaaagcaaagcaaaauucgaaaaccugugcaaacucaugaaagaaauacucgacaagaaagucgaaaaaguaacaauaagcaaccggcuagugagcagcccaugcugcaucgucacaagcacauacggcuggacggcgaacauggaaagaauaaugaaagcacaagcccuacgagacaacagcacgaugggauacaugauggcaaagaagcaccuagaaaucaacccagaccacccaaucguggaaacacuccgacaaaaagccgaagcagacaagaacgacaaggccguaaaagaucuagugguacuacuguucgaaaccgcgcuacucagcucaggauucagccucgaggacccacaaacccacucgaacaggaucuacagaaugaucaaacuaggccugggaauagacgaagacgaagucgccgccgaagaacccaacgcggcagucccagacgaaaucccaccauuggagggagacgaagacgcaagcaggauggaggaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2190 - RNA, 2629 nt, Artificial Sequence
  mRNA product Design1 comprising derived and/or modified sequence from Homo sapiens__NP_003290.1__HsHSP90B1 (opt8)
gggagaaagcuuaccaugagggcguuauggguccuagggcugugcugcguccuccugacguucggcagcgucagagcagacgacgaaguggacguagacggcaccguagaagaagaccugggaaaauccagagaggguagcagaaccgacgaugaagucgugcagcgagaggaagaagccauccaacucgacgggcugaacgcgucacagauacgggaacuacgagagaaaagcgaaaaauucgccuuccaagcagaagucaaccgaaugaugaaguuaaucauaaacucacuauacaaaaauaaagaaauauuccucagagaacugauaagcaacgcgagugacgcacuagacaaaaucagacucaucagccucaccgacgaaaacgcccuuagugggaacgaagaacuaacagucaaaaucaaaugcgacaaggaaaagaaccuacuacacguaacagacacggguguaggaaugacccgggaggaacucgucaaaaaccucggcaccauagcgaaaagcggaacaucagaguuccucaacaaaaugacagaggcccaggaagacggacaaagcaccagcgaacugaucgggcaauucggaguaggauucuacagcgcguuccucguggcagauaaggucaucgucaccucaaaacacaacaacgacacccagcacauaugggagagcgacagcaacgaguucuccguaaucgcggacccccgcgggaacacgcucggccgcggaaccacaaucacacucguacucaaagaagaagcaagcgacuaccuagagcucgauacaauaaagaaccuggugaaaaaguacagccaguucaucaacuucccaaucuacguauggagcagcaaaacugagacgguagaagaaccaauggaagaagaggaagcagccaaagaagaaaaagaagagucggacgacgaggcagcgguagaagaagaagaagaagagaagaaaccgaaaaccaagaaaguagagaaaacgguaugggauugggaacuaaugaacgacaucaaacccauauggcagcgccccagcaaagaagucgaagaagacgaauacaaggcauucuacaagagcuucagcaaagaaagugacgacccgauggccuacauacacuucaccgcagaaggggaaguaacauucaagagcauacuauucgucccaaccucagcgccgcgaggacucuucgacgaguacgggagcaagaaaagcgacuacaucaaacuguacguaagacgcguauucauaaccgacgacuuccacgacaugaugcccaaauaccuaaacuuugugaaagggguaguagacagcgacgaccuaccccuaaacguguccagagaaacccuccagcagcacaaacuccugaagguaauaaggaagaaacuggugcggaaaacacuagacaugauaaagaaaauagccgacgacaaguacaacgacaccuucuggaaggaguucggcaccaacauaaaacuaggggugaucgaagaccauagcaaccggacccgacucgcaaaacuccuaagauuccaaucaagccaccaccccaccgacauaacgagccucgaccaguacguggaaaggaugaaggaaaagcaagauaaaaucuacuuuauggcgggcuccucccgaaaagaagcagaaagcucacccuucguagagcgacuacucaagaaaggguacgaaguuauauaccugacagaaccuguggacgaauacugcauacaagcacugccggaguucgauggcaaacgcuuccaaaacguggcaaaagaaggcguaaaauucgacgaaagcgagaaaacgaaagaaucacgcgaagcaguagaaaaagaguucgaaccccuacucaauuggaugaaagacaaagcauuaaaagacaaaauagaaaaagcaguagugagccaacgcuugaccgaaagcccgugugcccucguagcaagccaguacggcuggagcgggaacauggagagaaucaugaaagcgcaggcguaccaaacaggaaaagacauauccaccaacuacuacgcuucacaaaagaaaaccuucgaaauaaacccaagacauccgcuaauccgcgacaugcugcgacgaauaaaggaggacgaagacgacaagacaguacucgaccucgcagucguccucuucgaaaccgcaacgcuacggucaggcuaccugcucccagacacgaaagcauacggagacaggauagagaggaugcucagacuaagccuaaacauagacccggacgccaagguagaagaagaaccagaggaagaaccggaagaaacggcagaagacaccacagaggacacagagcaagacgaggacgaggaaauggacguaggaacugaugaagaagaagaaacggccaaagaaucgacagcagaaaaggacgaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2191 - RNA, 2332 nt, Artificial Sequence
  mRNA product Design1 comprising derived and/or modified sequence from Homo sapiens__NP_057376.2__HsTRAP1 (opt8)
gggagaaagcuuaccauggcacgagaacuaagggcccuccuccuuuggggccgacgccuccgcccgcuacuucgcgcgccagcacuggcagcugucccaggaggcaaacccauccuaugcccccgccgaacaaccgcacagcucggucccagacgcaacccagcuuggucccuucaagcaggccgccucuucuccacucaaacagcagaagacaaagaagaaccacuccacagcauaaucucaucaaccgaaucaguacaaggcucaacaucuaaacacgaguuccaagccgaaacuaagaaacugcucgacauaguggccagaucccuauacuccgaaaaagaagucuucauccgcgaauugaucucaaacgcauccgacgcacucgaaaaacuacgacacaaacucgucuccgacggccaagcccucccagaaauggaaauccaucugcaaacuaacgccgaaaaaggcaccauaacaauccaggacacaggcaucggcaugacccaagaggaacuugucuccaaccucggaacaaucgcccgcagcggauccaaagcauuccucgacgcccuacaaaaccaagcagaagcaagcuccaaaaucaucggacaauucggagucggcuucuacucagccuucauggucgccgaccgcgucgaaguguacucacgcucagcugcacccggaagucuaggcuaucaauggcuaucagacggaagcggggucuucgaaaucgcagaagccucuggcgugcgcacaggcaccaaaaucaucauccaccugaaauccgacugcaaagaguucucgagcgaagcacgagucagggacguuguaaccaaauacucaaacuucguauccuuuccacuauaccucaauggccgucgaaugaacacccuccaagcaaucuggaugauggacccuaaagacguaagagaauggcaacacgaagaguucuaccgcuacguugcccaagcucacgacaaaccacguuacacccugcacuacaaaaccgacgcaccccugaauauccgaagcauuuucuacguccccgacaugaaacccucuauguucgacguaucccgcgaacucggcuccucagucgcccuauacucccgcaaaguccuuauacaaaccaaagccaccgacauacucccaaaauggcuccgcuuuauacgaggagucgucgacucagaagacaucccgcucaaccugagccgagaacuacuccaagaauccgcccucauucgcaaacugcgugacguccuccaacaacgccucaucaaauucuucaucgaccaaucaaagaaagacgccgaaaaauacgcuaaauucuucgaagacuacggccuauucaugcgcgaaggaaucgugaccgccacagaacaagaggucaaagaagacauagccaaacuccuaagauacgaauccuccgcacugcccucgggacaauuaaccucacuauccgaauacgcaagccguaugcgcgccgggacccgcaacaucuacuaccucugcgcccccaaccgacaccuggcagagcacuccccauacuacgaggcaaugaaaaagaaagacaccgaaguccuuuucugcuucgaacaauucgacgaacuaacccucuuacaccuaagggaguucgacaaaaagaaacucaucucaguggaaacggacaucguagucgaccacuacaaagaagaaaaauucgaagaccgcucaccagccgcagaaugucuauccgaaaaagaaacagaagaacucauggccuggaugcgcaacguccuaggcagucgcgucacaaacgucaaaguaacccuuagacuugacacccaucccgccaugguaacaguccucgaaaugggagccgcacgccacuuccuaagaaugcagcaacuagccaaaacacaagaagaaagagcccaacuccuacaaccuacacuagaaaucaacccccgccacgcacucaucaagaaacuaaaccaacuacgcgcaagcgaaccaggccuagcgcaacuccuaguagaccaaaucuacgaaaacgccaugauagcagcaggccuaguagacgacccccgcgccauggucggccgccucaacgaacuccuaguaaaagcccucgaaagacacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2192 - RNA, 679 nt, Artificial Sequence
  mRNA product Design1 comprising derived and/or modified sequence from Homo sapiens__NP_000609.1__HsIGF1 (opt8)
gggagaaagcuuaccaugggcaaaaucuccucacuccccacacaacuauucaaaugcugcuucugcgacuuccucaaagucaaaaugcacacaauguccuccucacaccucuucuaccuagcccucugccuacucaccuucacaucaucagccacagccggcccugaaaccuuaugcggagccgaacucguagacgcccuccaauucgucugcggagaccgaggcuucuacuucaacaaacccaccgguuacggaucaucaucccgccgcgccccacaaacaggcaucgucgacgaaugcugcuuccgcucaugcgaccuccgaagacuagaaauguacugcgcaccccucaaacccgccaaauccgcccgcuccguccgagcccaacgccacacagacaugcccaaaacacaaaaagaaguccaccucaaaaacgccucccgaggauccgccggcaacaaaaacuaccgcauguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2193 - RNA, 760 nt, Artificial Sequence
  mRNA product Design1 comprising derived and/or modified sequence from Homo sapiens__NP_000603.1__HsIGF2 (opt8)
gggagaaagcuuaccaugggcauaccaaugggcaaauccaugcuaguacuccuaaccuuccuugccuucgcauccugcugcauagccgccuaccgacccuccgaaacacucugcggcggcgaauuagucgacacccuacaauucgucugcggcgaccgcggcuucuacuucucccgaccagccucccgcgucuccagacgcucacgcggcaucguagaagaaugcugcuuccgaucaugcgaccucgcccuccucgaaaccuacugcgccacccccgcaaaaucagaacgagacgucucaaccccacccaccguccuccccgacaacuuccccagauaccccguaggcaaauucuuccaauacgacaccuggaaacaauccacccaaagacuuagacgcggccuccccgcccuacuccgagcccgccgcggacacguacucgccaaagaacucgaagccuuccgcgaagccaaacgccaccgcccacucaucgcccuacccacacaagaccccgcccacggcggcgcacccccagaaauggccucaaaccgaaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2194 - RNA, 856 nt, Artificial Sequence
  mRNA product Design1 comprising derived and/or modified sequence from Homo sapiens__NP_000591.1__HsIL6 (opt8)
gggagaaagcuuaccaugaacuccuucuccacaucagccuucggccccgucgccuucucccucggacuccuccuuguccucccagccgccuuccccgccccagucccccccggcgaagacucaaaagacguagccgccccccaccgacaaccccuuaccuccuccgaacgcaucgacaaacaaauacgauacauccuagacggcaucucagcccuccgcaaagaaaccugcaacaaauccaacaugugcgaaucuuccaaagaagcccuagccgaaaacaaccucaaccuccccaaaauggccgaaaaagacggcugcuuccaaucaggauucaacgaagaaaccugccuugucaaaaucaucaccggccuccucgaauucgaagucuaccucgaauaccuccaaaaccgcuucgaaucauccgaagaacaagcccgcgccguccaaaugucaacaaaaguccucauacaauuccuccaaaaaaaagccaaaaaccucgacgccauaaccacccccgaccccaccaccaacgccucacuacuaaccaaacuccaagcccaaaaccaauggcuacaagacaugaccacccaccucauccuccgcuccuucaaagaauuccuacaaagcucccuccgcgcccuacgccaaauguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2195 - RNA, 1498 nt, Artificial Sequence
  mRNA product Design1 comprising derived and/or modified sequence from Homo sapiens__NP_002183.1__HsINHBA (opt8)
gggagaaagcuuaccaugccacuacuauggcuccgcggcuuccuacuggccucaugcuggaucaucguacgcagcagccccacaccaggaagcgagggacacagcgcagccccagacugcccaagcugcgcccuagcggcccugccaaaagacguacccaacagccaacccgaaaugguagaagccgucaaaaaacacauacuaaacaugcuacaccuaaaaaaaaggccagacguaacacaacccgucccaaaagcagcacuacucaacgcaauccgcaaacuccacgucgggaaagucggagaaaacggauacguagagauagaagacgacaucgggcgccgcgccgaaaugaacgaacucauggaacaaaccucagagauaaucacguucgccgaaagcggaacagcccgcaaaacacuacacuucgaaauaagcaaagaaggcagcgaccuaagcgucgucgagcgcgcagaagucuggcucuuccucaaaguacccaaagcaaaccgcacacgaacaaaagucacaauacgacuguuccagcaacaaaagcacccacaaggcucccucgacacaggcgaagaagcagaagaaguaggccuaaaaggagaacggagcgaacuacuccuaucagaaaaagucguagacgcacgcaaaagcacguggcacgucuucccaguaagcagcagcauacaacgacuacucgaccaaggcaaaagcagccucgacgucagaauagcaugcgaacaaugccaagaaucaggcgccucccucguccuacugggaaaaaaaaagaaaaaagaagaagaaggcgaaggaaagaaaaaaggcgguggagaaggaggcgcaggagcggacgaggaaaaagaacaaucccaccgcccauuucuaaugcugcaagcacggcaaucagaagaccacccccaccgccgccgacgacgaggacuagaaugcgacggaaaagucaacaucugcugcaaaaaacaauucuucgucagcuucaaagacauaggauggaacgacuggauaauagcgccaagcggauaccacgcaaacuacugcgaaggcgaaugccccagccacauagcaggcacaagcgggagcagccugucguuccacagcaccgugaucaaccacuacagaaugagaggacacuccccauucgcaaaccugaaaucgugcugcguccccaccaaacuacgaccgaugagcaugcucuacuacgacgacggacagaacaucauaaaaaaagacauacaaaauaugaucguggaagagugcggaugcagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2196 - RNA, 1441 nt, Artificial Sequence
  mRNA product Design1 comprising derived and/or modified sequence from Homo sapiens__NP_002184.2__HsINHBB (opt8)
gggagaaagcuuaccauggacggccugccaggccgagcguuaggcgccgccugccuccuacuccuagcagcaggcuggcucggccccgaagccuggggaucaccaaccccaccaccaacccccgcagccccucccccacccccaccacccggcagucccggcggaucacaagauaccugcaccucaugcggcggauuccgcagaccagaagaacucggacgcguagacggagacuuccucgaagccguaaaaagacacauacuaucccgccuccaaaugcgcggccgacccaacaucacacacgccguccccaaagccgccauggucaccgcccuacgcaaacuacacgccggcaaaguucgcgaggacggccgagucgaaaucccacaccucgacggccacgccucccccggcgcagacggacaagaacgaguuagcgaaaucaucuccuuugccgaaacagacggccuagccucaucacgaguccgacucuacuuuuucaucuccaacgaaggaaaccaaaaccucuucgucguacaagcaucccuauggcuauaccuaaaacuccuacccuacgucuuagaaaaaggaucccgccgcaaaguccgcgucaaagucuacuuccaagaacagggccacggcgaccgcuggaacauggucgaaaaacgcguagaccucaaacgcuccggcuggcacaccuucccccuaaccgaagccauccaagcccucuucgaacgcggcgaacgacgccuaaaccucgacguacagugcgacucaugccaagaacucgccguaguacccguauucgucgacccaggggaagaaagccacagaccauucgucgucguccaagccagacucggcgacucccgacaccgcauacgcaaacgaggccucgaaugcgacggccgcacaaaccucuguugccgccaacaauucuucaucgacuuccgccuaaucgguuggaacgacuggauuauagccccaacaggauacuacggcaacuacugcgaagggucaugccccgccuaccuagccggaguccccggcucugccagcucauuccacacagcagucgugaaccaauaccgcaugcgaggccuaaaccccggcaccguaaacucuugcugcauccccacaaaauuaucaaccauguccaugcuuuacuucgacgacgaauacaacauagucaaacgcgacguccccaacaugauaguagaagaaugcggcugcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2197 - RNA, 3676 nt, Artificial Sequence
  mRNA product Design1 comprising derived and/or modified sequence from Homo sapiens__NP_000623.2__HsITGAM (opt8)
gggagaaagcuuaccauggcacuucgcguccuccuccuuaccgcccuaacccuaugucauggauucaaccucgacaccgaaaaugccaugaccuuucaagaaaacgcccgcggauucggccagucuguaguacagcuccaaggaucuagaguagucgucggugccccucaagaaaucguagcagcaaaccaacgcgguagucuauaccaaugugacuacucuacuggcucgugcgaaccuaucaggcuccaaguccccguggaagccgucaacauguccuuaggacuaucacuggccgccaccaccuccccaccgcaacuccuagccugcggacccaccguacaccaaacauguagcgaaaacacguacgucaaaggacucuguuuucucuucggcagcaaccuacgccaacaaccccaaaaauucccugaagcccucagaggcugcccacaagaagacuccgacauagccuuccucaucgacggauccggcuccauuauaccccacgacuuccggaggaugaaagaauuugucucgacgguaauggagcaacucaagaaaucaaaaacacuguucagccuaaugcaauacucggaggaguuccgaauccacuucaccuucaaagaguuccaaaacaaccccaacccccguagccuuguuaaacccauaacccaacuacugggccgaacacacaccgccaccggcauccgcaaagucguccgcgaacuauucaacauaaccaacggcgcacgcaaaaaugcuuucaagauacuuguaguaaucacagacggagaaaaauucggagacccauugggauacgaagacgucauuccugaagccgaccgagaaggcguaaucagauacgugauagguguaggcgacgcauucagaucagaaaaaucacgccaagaacuaaacacaauagccuccaagccaccccgagaccaugucuuccagguaaacaauuucgaggcacuuaaaacuauucagaaccagcuccgugagaaaaucuucgccaucgaaggaacucagacaggauccuccucgucuuucgaacaugagaugagccaagaaggcuucagcgcugccaucaccucuaacggacccuugcuaucuacagucggcuccuacgacugggccggcggcguguuccucuacaccuccaaagaaaaauccacguucauaaacaugacacgagucgacucggacaugaaugacgcguaccuugguuaugcugccgcaauuauacuuagaaaccgugugcaaucccuuguacucggcgcucccagauaucaacacaucggccucgucgcuauguuucgucaaaauaccgggaugugggaauccaacgccaaugucaaaggcacccaaaucggcgccuacuucggcgcgagccuaugcucagucgacgucgacucaaacggauccaccgaucuaguccugaucggagcaccacacuauuacgaacaaaccagaggcggccagguaucagucugcccacucccccgaggccgcgcccgcuggcaaugcgacgccguccuuuacggcgagcagggccagccuuggggacgauucggagccgcccucaccguacucggugacguuaacggagauaaacuaacagacgucgcaaucggcgcccccggagaagaagacaacagaggagcggucuaccucuuucacggaaccuccgggagcggaaucagcccgucccauucccagcgcauugcagguagcaaacucaguccccgccuccaguacuucggccaaucccuguccggcggccaagaccuuacaauggacggccuaguagaccucaccgucggugcucagggccauguccugcuucuacgcucucaaccagucuuacgaguaaaagcaauaauggaguucaacccacgcgaagucgcccgcaacgucuucgaaugcaacgaccaggucguaaaaggcaaagaagccggagaaguccguguaugccugcacguacaaaaguccacccgcgaccgccuacgggaaggccaaauacagucugucgucacuuaugaccucgcucucgacuccggaagaccgcacucucgggccgucuuuaacgaaaccaaaaacucaacacgacgacaaacacaggugcucggccugacgcagacaugcgagacgcucaaauugcagcuaccaaacugcaucgaagacccaguaagcccuauuguccuucgccuaaacuucagccucguggggacaccacuaagcgccuucggcaaccuacgcccgguacucgcggaagacgcccagcgccucuucaccgcccuuuuucccuucgagaaaaacugcggcaacgauaacaucugccaagacgaucugucgaucaccuucagcuucaugucccucgacugucucguagucggaggcccccgugaguucaacguaaccguaaccguccgcaacgacggagaagacagcuaccgcacucaggucaccuuuuucuucccccucgaccugucuuacagaaaaguaucaacacuccaaaaccaacgaucccaacguucauggcgacuagccugcgaauccgccagcuccacugaagucagcggcgcccucaaaagcacguccugcucgaucaaccaccccauauuccccgagaacucagaagucacauucaacaucacauucgacguagauucaaaggcuucacucggaaauaaacugcuucucaaagccaacgucaccucagaaaauaauaugccccguacuaacaaaaccgaguuucaacuagaacucccggucaaauacgccgucuacaugguaguaaccucucacggaguauccaccaaguaccucaacuucacugcauccgaaaacacuucucgcgucaugcagcaccaauaucaagucuccaaccucggucaacguucacugcccaucucccuaguauuccuggucccaguacgccuaaaccagaccgucauaugggacagaccccaagucaccuucucagaaaaccuuagcucuaccugccauacaaaggaaagauuacccucacacuccgacuuucucgcagagcucaggaaagcccccguagucaacugcucgauagcaguaugccaacgaauacaaugcgauaucccauucuuuggcauccaggaagaguucaacgccacccugaaggguaaccucucauucgacugguacauaaagacaucacauaaccaucuacuuauagucagcacagccgaaauccuguucaacgacucaguguucacccuccugcccggccaaggagccuucguacgcucacaaaccgaaacaaaaguugaaccuuucgaaguucccaacccccuuccgcucauagucggcuccucagucggaggccuccuccuacucgcccuaauaaccgcagccuuguacaaacucggauucuucaaacgccaguacaaagacaugaugucagaaggagguccucccggcgcagaaccacaauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2198 - RNA, 1621 nt, Artificial Sequence
  mRNA product Design1 comprising derived and/or modified sequence from Homo sapiens__NP_002415.1__HsMMP8 (opt8)
gggagaaagcuuaccauguucucacuaaaaacccuacccuuucuccuacuccuucacguccagauaucaaaagccuuccccgucuccucuaaagagaaaaacaccaaaaccgugcaagacuaccucgaaaaauucuaccaacucccguccaaccaauaccaaucaacacgcaaaaacggcacuaacguaaucgucgaaaaauugaaagaaaugcaacgauucuucggccucaacgucaccggcaaacccaacgaagaaacccucgacaugaugaagaaaccccgaugcggaguacccgacucuggcggcuucaugcucacucccggcaaucccaaaugggaacgcacuaaccucaccuaccgcaucagaaauuacacaccccaacucucagaagccgaagucgaaagagcgauuaaagacgcauucgaacuaugguccgucgccagcccccuaaucuucacccgcaucucccaaggugaagccgacaucaacauagcauucuaccaacgcgaccacggugacaacuccccauucgacggcccaaacggcauacuugcccacgcauuccaacccggucaaggaaucggaggcgacgcccacuucgacgccgaagaaaccuggaccaacacauccgcaaacuacaaccuauuccucguugccgcccacgaguucggccacucccuaggcuuagcacacuccuccgauccaggugcccuaauguauccaaacuacgccuuccgcgaaaccuccaauuacucccuaccccaagaugacaucgacggaauccaagcaaucuacggacucucauccaaccccauccaacccaccgguccaucaaccccaaaacccugcgaccccucccucaccuucgacgcaaucaccacucucagaggugaaauccucuucuucaaagaccguuacuucuggcgaagacacccacaacuccaacgcgucgaaaugaacuuuauuucacucuucuggcccucgcuucccaccggcauccaggccgcauacgaagacuucgaccgcgaccuaaucuuccucuucaaagguaaccaauacugggcacuaucaggcuacgacauccuucaaggcuaccccaaagacauauccaacuacggcuucccauccuccguccaggcaaucgacgcugcagucuucuauagauccaaaaccuacuucuucgucaacgaccaauucuggcgauacgacaaccaacgacaauucauggaacccggcuaccccaaaucaaucuccggcgcuuuccccggcaucgaauccaaagucgacgccguuuuccaacaagaacacuucuuccacgucuucuccgggccacgauacuacgccuucgaccucaucgcccaacgcgucacccgaguagcacgcggcaacaaauggcuuaacugccguuacggcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2199 - RNA, 2341 nt, Artificial Sequence
  mRNA product Design1 comprising derived and/or modified sequence from Homo sapiens__NP_004985.2__HsMMP9 (opt8)
gggagaaagcuuaccaugucccucuggcaaccccuaguucuaguccuccucguacuuggaugcugcuucgcagcaccccgacaacgccaauccacccuaguccucuucccuggcgaucuucgaacaaaccugaccgaccgccaacucgcggaagaauaucucuaccgcuacggcuacacacguguagccgaaaugcgcggagaauccaaaagccuagguccagcacuccuccuccuccaaaaacaacuuucacuccccgaaacgggcgaacucgacuccgccacccucaaagcaaugagaacaccacgcugcgggguacccgacuuagggagauuccaaacguucgaaggagaccuaaaguggcaccaccacaacauaacuuacuggauacaaaacuacagcgaggaccugccccgagcagucaucgacgacgccuucgcaagagccuucgcccuauggagcgccguaacaccccucaccuucacccguguauacucccgagacgccgacauugucauccaauucggcguagccgaacacggagacggcuacccauucgacggcaaagacggccuauuggcacacgcauuuccacccggcccaggaauacaaggcgacgcccacuuugacgaugacgaacucuggagccugggaaaaggagucguaguccccaccagauucggcaacgcagacggagcagcaugccacuuccccuuuauauucgaaggccgcucuuacagcgccugcacuaccgauggccgcuccgauggucuacccuggugcuccaccaccgccaacuacgacaccgaugaucgcuucgguuucuguccaucugaaagacucuacacccaggacggcaacgccgacggcaaacccugccaauuuccauucaucuuccaaggccaaucuuacuccgcaugcaccacagacggccgauccgauggauaucgcuggugcgccacaacugccaauuacgaccgagacaaacucuucggauucugcccaacccgagcagacucaaccguaaugggaggaaacucagccggcgaauuaugcguauuucccuucaccuuccucggaaaagaguacuccacgugcaccagcgaaggccgaggagacggacgacuauggugcgccaccacaucaaacuucgacuccgacaagaaauggggcuucugccccgaucaaggcuacucucuguucuuagucgccgcacacgaguucggacacgcccugggacuagaccacaguucaguccccgaagcgcucauguaccccauguaccgcuucacagaaggaccaccacuacacaaggacgacguaaacggcaucagacaccuauaugguccccgaccagaacccgaaccacgcccucccacuaccacuaccccacaaccaacugccccacccacaguauguccaacaggaccacccaccguacaccccuccgaacgccccaccgccggcccuaccggaccucccuccgcaggucccacaggaccacccacagccggccccuccaccgccaccacaguucccuuauccccugucgacgacgcaugcaacgucaacauauucgacgcuaucgccgaaaucggcaaucaacuauaccuguucaaggacggcaaauauuggcgcuucucagaaggccgaggcagccgcccucaagguccauuccucauugccgacaaauggcccgcccuccccagaaaacuugacuccgucuucgaagaacgucucuccaagaaauuauucuucuucucaggccgucaagucugggucuacaccggcgccagcguccucggccccagacgucuagacaaacuuggacucggagccgacgucgcucagguaaccggggcucugcgauccggacgcgggaagauguugcuauucagcggacgcagacuauggcgcuucgacgucaaagcccaaauggucgacccgagauccgccuccgaaguugaccguauguucccaggcgugccccucgacacccacgacguauuccaauaccgcgaaaaagcauacuucugccaggaccgcuuuuauuggcgagucucuucccgaucugaacuuaaccaagucgaccaaguaggauaugucaccuacgacauccuccagugccccgaggacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2200 - RNA, 1633 nt, Artificial Sequence
  mRNA product Design1 comprising derived and/or modified sequence from Homo sapiens__NP_002418.1__HsMMP13 (opt8)
gggagaaagcuuaccaugcacccaggcguccucgcagcuuuccucuuccucuccuggacacacugccgcgcauuaccccuccccucaggaggcgacgaagacgaccucuccgaagaggaccuccaauucgccgaacguuaccuccgcuccuacuaccacccgacaaaccucgcaggaauacucaaggaaaacgccgccuccuccaugaccgaacgccuuagagaaaugcagucauucuucggccuagaaguaaccggaaaacuagacgacaacacccuagacgucaugaaaaaaccccgaugcgguguccccgacgucggcgaauacaacgucuucccccgcacccuuaagugguccaaaaugaaccugaccuaucgcauagucaacuacacgccagacaugacccauuccgaagucgaaaaagcauucaaaaaagcguucaaaguaugguccgacgucaccccacuuaacuucacacgccuccacgacggaaucgcagacaucaugauaagcuucgguaucaaagaacacggcgacuucuaccccuucgacggcccaucaggccuacuagcccacgcauucccccccggcccgaauuacggcggcgacgcccacuuugacgaugacgaaaccuggacauccuccuccaaagguuacaaccuauuccuaguagccgcacacgaauucggccacucccucgggcuagaccacuccaaagaccccggagcccucauguuccccauauacacuuacaccggcaaaucccacuucaugcuacccgacgacgacguacaaggcauccaaucccuguacggcccaggcgacgaagacccaaaccccaaacaccccaaaacucccgacaaaugcgaccccucccucucccuagacgccaucaccucacuccgcggcgaaacaaugauauucaaagaccguuucuucuggcgccuccacccacaacaaguagaugcagaacucuuccuaacaaaauccuucuggcccgaacuaccaaaccgaaucgacgcugcauaugaacauccaucccacgaccucauuuucauauuucgaggccgaaaauucugggcacuaaacgguuacgacauccucgaaggcuaccccaaaaaaaucuccgaacuaggccuucccaaagaaguaaaaaaaaucucagccgccguccacuuugaagacaccggaaagacucuacuauucucaggcaaccaagucuggcgauacgacgacaccaaccacauaauggacaaagacuaccccaggcuaauagaagaagacuuuccaggcaucggagacaaaguagacgccguauacgagaaaaacggcuacaucuacuucuucaacggccccauacaauucgaguacuccaucugguccaaucgaaucguacgcgucaugcccgccaacucaauccucuggugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2201 - RNA, 1285 nt, Artificial Sequence
  mRNA product Design1 comprising derived and/or modified sequence from Homo sapiens__NP_001286.1__HsCCR1 (opt8)
gggagaaagcuuaccauggagacccccaacaccacagaagacuacgacaccaccaccgaauucgacuacggugacgccacccccugucaaaaagucaaugaacgcgccuucggcgcacaacuacuaccgccccucuacucgcucguuuucguaaucggccucgucggaaauauacucgucguccucguccuaguccaauacaaacgccucaaaaacaugacuucaaucuaccuccuuaaccuagccaucucugaccuccucuuccuauucacacucccauuuuggaucgauuacaaacucaaagacgacugggucuucggcgacgcaaugugcaaaauccuaucaggcuucuacuacaccggccuauauagcgaaaucuucuucauuauccuucucaccaucgaccgcuaccucgccauaguccacgcagucuucgccuugcgcgcacgcaccguaacuuuuggagucauaaccuccaucaucauuugggcucucgccauccucgccucaaugcccggccuauacuucuccaaaacacaaugggaauucacccaccauacuugcucccuccacuucccacacgagucccuaagagaauggaaacucuuucaagcacucaaauuaaaccucuuuggucucguucuuccccuccucgucaugauaauuugcuacaccggcaucaucaaaauccuccuccgccguccaaacgaaaaaaaauccaaagccguccgccuaaucuucguaauaaugaucaucuucuuccucuucuggacccccuacaaccucacaauccucaucuccgucuuccaagauuuccucuucacccacgaaugcgaacaaucucgucaccucgaccucgcuguccaagucacagaagucaucgcuuacacacacugcugcgucaaccccguaaucuacgcauucgucggugaacgauuccgcaaauaccuccgccaacucuuccaccgccgcguagccguccaccucgucaaauggcuucccuuccucuccgucgaccgacucgaacgcguaucuagcaccuccccuuccacaggagaacacgaacucuccgccggcuucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2202 - RNA, 853 nt, Artificial Sequence
  mRNA product Design1 comprising derived and/or modified sequence from Homo sapiens__NP_002598.4__HsPDGFA (opt8)
gggagaaagcuuaccaugcgcacccucgccugccuccuccuccucggcugcggcuaccucgcccacguccucgccgaagaagccgagaucccacgcgaaguaaucgaacgccucgcccgcucccaaauacacuccauccgcgaccuccaacgccuccucgaaaucgacucaguaggcuccgaggacucacucgacaccucacuccgcgcccacggcguccacgccaccaaacacguccccgaaaaaagaccacucccaauccgacgaaaacgauccaucgaagaagccguccccgcagucugcaaaacccgcaccgucauauacgaaaucccacgaucccaagucgaccccaccuccgccaacuuccuaaucuggcccccaugcgucgaagucaaacgaugcaccggcugcugcaacacauccuccguaaaaugccaacccagccgcguccaccaccgcuccguaaaaguagcaaaagucgaauacguacgcaaaaaacccaaacuaaaagaaguccaaguccgccucgaagaacaccuagaaugcgcaugcgcaacaacaucccuaaaccccgacuaccgcgaagaagacaccggccgaccacgagaauccggcaaaaaacgcaaacgcaaacgccucaaaccaacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2203 - RNA, 943 nt, Artificial Sequence
  mRNA product Design1 comprising derived and/or modified sequence from Homo sapiens__NP_002599.1__HsPDGFB (opt8)
gggagaaagcuuaccaugaaccgaugcugggcacucuuccuaucccucugcugcuaccuacgccuagucucagccgaaggcgaccccauccccgaagaacucuacgaaaugcucagcgaccacuccauccgaagcuucgacgaccuucaacgccuacuccacggcgaccccggcgaagaagacggagccgaacucgaccuaaacaugacccgcucccacuccggcggagaacucgaaucacucgcacgcggacgcagaucccucggcucccucaccaucgccgaaccagccaugauagcagaaugcaaaacccgaacagaagucuucgaaaucucacgccgccucauagaccgaaccaacgccaacuuccucgucuggcccccaugcgucgaaguccaaagaugcuccggcugcugcaacaaccgcaacguccaaugccgcccaacccaaguccaacuccgcccaguccaaguacgcaaaaucgaaaucguacgcaaaaaaccaaucuucaaaaaagccaccgucacccuagaagaccaccucgccugcaaaugcgaaaccguagccgcagcccgacccguaacacgcucucccggcggcagccaagaacaacgagcaaaaacaccccaaacacgcgucacaaucaggaccguccgcguccgcagacccccaaaaggcaaacaccgcaaauucaaacacacccacgacaaaaccgcacucaaagaaacccuaggcgcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2204 - RNA, 1255 nt, Artificial Sequence
  mRNA product Design1 comprising derived and/or modified sequence from Homo sapiens__NP_057289.1__HsPDGFC (opt8)
gggagaaagcuuaccaugucccucuucggccuccuccuccucaccucagcccuagcaggccaacgccaaggcacccaagccgaauccaaccucuccuccaaauuccaauucucauccaacaaagaacaaaacggcguacaagacccgcaacaugaacgcauaaucaccguauccaccaacggcagcauccacuccccaagguucccccauaccuacccccgcaacaccguccuagucuggcgccuugucgccgucgaagaaaacgucuggauccaacugacauucgacgaacgcuucggccucgaagaccccgaagacgacaucugcaaauacgauuucgucgaaguagaagaaccuuccgauggcaccauccucggccgcuggugcggaagcggcaccguccccggcaaacaaaucucaaaaggcaaccaaauacgcauccgauucgucuccgacgaauacuucccaucagaacccggauucugcauacacuacaacaucgucaugccacaauucaccgaagccgucucacccuccguccuaccccccucagcccucccccucgaccuacucaacaacgccauaacagccuuuuccacccucgaagaccucauccgauaccucgaaccagaacgauggcagcucgaccuagaagaccucuaccgccccaccuggcaacucuuaggcaaagccuucgucuucggccgcaaaucgcgcguaguugaccuuaaccuccuaaccgaagaaguacgccucuacagcugcaccccacgcaacuucuccguaucaauccgcgaagaacucaaacguaccgacaccauauucuggcccggaugccuccuagucaaaagaugcggcggaaacugcgccugcugccuccauaacugcaacgaaugccaaugcguacccuccaaaguaaccaaaaaauaccacgaaguccuucaacuccgcccaaaaacaggcguacguggccuccauaaaucacuuaccgacgucgcccucgaacaccacgaagaaugugacugcgucugucgcggauccaccggaggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2205 - RNA, 1312 nt, Artificial Sequence
  mRNA product Design1 comprising derived and/or modified sequence from Homo sapiens__NP_149126.1__HsPDGFD (opt8)
gggagaaagcuuaccaugcaccgccucaucuucgucuacacccuaaucugcgccaauuucugcucaugccgcgacaccucugccacaccgcaaagcgcuucaaucaaagcacuccggaacgccaaccugcgacgagacgaccucuaccgccgcgacgaaaccauccaagucaaaggaaacggcuacguacaaagcccccgauucccaaacuccuacccccgcaaccuccuacucaccuggagacuacacucccaagaaaacacccgaauacaacucguauucgacaaccaauucggacuagaagaagcugaaaacgacaucugccgauacgacuucguagaagucgaagacauaagcgaaacauccacaaucaucagaggccgcuggugcggccacaaagaaguaccaccccgcaucaaaucccgcacaaaccaaaucaagauaaccuucaaaucagacgacuacuucgucgccaaacccggauucaaaaucuacuacucccuccuagaagacuuccaacccgccgccgccuccgaaacaaacugggaaucagucaccucaagcaucucagguguaucauacaacucccccuccgucaccgaccccacacucauagcagacgcccucgacaagaaaauagcugaauuugacaccgucgaagaccuccucaaauacuucaaccccgaauccuggcaagaagaccucgaaaacauguaccuggauacaccacgcuacagaggccgaucauaccacgaccgaaaaaguaaagucgaccuugaccgccucaacgacgacgccaaacgcuauagcugcaccccucgaaacuacuccgucaacauccgagaagaacuaaaacucgcaaacgucguauucuucccacguugccuccuuguccagcgaugcggaggcaacugcggcugcggcaccgucaacuggcggagcugcacaugcaacuccggcaaaaccguaaagaaauaccacgaaguacuccaauucgaaccaggucacaucaaacgucgcggcagagcuaaaaccauggcauuagucgacauacaacuagaccaccacgaacgaugcgacugcaucugcagcucacgacccccacgcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2206 - RNA, 895 nt, Artificial Sequence
  mRNA product Design1 comprising derived and/or modified sequence from Homo sapiens__NP_003946.3__HsSOCS3 (opt8)
gggagaaagcuuaccauggucacacacuccaaauuccccgccgccggcaugucccgacccuuagacaccuccuuacgccuaaaaaccuucuccuccaaauccgaauaccaacucguagucaacgcaguacgcaaacuccaagaauccggauucuacuggucagccguaaccggcggcgaagccaaccuccuccuauccgccgaaccagccggcaccuuccuaauucgcgacucauccgaccaacgccacuucuucacccucuccgucaaaacccaauccggcacaaaaaaccuccgcauccaaugcgaaggcggaucauucuccuuacaauccgacccccgcuccacccaaccagucccccgauucgacugcguacucaaacucguccaccacuacaugccaccccccggcgcccccuccuucccuucaccccccaccgaacccuccuccgaagucccugaacaacccucagcccaacccuuacccggcucccccccacgccgcgcauacuacaucuacucaggcggcgaaaaaaucccacucguccucucccgcccccucuccuccaauguagccacacuccaacaccucugccgcaaaaccgucaacggccaccuagacuccuacgaaaaaguaacccaacuccccggacccauacgcgaauuccuagaccaauacgacgccccacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2207 - RNA, 700 nt, Artificial Sequence
  mRNA product Design1 comprising derived and/or modified sequence from Homo sapiens__NP_003227.1__HsTGFA (opt8)
gggagaaagcuuaccaugguccccuccgccggccaacucgcccucuucgcccucggcauaguacucgcagccugccaagcccuagaaaacucuaccuccccccucuccgccgaccccccaguagcagccgccgucgucucacacuucaaugacugcccagacucccacacccaauucugcuuccacggcaccugccgcuuccucguacaagaagacaaacccgccugcguaugccauuccggauaugucggcgcccgcugcgaacacgccgaccuccuagcaguagucgcagcaucacaaaaaaaacaagcaaucacagcacuugucgucgucucaaucgucgcccucgccguacuaaucaucaccugcguccucauccacugcugccaaguccgaaaacacugcgaauggugccgagcacucaucugccgccacgaaaaacccucagcccuacucaaaggccgaaccgcaugcugccacuccgaaacagucgucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2208 - RNA, 1390 nt, Artificial Sequence
  mRNA product Design1 comprising derived and/or modified sequence from Homo sapiens__NP_000651.3__HsTGFB1 (opt8)
gggagaaagcuuaccaugccuccauccggccuacgacuacuccccuuacuccuaccccuccuauggcuccuaguccuaacacccggccgccccgcagccggccuaucgaccugcaaaaccaucgacauggaacucgucaaacgcaaacgcaucgaagccauucgaggacaaauccuauccaaacucagacucgccucaccucccucccagggcgaaguaccacccggcccccuucccgaagcaguccucgcccucuacaacucaacaagagaccgcgucgccggcgaauccgccgaacccgaacccgaacccgaagccgacuacuacgccaaagaaguuacccgagugcuaauggucgaaacccacaacgaaaucuacgacaaauucaagcagucaacacacucaauauacauguucuuuaauaccucagaacuccgcgaagcaguaccugaacccguccuccuaucccgcgccgaacuccgacuucucagacucaaacuuaaggucgaacaacacgucgaacucuaccaaaaauacuccaauaauucauggcgcuaccucuccaaucgacuccuugcccccuccgacucacccgaauggcucuccuucgacgucaccggagucguacgccaguggcucucccgcggcggcgaaaucgaaggcuuccgccucuccgcacacugcuccugugacucccgcgacaauacccuacaagucgacaucaacggcuucaccaccggccgacgcggcgaucucgccaccauccacggcaugaaccgcccauuccuccuccuaauggccacaccccucgaacgugcccaacaucugcaaucaucccgccaccgacgugcccucgacaccaacuacugcuucuccucaaccgagaaaaauugcugcguacgacaacuauacaucgacuuccgcaaagaccucggauggaaguggauccacgaacccaaaggauaccacgccaacuucugccucggccccugccccuacaucuggucccucgacacacaauacuccaaaguucucgcccucuacaaccaacacaaucccggcgcaucagcagcccccugcugcgucccccaagcccuagaaccccucccaaucgucuacuacgucggccgaaaaccaaaagucgaacaauuauccaacaugaucguccgcagcugcaaaugcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2209 - RNA, 1462 nt, Artificial Sequence
  mRNA product Design1 comprising derived and/or modified sequence from Homo sapiens__NP_003229.1__HsTGFB2 (opt8)
gggagaaagcuuaccaugcacuacugcguacucuccgcauuccucauacuccaccucgucaccgucgccuuaucuuuauccacaugcucaacccucgacauggaccaauucaugcgcaaacgcaucgaagccauccgaggacaaaucuuaucaaaacucaaacuaaccuccccacccgaagacuaccccgaaccagaagaagucccacccgaagucauuuccauuuacaacuccacacgcgaccugcuacaagaaaaagccucccgccgcgccgccgcaugcgaacgcgaacgcucagacgaagaauacuacgccaaagaagucuacaaaaucgacaugccacccuucuuccccuccgaaaacgccaucccacccaccuucuacagacccuacuuccguaucguccgcuuugacgucagcgcaauggagaaaaacgccaguaaccuugucaaagccgaguuccgaguauuccgccuacaaaacccaaaagcccgcgucccagaacaacgcaucgaacucuaccaaauccuaaaauccaaagaccuaacuucucccacccaacgauacauagacucaaaaguugucaagacccgcgcagaaggugaauggcucagcuucgacguaacugacgccguccacgaauggcuacaccauaaagaccgaaaccuaggcuucaaaauaagccuccacugcccaugcugcacauucguccccucgaacaacuauaucaucccgaacaaaucagaggaacuggaagcccgcuucgccggaaucgacggaaccuccaccuacaccuccggcgaccagaaaaccauuaaaucaacccgcaaaaagaacagcggaaaaaccccacaccuccuacucaugcuacuaccauccuaccgacuagaaucacaacaaaccaaccgcagaaagaaacgcgcccucgaugccgccuacugcuucaggaacguccaagacaacugcugccuacgcccccuauacaucgacuucaaacgcgaccucggauggaaauggauccacgaaccuaaaggcuacaacgcaaacuucugcgccggagcaugccccuaccucuggagcuccgacacacaacacucucgcguccucucccuauacaacaccaucaaccccgaagccuccgccucacccugcugcgucucccaagaccucgaaccccucacaauacuauacuacaucggcaaaacccccaaaaucgaacaacuguccaacaugaucgucaaauccugcaaaugcagcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2210 - RNA, 1456 nt, Artificial Sequence
  mRNA product Design1 comprising derived and/or modified sequence from Homo sapiens__NP_003230.1__HsTGFB3 (opt8)
gggagaaagcuuaccaugaagaugcaccuccaacgcgcccucguaguccucgcccuccucaacuucgccacagucagccucucccuaucaaccugcaccacccuagacuucggccacaucaaaaagaaaagagucgaagccauccgcggccaaauccucuccaaacuccgucucaccagcccacccgaacccaccgucaugacccacgucccauaccaaguccucgcccuauacaacuccacgcgcgaacuacuagaagaaaugcacggagaaagagaagaaggaugcacccaagaaaacacagaaucagaauacuacgcaaaagaaauccacaaauucgacaugauccaaggacucgccgaacacaacgaacucgccgugugccccaaaggcaucaccucuaaagucuuccgauucaacgucuccucaguagagaaaaaccgcaccaaccucuucagagccgaguuccgaguccucagaguccccaaccccucuucaaaacgcaacgaacaacgcauugaacuguuccaaauccuacgaccagacgaacacaucgcuaaacaacgauacauaggaggcaaaaaccugcccacccgaggaacagcagaauggcucuccuucgacgucaccgacaccguccgcgaauggcucuuacgccgagaauccaaccuuggacuagaaaucuccauacacugccccugccacaccuuccagcccaacggagacauacucgaaaacauccacgaagucauggaaaucaaauucaaaggaguagauaacgaagacgaccacggacgcggcgaccucggccgacucaagaaacaaaaagaccaccacaacccgcaccucauacugaugaugaucccaccccaucgccucgauaaccccggccagggcggccaacggaagaaacgagcacucgacaccaacuauugcuucagaaaccucgaagaaaacugcugcgucagaccccucuacaucgacuuccgccaagaccuaggcuggaaauggguacacgaaccaaaaggcuacuacgccaacuucugcagcggacccugcccauaccuccgaucggcagacaccacccacucaaccguccucggccucuacaacacccuuaaccccgaagcauccgcaucccccugcugcguaccgcaagaccuagaaccccucaccauacuauacuacgucggccgaaccccaaaagucgaacaauuauccaacauggucgucaaauccugcaaaugcagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2211 - RNA, 1603 nt, Artificial Sequence
  mRNA product Design1 comprising derived and/or modified sequence from Homo sapiens__NP_001057.1__HsTNFRSF1B (opt8)
gggagaaagcuuaccauggcaccaguagccgucugggccgccuuggccguuggccuagaacucugggccgcagcccacgcccugccagcccaagucgcauucaccccuuacgcccccgaacccggcagcacaugccgacuccgcgaauacuacgaccaaacggcacagaugugcugcucuaaaugcagcccaggccaacacgcaaaagucuucuguacaaaaaccagcgacaccguaugcgacuccugcgaagacuccacuuauacccaacucuggaacuggguccccgaaugccucucuugcggcagccgcugcucauccgaucaagucgaaacccaagccuguacccgcgaacaaaacagaaucuguaccugcagacccggcugguacugcgcccucuccaaacaagaaggaugccgacuaugcgccccucuccgcaaaugccgcccaggauucggcguagcacgccccggcaccgaaaccucagacgucgucugcaaaccuugugcgcccggaacauucagcaacaccaccucauccaccgacaucugcagaccccaucaaauaugcaacgucgucgcuauccccggaaacgcaucaauggacgcugucugcaccucaaccucucccaccagauccauggcaccaggggccguccaccuaccccaacccgucuccacucgaucccaacacacccaacccacaccagaaccguccaccgccccauccaccuccuuccuccuccccaugggcccauccccgcccgccgaagguucuaccggagacuucgcccuucccgucggccuuaucgucggugucaccgcacucggacuccucaucauaggcgucgucaacugcgucaucaugacacaaguaaagaagaaaccacuuugccuacaacgagaagccaaaguaccccaccuccccgcagacaaagcccguggcacccaaggacccgagcaacaacaccuccuaauaaccgcccccucauccuccuccucaucacucgaaucauccgccucagcacucgaccgcagagcgcccacccgcaaccaaccacaagcccccgguguagaagccuccggcgcuggcgaagcccgcgccuccacaggaucuuccgacucuucacccggcggccacggcacccaagucaacguaaccugcauagucaacguaugcuccuccuccgaccacuccucacaaugcaguucccaagcaucaucaacaaugggagacacagacuccucccccuccgaauccccaaaagacgaacaagucccauuuucaaaagaagaaugugccuucagaucccaacucgaaacaccagaaacccuacuuggcuccacagaagaaaaaccccucccccuaggcguucccgacgcuggcaugaaaccauccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2212 - RNA, 730 nt, Artificial Sequence
  mRNA product Design1 comprising derived and/or modified sequence from Homo sapiens__NP_002623.2__HsPGF (opt8)
gggagaaagcuuaccaugccggucaugagauuguucccgugcuuucuccagcuauuggccggguuagcacuaccggcagugcccccacaacagugggcgcucucggccgggaacgggagcucggaaguggaagugguaccauuccaggaagugugggggcgcucguacugucgagcgcucgagcgauugguagaugucgugagcgaguacccaagcgagguagagcacauguucucacccucaugcgugagcuugcucaggugcacgggcuguugcggggacgagaacuugcacugugucccgguagagaccgcgaacgugaccaugcaacugcucaagaucagaagcggggacaggcccucguacguggaauugaccuuuagccagcacgugcgcugugaaugucgcccgcucagagaaaagaugaagcccgagcgcagacgaccgaaagggcgcgggaaaaggcgcagggaaaagcaaaggcccacggacugucacuugugcggggacgcggucccgcgcagguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2213 - RNA, 1456 nt, Artificial Sequence
  mRNA product Design1 comprising derived and/or modified sequence from Homo sapiens__NP_001020537.2__HsVEGFA (opt8)
gggagaaagcuuaccaugaccgaccgccagaccgacaccgcgcccucgccaucauaccaucucuugcccggacgcaggagaacagucgaugccgcggcaucgcgagggcaaggaccagagcccgcaccaggaggaggggucgaggggguaggagcgcgcggaguagcgcucaaacuguucguacaacugcuaggcugcaguagguucgggggagcggucguacgcgcgggggaggccgaaccaagcggcgcggccagaagcgcaagcagcggcagggaagaaccacagcccgaggaaggagaagaggaagaggaaaaagaagaggaaaggggcccacaguggcgacugggagcgcgcaagcccgggagcuggaccggagaagcggcagugugcgcggacucggccccggcagcacgcgcgccacaggcccuggccagagccucaggcaggggcgggcgcguggccaggcgcggggcagaagaaucaggaccgccccacagcccaagcaggcgagggagcgcaaguagggccgggcccggccgcgcgagcgaaaccaugaacuuccuccugagcuggguccacuggucgcucgcgcuauugcucuaccuccaccacgcgaaauggagccaggccgcgcccauggcagaaggaggcgggcagaaccaccacgagguagugaaauucauggacguauaccaaaggagcuacugccaccccauagaaacgcuuguggacauauuccaagaauaccccgacgaaaucgaauacauauucaaaccgagcugcgucccacucaugcgcugcggagggugcugcaacgacgaagggcucgaaugcgugcccacggaagagagcaauaucacgaugcaaaucaugcgcauaaaaccgcaccaggggcaacacauaggggagaugucguuccuacaacacaacaaaugcgaaugccgacccaagaaagaucgagcacgccaggaaaagaaaucagucaggggcaaaggaaagggccagaaaagaaaaagaaagaaaagccgguacaaaagcuggagcguauacgugggcgcgcgaugcugccuaaugccguggagccuaccgggaccgcacccaugcggacccugcagcgagagaagaaaacaccuauucguacaggacccgcagacaugcaaaugcucgugcaagaacacagauucgcgaugcaaagcacgacagcucgagcucaaugaaaggacaugcagaugugacaaaccccgacgcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2214 - RNA, 916 nt, Artificial Sequence
  mRNA product Design1 comprising derived and/or modified sequence from Homo sapiens__NP_001165094.1__HsVEGFA (opt8)
gggagaaagcuuaccaugaacuuccuccucuccuggguccacuggucccuagcccuccuacuauaccuccaccacgccaaauggagccaagccgcccccauggccgagggcggcggacaaaaccaccacgaagucguaaaauucauggacguauaccaacgaagcuacugccaccccaucgaaacccucguagacauauuccaagaauaccccgacgaaaucgaauacaucuucaaaccaagcugcguaccccuaaugcgaugcggcggcugcugcaacgacgaaggccucgaaugcguacccaccgaagaaagcaacaucacaaugcaaaucaugagaaucaaaccccaccaaggccaacacauaggcgaaauguccuuccuccaacacaacaagugcgaaugccgccccaaaaaagaccgcgcccgccaagaaaagaaauccguccguggaaaaggcaaaggccaaaaacgaaaacgaaaaaaaagccgcuacaaauccuggagcgucuacguaggcgcccgaugcugccuaaugccauggucccuccccggcccccaccccugcggccccugcuccgaacgccgaaaacaccucuucguccaagacccacaaaccugcaaaugcuccugcaaaaacacagacucacgcugcaaagcaagacaacucgaacuaaacgaacgcaccugccgcugugacaaaccacgacgauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2215 - RNA, 841 nt, Artificial Sequence
  mRNA product Design1 comprising derived and/or modified sequence from Homo sapiens__NP_003368.1__HsVEGFB (opt8)
gggagaaagcuuaccaugucaccacuacuccgccgacuacuccucgccgcccuccuccaacucgcccccgcccaagcccccgucagccaacccgacgccccaggccaccaacgcaaagucgucuccuggaucgacguuuacacucgcgcaacaugccaaccccgcgaaguagucgucccacucaccgucgaacuaaugggcaccgucgccaaacaacucguccccucaugcgucaccguccaacgcugcggaggaugcugccccgacgacggccuagaaugcgucccaaccggccaacaccaaguacgcaugcaaauacucaugauccgauaccccucaucccaacuaggcgagaugucccucgaagaacacucccaaugcgaaugccgacccaaaaaaaaagacuccgccgucaaacccgaccgagccgccacaccccaccaccgcccacaaccccgcuccgucccaggcugggacucagcccccggcgcaccaucacccgccgacaucacccaccccacacccgcacccggccccuccgcccacgccgcccccucaaccaccuccgcacuaacccccggccccgccgccgccgccgccgacgccgccgcaucaucaguagcaaaaggcggagcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2216 - RNA, 1477 nt, Artificial Sequence
  mRNA product Design1 comprising derived and/or modified sequence from Homo sapiens__NP_005420.1__HsVEGFC (opt8)
gggagaaagcuuaccaugcaccuccucggauucuucucaguagccugcucccuucuggccgcagcccuccuccccggcccgcgcgaagcccccgccgccgccgcagccuucgaauccggccuagaccugagcgacgccgagcccgacgcaggagaagccaccgccuaugccuccaaagaccucgaagaacaauugcgcucggucucgucagucgacgaacucaugaccguccucuacccagaauacuggaaaauguauaaaugccaacuccgcaaagguggcuggcaacacaaccgggaacaagccaaccucaacagccgaacagaagaaacaaucaaauucgccgcagcccacuacaacacagaaauccucaaauccauagacaacgaauggcgcaaaacccaaugcaugccccgcgaagugugcaucgacguaggcaaagaguucggcgucgccacaaacacauucuucaaaccaccgugcgucuccgucuaccgcuguggcggaugcugcaacucggaaggacuacaaugcaugaacacguccaccuccuaccucuccaaaacccucuucgaaauaaccguaccacuaucccaggguccaaaacccguaacaauauccuucgcaaaccauacuuccugccgaugcauguccaaacuugacgucuacagacagguacacagcauaauccggcguucccuacccgcuacccuaccacaaugccaagcagccaauaaaaccuguccaacaaacuacauguggaacaaccacaucugucgcugccucgcccaagaagacuucauguucuccucagacgccggcgacgacucaacagacggcuuccacgacaucuguggcccaaacaaagaacuugaugaagaaacaugccaaugcgucugccgagccggacuccgacccgcaagcugcggcccccauaaagaacuagaccggaacucaugccaaugcguauguaaaaauaaacuauuccccucccaaugcggcgccaaccgggaguucgacgaaaauaccugccaaugcguaugcaaacgcacuugcccacgcaaccaaccccuaaaccccggcaaaugcgccugcgaaugcaccgaaucgccccaaaaaugccuacucaaaggcaagaaauuccaccaccaaaccugcuccuguuaccgccgacccugcaccaaccgccaaaaagccugcgaacccgguuucucauacucagaagaggucugccgaugcguccccagcuauuggaaacgcccacaaauguccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2217 - RNA, 1282 nt, Artificial Sequence
  mRNA product Design1 comprising derived and/or modified sequence from Homo sapiens__NP_004460.1__HsVEGFD (opt8)
gggagaaagcuuaccauguaccgugaaugggucgucgucaacguauucaugaugcuauacguucaacucguccaaggauccucaaaugaacacggcccagucaaacgcagcucccaauccacacucgaacgcuccgaacaacaaauccgcgccgccuccucccucgaagaacuacuucgcaucacccauucagaagacuggaaacuauggcgaugccgccuccgccucaaaucauuuaccucaauggacagccgcucagccucccaccgcuccacacgcuucgcggccacuuuuuacgacauagaaaccuuaaaagucauagaugaagaauggcaacgcacacaaugcucccccagagaaaccugcgucgaagucgccuccgaacucggcaaaucaaccaacaccuucuucaaacccccaugcgucaacguauuccguugcggaggcugcugcaacgaggaaucauuaaucugcaugaacacaagcacauccuacaucuccaaacaacucuucgaaaucucuguaccccucaccuccguccccgaauuaguaccugucaaagucgcaaaccacacaggaugcaagugccucccuaccgcaccccgccaccccuacuccauaauccggcgauccauccaaauccccgaagaagaccgaugcucacacucaaagaaacucugccccaucgacaugcucugggacuccaacaaaugcaaaugcguccuccaagaagaaaacccccuagccggcaccgaggaccacucccaccuacaagaaccagcccucugcggcccccacaugauguucgacgaagaccgaugcgaaugcgucugcaaaacccccugccccaaagaccucauccaacaccccaaaaacugcuccugcuucgaaugcaaagaaucccuagaaaccugcugccaaaaacacaaacuauuccacccagauaccugcucaugcgaagaccgcugccccuuccacacacgccccugcgccuccggcaaaaccgccugcgccaaacacugccgauuccccaaagaaaaacgcgccgcccaaggaccccacucccgcaaaaaccccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2218 - RNA, 847 nt, Artificial Sequence
  mRNA product Design1 comprising derived and/or modified sequence from Homo sapiens__NP_061986.1__HsFGF21 (opt9)
gggagaaagcuuaccauggacuccgacgaaaccggcuucgaacacuccggccucugggucuccguccucgccggccuccuccuaggcgccugccaagcacaccccauacccgauucuuccccacuacuccaauucggcggccaaguccgccaacgcuaccucuacacagacgacgcccaacaaacagaagcccaccuagaaauccgagaagacggcacagucggaggcgccgccgaccaaucacccgaaucccuccuacaacuaaaagcccucaaacccggcgucauccaaauccucggcgucaaaaccagccgauuccucugccaacgccccgacggcgcccucuacggaucccuacacuucgacccagaagccugcuccuuccgcgaacuccuccuagaagacggcuacaacgucuaccaaucagaagcccacggccucccccuccaccuccccggcaacaaaucaccacaccgcgacccagccccacgcggccccgcccgcuuccuuccccuccccggccucccacccgcacuccccgaacccccaggcauccucgcaccccaacccccagacgucggcuccucagacccccucuccauggucggccccucucaaggcagauccccauccuacgccuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2219 - RNA, 1627 nt, Artificial Sequence
  mRNA product Design1 comprising derived and/or modified sequence from Homo sapiens__NP_002412.1__HsMMP1 (opt9)
gggagaaagcuuaccaugcacuccuucccuccccuccuacuacuccucuucuggggcguugucucccacuccuuccccgcgacccuagaaacacaggaacaagacguugaccucguccaaaaauaccuagaaaaauacuacaaccucaaaaacgacggacgccaaguagaaaaacgacgcaacuccggccccgucgucgaaaaacucaaacagaugcaagaguucuucggccucaaggucaccggcaaacccgacgccgaaacacuaaaaguaaugaaacaaccccgcugcggcguacccgacgucgcccaauucguacucaccgaagguaacccacgcugggaacaaacccaccucacuuaccggaucgaaaacuacacccccgaccucccccgcgccgacgucgaccaugccaucgaaaaagccuuccaacucuggucaaacgucacaccccucaccuucaccaaagucucugaaggccaagcagacaucaugauaucauucguacgaggcgaccaccgagacaacucccccuucgacggcccgggaggcaaccuggcacacgccuuccaaccagguccaggaaucggcggcgacgcacacuuugacgaggacgagcgauggaccaacaacuuccgagaauacaaccuccaccgcgucgcagcccacgagcucggccacucacugggacucucacacuccaccgauaucggagcacucauguaucccucuuacacuuucuccggcgacguacaacuagcccaagacgacauagacggaauccaagcaaucuacggacgcucccagaaccccguccagcccaucggaccucaaacaccaaaagccugcgacuccaaacuaacauucgacgccaucacaaccauacgaggcgaagucauguucuucaaagacagauucuacaugcgcacaaacccuuucuaucccgaagucgagcucaacuucaucuccgucuucuggccccaacuccccaacggccuugaagcagccuacgaguucgccgaccgcgacgaaguccgauucuucaaaggaaacaaauacugggccguccaaggccaaaacguccuacauggcuaccccaaagacauauacuccuccuucggcuucccaagaaccgucaaacacaucgacgcagcacucuccgaggaaaacaccggaaaaaccuacuucuucgucgcaaacaaauacuggcgcuacgacgaauacaagcgcucaauggaccccggcuauccaaaaaugaucgcacacgacuuccccggcaucggucacaaagucgaugcuguuuucaugaaagacggcuucuucuacuucuuccacggaacccgccaauacaaauuugacccaaaaaccaaacgcauccucacacuacaaaaagccaacagcugguucaacugccgcaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2220 - RNA, 1387 nt, Artificial Sequence
  mRNA product Design1 comprising derived and/or modified sequence from Homo sapiens__NP_002412.1__HsMMP1(1-19,100-469) (opt9)
gggagaaagcuuaccaugcacuccuucccaccccuacuccuccuacucuucuggggcguagucucccacucauucguacucaccgaaggcaacccccgaugggaacaaacccaccucaccuaccgcauagaaaacuacacccccgaccucccccgcgccgacguagaccacgccaucgaaaaagccuuccaacucugguccaacguaacaccccucaccuucaccaaagucuccgaaggccaagcagacauaaugauaucauucguccgcggcgaccaccgagacaacucacccuucgacggccccggcggcaacuuagcccacgccuuccagcccggcccaggcauaggcggagacgcacacuucgaugaagacgaacgcuggaccaacaacuuccgcgaauacaaccuccaccgcgucgcagcccacgaacucggccacucccuuggacucucacacuccaccgacaucggagcccuaauguacccaucauacacauucucaggcgacguacaacucgcccaagacgacaucgacggcauacaagcaaucuauggccgcucacagaacccaguacaaccaaucggcccccaaacccccaaagccugcgacuccaaacucaccuucgacgcaauaaccacaauucgaggagaagucauguucuucaaagaccgauucuacaugcgcaccaaccccuucuaccccgaaguagaacucaacuucauauccgucuucuggccucaacuacccaacggccucgaagcagcauacgaguucgccgaccgagacgaaguccgauucuucaaaggcaacaaauacugggccguccaaggccaaaacguccuacacggcuacccaaaagacaucuacucuuccuucggcuucccacgaacaguaaaacacauagacgcagcucucucagaagaaaacaccggcaaaacuuacuucuucguagcaaacaaauacuggcgcuacgacgaauacaaacgcucuauggaccccggauaccccaaaaugauagcucacgacuuccccggcauaggucacaaagucgacgcaguauucaugaaagacggcuucuucuacuucuuccacggcacccgccaauacaaauuugaccccaaaaccaaacgcauccucacccuucaaaaagccaacuccugguuuaacugucgcaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2221 - RNA, 3574 nt, Artificial Sequence
  mRNA product Design1 comprising derived and/or modified sequence from Clostridium histolyticum__BAA77453.1__ColG (opt9)
gggagaaagcuuaccaugaaaaagaacauccuaaagauacucauggacagcuacagcaaagaaucgaaaauccaaaccguucgucgaguaaccuccguaagccuccuagccguauaucugaccaugaacacgagcagccucguacuagccaaacccauagaaaacaccaacgauaccucaaucaaaaacguagaaaaacugaggaacgcacccaaugaagaaaacucaaagaaaguugaagacagcaaaaaugacaaggucgaacacgucaaaaacaucgaagaagcaaaaguagagcaaguagcccccgagguaaaaagcaaaagcacgcucagaucagcaagcauugccaacacaaacagcgaaaaauacgacuucgaauaccuaaacggucuaagcuauaccgaacugacgaacuuaauaaagaacaucaaauggaaccaaauaaacggccuauucaacuacuccacaggcagccaaaaauucuucggggacaaaaacagaguacaggcaauaaucaacgcgcuccaggaauccggccguaccuacacggcgaacgacaugaaggggaucgaaacauucaccgaaguacuccgugccggcuucuaccuuggguauuacaaugacggacucagcuaccucaacgaccgcaacuuucaggacaagugcauccccgcaaugaucgcaauccaaaagaacccuaauuucaaauuaggaacagccguacaggacgagguaaucacgagccugggcaaauuaaucggcaacgccucugcgaacgcagaggucgucaacaacugugugccaguccucaagcaguuccgggagaaccugaaucaauacgcacccgacuacguaaagggcacugccgucaacgaacucauaaaaggcauagaguucgacuucucaggcgccgccuacgaaaaagacguuaaaacgaugcccugguacggaaaaauagaccccuucauaaacgaauuaaaagccuuaggccucuacggcaacaucaccagcgcaacggaaugggccucagacguagguaucuacuaucuuuccaaauucggauuauacagcaccaaccgcaacgacauaguacaaucccuagagaaagccgucgauauguacaaauacggaaaaauagcguucguagccauggaacgaaucaccugggacuacgacggcaucggcucaaacggcaagaaagucgaccacgacaaauuccuggacgacgccgaaaaacacuaucuccccaaaaccuacacauucgacaacgggacguucauaauccgcgcgggcgacaaaguauccgaagagaaaaucaaacgccuauacugggccuccagagaaguuaaaagccaauuucaccgggugguggggaacgacaaagcccuagaagucggaaacgccgaugacguccucacaaugaaaaucuucaauagucccgaagaauacaaauucaacaccaacauaaacggcguuagcaccgacaaugggggccuguacaucgaaccccggggcacauucuacaccuacgaaagaacgccucaacaaucuaucuucagucuggaggaguuguuccgccacgaauacacccacuaccuacaagcacguuaccucgucgacggccuauggggccagggacccuuuuacgaaaagaacaggcuaaccugguucgacgagggcacagccgaguucuucgccgggagcacccgcacauccggaguacugcccaggaaaagcauccucggcuaccuugccaaagauaaaguugaccaucgcuacucacugaagaagacccuuaacagcggauaugacgauagcgacuggauguucuacaacuauggguucgcgguagcacacuaccuauaugaaaaagacaugcccacuuucaucaaaaugaauaaggcaauccucaacaccgacgucaaauccuacgacgaaaucauuaagaaacugagcgacgacgcaaacaagaacaccgaguaccagaaccacauccaggagcuagccgacaaguaccagggggcaggaaucccccuaguaucagacgacuaccucaaagaucacggcuacaagaaagcgagcgaaguauacuccgaaauaucgaaggcagcaagccucacgaacacaagcgugacagccgaaaaaucacaauacuucaacaccuucacucuccgggguaccuacacaggcgagaccuccaagggagaauuuaaagacugggacgaaaugagcaaaaagcucgacggcacccucgaaucacucgccaaaaacuccugguccggcuacaagacauuaacugcauacuucacuaauuaccgcgucaccagcgacaacaaaguccaauacgacgucguuuuccacgggguacuaaccgauaacgcagacaucuccaacaacaaagcaccuaucgcaaaagucacgggaccauccacuggggccguuggacgcaauauugaguucucagguaaagacagcaaagacgaggacggcaaaaucgucagcuacgacugggauuucggagacggcgcgacaucacgaggcaaaaacagcguccacgcauauaagaaagccggcaccuacaacguuacacuaaaggucacagacgacaaaggagcaacagcgacagagucauucacaauagagaucaaaaacgaggacacgacgacaccuaucacaaaagaaauggaaccgaacgacgacaucaaagaagccaacggcccaauagucgaaggaguaaccguuaaaggcgaccucaacggcucagaugacgccgauaccuucuacuucgacgucaaggaagacggggacguaacaauugaacuaccauacucagggucaagcaauuucacauggcucgucuacaaagaaggcgacgaucagaaccauauagcaucaggcauagacaaaaacaacucgaaagugggcaccuuuaaaagcacaaaaggccgccacuacguguucauauacaaacacgacagcgccucgaacaucucuuacucacuaaacaucaagggccuaggaaacgagaagcugaaagaaaaagaaaacaacgacucuucagauaaggccaccgucauucccaacuucaacacaacaaugcaaggcucgcugcucggcgacgacuccagagacuauuacuccuucgagguaaaagaagaaggagaagucaacaucgaauuggacaagaaagacgaguucggggugacauggacccuucacccggaauccaacauaaacgacaggauaaccuacgggcaaguagauggaaacaaagugucgaacaaagucaagcuccgacccggcaaauacuacuugcuagucuacaaauacagcggcucuggcaacuacgaacuacgaguaaacaaauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2222 - RNA, 3298 nt, Artificial Sequence
  mRNA product Design1 comprising derived and/or modified sequence from Clostridium histolyticum__BAA77453.1__HsALB(1-18)_ColG(111-1118) (opt9)
gggagaaagcuuaccaugaaaugggugacuuucauuucccugcuguuccucuucagcagcgccuacuccaucgcaaacacaaacagcgaaaaauacgacuucgaauaccugaacggacucaguuacaccgaacucacaaaccucaucaagaacaucaaguggaaccaaauaaacggccucuucaacuacucgaccggcucccaaaaguucuucggggauaagaaccgcguccaagccauuaucaacgcccuccaagaaagcgggcgcacauacaccgccaacgacaugaagggcauagaaacauuuacagaagugcuacgcgcgggcuucuaccucggcuauuacaacgacggacucagcuaccuaaacgaccgaaacuuccaggacaagugcauaccggcaaugauagccauccagaaaaaucccaacuuuaaacucggaacugccgugcaagacgaaguaaucaccucgcucggaaaacuaaucggcaacgccucagccaaugccgaaguagucaauaacugcguccccgucuuaaagcaauuccgagagaacuugaaccaauacgcaccagacuacgucaagggcaccgccguaaacgaguuaaucaaagggauagaguucgacuucucgggagccgcauaugaaaaagacgucaaaaccaugccaugguacggcaaaaucgaccccuucauaaacgaacucaaagcccuuggccuauacggcaacauaacaagcgcgacagaaugggccagcgacguaggcaucuacuaccuaucaaaguucggacucuacagcaccaaccggaacgacauaguccaaagccucgaaaaagcaguagacauguacaaauacggcaaaauagccuucgucgcaauggagcgcauaacaugggauuacgacgggaucggcaguaaugguaagaaaguagaccaugacaaguuccucgacgacgcagaaaaacacuaccuaccuaagacauacaccuucgacaacggaaccuucauaauccgcgcaggcgacaaaguuagugaggagaaaaucaaaagacuauacugggcaucaagagaagucaaaucacaauuccaccgcguagucggcaacgacaaagcccucgaaguggggaacgccgacgacguccuaacaaugaaaaucuucaacagccccgaagaauacaaauucaauacuaauauaaacggaguaagcacagacaacggcggccuauauaucgaaccccgcgggacuuucuauaccuacgaaaggacgccgcaacaauccauauucucacuagaagaacuauuccgccacgaauacacccacuaccuccaggcaagauaccuagucgacggccuauggggucagggcccauucuacgaaaagaaccgccuaaccugguucgacgagggaacagccgaauuuuucgccggauccacccgcacaagcggaguccugccccgcaaaucaauacucggguaccuagcgaaagacaaaguggaccaccgauacagccuaaagaaaacacucaacuccggauacgaugacagcgacuggauguucuacaacuacggauucgccgucgcacacuaccuauacgagaaagacaugcccacuuucaucaaaaugaacaaagcgauacucaacaccgacgucaaaagcuacgacgagaucaucaagaaacuguccgacgacgcaaauaaaaacaccgaauaccagaaccacauucaggaacucgccgacaaauaccaaggagccggcaucccacucgucagcgacgacuaccucaaagaccacggguacaaaaaggcguccgaaguauauucugagaucagcaaagccgcaucccugaccaacacaucagucacagcagagaaaucucaguacuucaacacauucacgcuccgggggaccuacacaggcgaaacuagcaaaggggaguucaaggacugggacgagaugagcaagaaacuggauggcacacucgagagucucgcgaaaaacuccuggucgggcuacaaaacgcuuacagcauauuucaccaacuaccgcgucaccucagacaacaaaguccaauacgacgucguguuccacggagugcucaccgacaacgccgacaucuccaacaacaaggcaccuaucgcaaaggugaccggccccucaacaggcgcgguuggacggaacaucgaguucuccgggaaagacaguaaggacgaggacggcaaaauaguaagcuacgacugggacuucggagacggggcgaccucccgaggcaagaacagcguccacgccuacaagaaagccggcacauacaacgugacacuuaaaguuaccgacgacaaaggagccaccgccacggaguccuuuaccaucgagaucaaaaacgaagacaccacaaccccaauaaccaaagaaauggaaccuaacgacgacauuaaggaggcaaacggcccaauaguagaaggaguuacggucaagggugaccucaacgguuccgaugacgcagacaccuucuacuucgacgucaaagaagacggggauguaaccaucgaacuacccuacuccggauccucaaauuucacuuggcuaguauacaaggagggcgacgaccaaaaccacauagccucggggauagacaaaaacaacucuaaaguaggaaccuuuaaguccacaaagggacggcacuacgucuuuaucuacaagcacgacuccgcuuccaacauaucguacucguuaaacaucaaaggacuaggaaacgaaaaacucaaagagaaagaaaacaacgacucaucggacaaagcgacaguaauaccaaacuucaacaccacgaugcagggcucccuauugggagaugacagccgagacuacuacucguuugaaguaaaagaggaaggcgaagucaacaucgaacuagauaagaaagacgaguucggaguuacguggacccuccaccccgagagcaacaucaaugaccgaauuaccuauggccaggucgacgguaacaaaguaucuaauaaagucaaacuccgcccaggcaaauacuaccuccucgucuacaaguacagcgguagcggcaacuacgaacuacgcgugaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2223 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt9)
gggagaaagcuuaccaugaagugggugacauucaucucccuacuguucuuauuuaguuccgccuauaguaugaaaaagaacauucucaaaauccucauggacagcuacagcaaagagagcaagauccagaccgugcgucgaguaaccagcgucagcuuacuagcgguauaccuaaccaugaacacauccagccuaguccuggcaaaacccaucgaaaacaccaaugacacuuccaucaagaacgucgagaagcuacgaaacgcaccaaacgaagagaauagcaagaaaguugaagauuccaaaaaugacaaaguagagcacgucaaaaacaucgaagaagcaaaagucgaacaaguagccccggaagucaaauccaagagcacgcuccgcuccgccaguagacggcgcaggaaacgcaucgcaaacacaaacuccgagaaauacgacuucgaauacuugaacggauuaagcuacacggagcuaaccaaccucaucaaaaauauaaaauggaaccaaauaaacggccuauucaacuauagcaccgggucccagaaauucuucggagauaagaaccgcguacaagcuaucaucaaugcccugcaggaauccggccgcacauacacggccaacgacaugaaagguauagaaacauucacagaagugcuaagggccggcuucuaccucggcuacuacaacgacgggcuaucauaccuaaaugacagaaauuuucaggacaaaugcauaccggcuaugaucgcgauacagaaaaacccgaacuucaagcuaggcacggccguacaagacgaagucaucaccuccuugggaaaacucauaggcaacgccuccgcgaacgccgaagucgucaacaacuguguacccguccuaaaacaguuuagagagaaccuaaaccaguacgcuccggacuacgucaaagggacagcagugaaugaacugauuaagggaauagaguucgacuucucaggcgcugccuacgaaaaggacgugaaaaccaugcccugguacggcaagaucgacccauucaucaacgaauuaaaagcacucggccuauauggcaacauaaccuccgccaccgaaugggcaucggacgucggaauauacuaccucaguaaauuuggacuguauagcaccaacagaaacgacaucguccaaagccucgagaaagcagucgacauguacaaauacggcaaaauagccuucguggcaauggaaaggaucacaugggacuacgacggcaucggguccaacggaaagaaaguagaccacgacaaauuucuugacgacgccgagaaacacuaccuaccaaaaacuuacaccuucgacaacggcaccuucauaaucagagcaggagacaaagucagcgaagagaaaaucaaacggcuuuacugggccucacgugaagugaaaagccaguuccaccgcgucgugggaaaugacaaggcauuggaaguagggaacgcggacgacguccuaacaaugaaaauauucaacagcccagaagaauacaaauucaacacuaacauaaauggagucuccaccgacaacggcggccucuacauagaaccaaggggcaccuuuuacacauacgaacgcacaccucagcaaagcauauuuucacuagaagaacucuuccgucacgaauacacccacuaccuccaggcuagauaccucguugacggacuguggggccagggccccuuuuaugagaaaaaccgccucacgugguucgacgaaggcacagccgaguucuucgccggcagcacacgaaccagcggcguacuaccacgaaaaucgauccucggcuaccuggcaaaagacaaagucgaucauagguacagccucaaaaagacacuaaacagcggauaugacgacucugacuggauguuuuacaacuacggguucgccgucgcacacuaccucuacgaaaaggacaugcccacauucaucaaaaugaacaaggcgauccuaaacacugacguaaaaagcuacgacgaaauaauaaagaagcuaagcgacgaugccaacaagaacacagaguaccaaaaccacauucaggaacuugccgacaaauaccagggagccggaaucccgcucguauccgacgacuaccuaaaagaccacggauacaaaaaggcauccgaagucuacagcgaaauaagcaaggccgcgucacuaacaaacacgucagucaccgcagagaaaucccaauacuucaacaccuuuacacugagagggacauacaccggcgaaaccucaaaaggagaguucaaagacugggacgaaauguccaagaaacuagacggaacacucgaaucgcuagcuaaaaacuccuggagcggauacaaaacccucacggcuuauuucaccaacuaccgcgucacgagcgacaacaagguacaauaugacguugucuuccacggcguccucacggacaacgccgacaucucaaacaauaaggcccccauagcaaaaguaacaggaccauccaccggcgcagucggccgaaacauagaguucucaggcaaagauuccaaagacgaagacgggaaaaucguuaguuacgauugggacuucggcgacggcgccaccucgcgagguaagaacuccgugcacgcauacaaaaaggccggaaccuacaacguuacccuaaaggugacagacgacaaaggagcgacggcgacagaaucuuucacaaucgaaaucaaaaacgaagacacuacaacacccaucacgaaagaaauggagcccaacgacgacaucaaggaagcaaacgggccgaucguugaaggaguaaccgucaaaggagaccucaacgggagcgacgacgcagacaccuucuacuucgaugucaaagaggacggggacguaacaaucgagcuccccuacucaggaagcagcaacuucacauggcuaguguacaaggagggcgacgaccagaaccacauagcguccggcaucgacaaaaacaacucaaaaguaggcaccuucaaaaguaccaaaggccgccacuacguuuucaucuacaagcacgacuccgccuccaacauaagcuacucgcuaaacaucaagggcuuaggcaacgaaaaacugaaagaaaaagaaaacaacgacucaucugacaaggccaccguaauacccaauuucaacacaaccaugcagggcucacugcucggagacgacucacgagauuacuacuccuuugaaguaaaagaagaaggcgaaguaaacaucgaauuggauaagaaagacgaguucggcgugacguggacacuucacccagaaucaaacaucaacgacaggauaaccuaugggcaaguagacggcaacaaaguaucuaacaaggucaagcuccgccccggcaaguacuaccugcucgucuacaaauacagcggaucuggaaacuaugaacuccgcguaaacaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2224 - RNA, 3322 nt, Artificial Sequence
  mRNA product Design1 comprising derived and/or modified sequence from Clostridium histolyticum__BAA34542.1__ColH (opt9)
gggagaaagcuuaccaugaacuuccucaaaaucauacugaaccgcggaaaaaccaugaagagaaagugccuauccaaaagguuaaugcucgccauaaccauggccacgauauucacagugaacucgacccucccgauuuacgccgccguagacaaaaacaacgcgaccgccgcgguacagaacgaguccaaacgguacacgguauccuaucucaagacccucaacuacuacgacuuggucgaccuucucgucaaaacagagauagaaaaccuucccgaucuauuccaauacucuagcgacgccaaagaguucuacggaaacaaaacaagaaugucguucaucauggacgagaucggccgccgcgcuccucaauacacagaaauagaccacaaaggcauacccacccuggucgaggucguccgcgccggcuucuaccuagguuuccacaacaaagaacuaaacgaaaucaacaagcgcagcuucaaagaaagggucauacccuccauacuggcuauccagaaaaaccccaacuucaaauugggaaccgaaguacaagacaaaauagucucagccacaggccugcucgcagguaacgagacugcaccaccggaagugguaaauaacuucaccccgauacuccaagacuguaucaagaacaucgaccguuacgcccucgacgaucucaaaagcaaagcacucuucaacgugcucgcagcaccaacguaugauaucacugaauaccugagagcaaccaaagaaaaaccggagaacacccccugguacgggaaaaucgacggguucauaaacgaauugaagaaacuggcccuuuacggcaaaauaaacgacaauaacucauggauaaucgacaacggaaucuaccacauagcaccccucggcaaacuccacaguaacaacaaaauagggaucgagacccuaaccgaagugaugaagguuuaccccuaucucucaaugcagcaucuccagagugcagaccaaauaaaaaggcauuacgacucaaaagacgccgagggcaacaagauaccucucgacaaguucaagaaagagggcaaagaaaaguacugccccaaaaccuacacguuugacgaugguaaagucaucauaaaggcaggagcacgagucgaagaagaaaaagucaaacgucuuuacugggccagcaaggaaguaaacagccaguucuuccgagucuacggcaucgacaaaccacucgaggaaggcaacccggaugacauccucacaauggugaucuacaacagcccggaggaguacaaacuuaacuccgucuuguacggcuaugacaccaacaauggcgggauguacaucgaaccagaaggaacuuucuucaccuaugagcgcgaagcccaagaguccaccuauacccucgaggaacucuuccgacacgaauacacucauuacuuacaaggccgcuacgcaguacccgggcaauggggccgcaccaagcuauacgacaaugacagacuaacuugguacgaggaaggcggagccgaacuauucgcaggcuccacacgcaccucaggaauacucccucgcaaaagcauaguauccaacauacacaacaccacccgaaacaacagauauaaacuaagcgacaccguccacagcaaauacggagcgagcuucgaguucuacaacuacgccugcauguuuauggacuauauguacaacaaagauaugggcauacucaacaaacuuaacgaccuagcaaagaacaacgacgucgacggcuacgacaacuacauacgggaccucagcucgaacuaugcacuaaacgacaaauaccaagaccacaugcaggaacgcauagacaacuacgaaaaccucaccguacccuucgucgcagacgacuaccuaguccgacacgcguacaaaaaucccaacgaaaucuacuccgaaaucagcgaagucgccaagcugaaggaugccaaaagcgaagugaagaaaucacaauauuucucaaccuucacgcuccgcggcucauacacagguggcgccuccaaaggaaaacuagaggaucaaaaagcaaugaacaaguucauagacgacucccucaaaaagcucgacacauacuccugguccggcuacaaaacacuuaccgcguacuucaccaacuacaaaguagacuccucgaaucgaguaaccuacgacgucguauuccacggcuaccuuccaaacgaaggcgacuccaaaaacucccuacccuacggaaagauaaacggcaccuacaaagguaccgaaaaggagaaaaucaaauucuccagcgaagggucauuugacccagacggaaaaaucgucuccuacgaaugggacuucggagacggaaauaagucaaacgaagaaaaccccgaacacagcuacgacaaagugggaaccuacaccguaaagcucaaagugacagaugacaaaggcgaaucaaguguaaguacgaccacugcugagauaaaagacuugucggagaauaaacuucccguaaucuacaugcacguccccaaaucaggagcacuaaaccagaaagucguauucuacggcaaaggaaccuacgaccccgacggcucaauagccggauaucaaugggauuucggggacggaagcgacuuuucgucggaacagaaccccagccacguguacacgaagaaaggggaauacaccgucacccugcggguaauggacagcucaggccaaauguccgagaaaacaaugaaaauaaaaaucaccgaccccgucuaccccaucggcacggaaaaagaacccaacaacuccaaagaaaccgcauccggcccaaucgugcccggcauacccgucuccggcacaauagaaaauaccuccgaccaagacuacuucuauuucgaugucaucacccccggagaggucaaaaucgacaucaacaaacugggcuacggcggagcaaccuggguagucuacgacgagaacaacaacgccgucaguuacgcaaccgacgacgggcaaaaccucagcggaaaguucaaagccgacaaaccaggaagauacuacauccaccuauacauguucaauggcagcuacaugcccuacagaauuaauaucgagggauccgugggccgcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2225 - RNA, 3283 nt, Artificial Sequence
  mRNA product Design1 comprising derived and/or modified sequence from Clostridium histolyticum__BAA34542.1__ColH (opt9)
gggagaaagcuuaccaugaaacgaaaaugccuuagcaaacgccugaugcucgccauuaccauggcgacaauauucaccgugaacaguacgcucccuaucuacgcagccguagacaaaaacaacgcaaccgcagccguacagaacgaguccaaacgcuacaccgucuccuaucucaagacccuaaacuacuacgaccuuguagaccuccucgugaagaccgaaaucgaaaaccuacccgaccucuuccaauacuccagcgacgccaaggaguucuacggaaacaaaacccgaaugagcuucauaauggacgaaaucggucgccgcgcgccccaauacacggaaaucgaccauaaaggaaucccuaccuuagucgaggucguaagagcggguuucuaccuaggauuccacaacaaagagcuaaacgagaucaacaaacgcuccuucaaagaacgcgugauccccucuauccuagccauccagaaaaacccaaauuucaaacucggcaccgaaguacaagauaaaauaguaagcgccaccggacuccucgcuggcaacgaaaccgcacccccagaaguagugaauaacuucacacccauccuccaagauugcaucaaaaauauagaccgauacgcccuggacgauuuaaaaagcaaagcacucuucaacguacucgcugcacccacauacgacaucacagaguacuugagggcaacgaaagagaaacccgaaaacacccccugguacggaaaaauagacggcuucaucaacgaacuaaagaaauuggcgcuauaugggaaaaucaacgacaacaacaguuggauaaucgacaacggcaucuaucacauagcaccccucggcaaacuccauagcaacaacaaaauaggcauagaaacacuaacugaagucaugaaaguauaccccuaucucagcaugcaacaccuacaauccgccgaccaaaucaaacgccacuacgacagcaaagacgcagaaggcaacaaaauaccccucgacaaguucaagaaagaaggaaaagagaaauacugccccaaaaccuacaccuucgacgacggcaaaguaaucaucaaggccggagcacgaguagaagaagagaaaguaaaacgacucuacugggcgagcaaagaagucaauagccaauucuuccgcguuuacgguaucgauaaaccgcuugaagaaggcaacccagaugacauccuaacgaugguuaucuauaacagucccgaagaauacaaacucaacagcguccuuuauggguacgacaccaauaacggcgggauguacaucgaacccgaggggaccuucuucacauacgaacgagaagcccaagaauccaccuacacacuagaagaacucuuccgccacgaauacacccacuaucuucagggcagauacgccguaccaggacaaugggggaggaccaaauuauacgacaacgaccgacucacaugguacgaagaaggcggcgccgaguuauucgcuggaaguacucgaaccuccggcauccuuccccgaaaaagcauagucucgaacauccacaacacaacccguaacaaucgcuacaaacuauccgauacaguccacagcaaauauggagcuagcuuugaguucuacaacuaugccugcauguucauggacuacauguacaacaaggacaugggcauccucaacaaacuaaacgaccuggcgaaaaacaacgacguagacggcuacgacaacuacauacgcgaucuuagcucuaacuacgcccuaaacgacaaauaucaagaccauaugcaggaacggaucgauaauuacgaaaaucucacaguacccuucgucgccgacgacuaccuaguccggcaugcauacaaaaacccgaaugagauauacuccgagaucucagaagucgcaaaacugaaagacgcaaagucggaaguuaaaaagagccaauacuucagcacauucacccuccgcggaucuuacaccggcggggccuccaaggggaaacuugaggaccaaaaagcaaugaacaaauuuaucgacgacagccucaaaaagcucgacaccuacagcuggagcggguacaaaacacuuacggcauacuucaccaauuacaaagucgacucgagcaaucgggucaccuacgacguggucuuccacggcuaccuaccgaacgaaggcgacagcaaaaacucacuaccguacggcaaaauaaacggcacguauaaagggaccgaaaaagaaaagaucaaguucucaucagaaggcuccuucgacccagacggaaaaauagugagcuaugagugggauuucggcgacgggaacaaaucaaacgaagagaacccggagcacagcuacgacaaagucgggaccuacaccgucaaacuaaaagucaccgaugacaaaggcgaguccucaguauccacgaccacggcugaaaucaaagaccugagcgaaaacaagcucccagucauauacaugcacgucccgaaauccggcgcccuaaaccagaaagucgucuucuacggcaaaggcacuuacgacccagacggcagcauagcaggauaccaaugggacuucggggacggcuccgacuucucaucagaacagaacccaucacacgucuacaccaaaaagggcgaguacacaguuacacuccgcgugauggacuccuccggacaaaugagcgagaaaacaaugaaaauaaaaauaaccgacccgguauacccaauaggcacggaaaaggaaccuaacaacagcaaagaaacagcaucaggucccauuguacccggcaucccagucucaggaaccaucgaaaacaccuccgaccaagacuacuucuacuucgauguaauaacacccggcgaaguaaaaaucgacaucaacaaacucggguacgggggagcaaccugggucguauacgaugaaaacaacaacgcugucucauacgcaaccgacgacggacagaaccugagcggcaaguucaaagccgacaaaccagggagguacuacauacaccucuacauguucaaugguagcuacaugccuuaccguauaaauaucgaaggaucuguaggacgauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2226 - RNA, 3217 nt, Artificial Sequence
  mRNA product Design1 comprising derived and/or modified sequence from Clostridium histolyticum__BAA34542.1__HsALB(1-18)_ColH(41-1021) (opt9)
gggagaaagcuuaccaugaaaugggugaccuucauaagccuucucuuccucuucucauccgccuacagcguacaaaacgagucgaaaagauacaccguaucauaccucaagacccucaacuacuacgaucucgucgaucuauuagucaagacagaaaucgaaaaucuacccgaccuauuccaguacucaucggacgccaaagaguucuacggcaacaaaacacgaaugagcuucauuauggacgaaauagguagacgagcgccgcaguacacggaaaucgaccacaaagggauccccaccuuagucgaaguuguacgcgcgggcuucuaccuaggauuucacaacaaagaacuuaacgaaaucaacaaacgcaguuucaaagaacgcgucauccccagcauccuagcgauccagaaaaaccccaauuuuaaacucggcaccgaaguacaggacaagauagugucagcaacaggccugcucgccggaaacgaaacggccccacccgaaguagucaauaacuucacacccauacugcaggacugcaucaaaaauaucgaccgauacgcacucgacgaccucaagagcaaagcccucuucaacgugcucgccgccccaaccuacgacauaaccgaauacuugagggccacaaaagaaaaacccgaaaacaccccaugguacggcaaaauugacggauucaucaacgagcugaagaaacucgcccucuacgggaaaaucaaugacaacaacagcuggaucaucgacaacggcaucuaccacauugccccgcuaggcaaacuacacuccaacaacaaaaucggcaucgaaacgcucacggaagucaugaaaguauauccauaucuauccaugcaacaccuccaaucugccgaccaaaucaaacgccacuacgacagcaaggacgcggaaggaaacaaaaucccacucgacaaguuuaagaaggaaggcaaagaaaaauacugcccuaaaaccuacacguucgaugacgggaaaguaauuaucaaagccggcgcccgagucgaagaggaaaaggugaaacgccuauacugggccuccaaagagguuaauucacaauuuuuccgagucuauggcaucgacaaaccacucgaggaagguaaccccgacgauauccucaccaugguaauauauaauucgcccgaggaauauaaacucaacagcgucuuauacggcuacgacaccaacaacgguggcauguacaucgagccggaaggcaccuucuucaccuacgagcgugaagcccaagaauccacguacacacuugaggaacuauuccgacaugaauacacccacuaccugcaaggccgguacgcaguaccuggccaguggggccgcacuaaacucuacgacaacgaccgucucaccugguacgaagaagguggagccgaacucuucgccggcuccacccgcaccagcggcauccuaccccgaaaauccauagucucgaacauucacaacacaacccgaaauaaccgcuacaaacucagcgacaccguacacucaaaauacggagccagcuucgaguucuacaacuacgcgugcauguucauggacuacauguacaacaaagauauggggauucuaaacaaacuuaacgaccucgccaaaaauaacgacgucgacgguuacgacaacuauauacgagaucuuucaucgaacuacgcacuaaacgacaaauaccaggaccacaugcaagaacgcaucgacaacuacgaaaaccucaccguccccuucgucgcagacgauuaccucguccgacacgcauacaagaaccccaacgaaauauacucggagaucagcgaagucgccaagcucaaagaugcaaaauccgaagucaaaaagucacaguacuuuagcacauucacacuccgcgggagcuacaccggcggcgcguccaagggaaagcucgaagaccaaaaagccaugaacaaauuuauagacgacucccucaagaaacucgacaccuacucguggagcggcuacaaaacacuuaccgcauacuucaccaacuacaaaguagacagcucaaaucggguaacuuacgacguagucuuccacggcuaccuucccaaugaaggagacagcaagaacucacucccuuacggcaaaauaaauggaacguacaagggcacggaaaaggagaaaaucaaauucagcuccgaaggcuccuucgaccccgacggaaaaauaguaucauacgaaugggacuucggcgacggcaacaagaguaacgaagaaaaucccgaacacucauacgacaaagucggcacguacaccgucaaacuaaaaguaacagacgacaaaggcgaauccucagugaguacgaccaccgcagaaaucaaagacuuaucagaaaacaaacuccccguaauauacaugcacgucccaaagagcggggcacucaaccaaaaagucgucuucuacggcaaaggaaccuacgacccugacggauccaucgccggcuaccagugggauuucggcgacggaagcgacuucucaucggagcaaaacccaagccacgucuacacgaaaaagggagaauacacagugacacuccgaguaauggacuccucagggcagauguccgagaaaaccaugaaaauaaagaucaccgacccugucuaccccaucggaaccgaaaaggagccuaacaauuccaaagaaaccgccagcggaccaauaguacccgguauccccgucuccggaaccaucgaaaacacgucagaccaggacuacuucuacuucgacgucauaaccccgggcgaaguaaaaaucgacaucaacaaacuaggcuacggcggagccacaugggucguauacgacgaaaacaacaacgcgguaucuuacgcaacagacgacggccaaaaccuaagcggcaaguucaaagcagacaaacccgggcgcuacuacauccaccuguacauguucaacggaagcuacaugccauacagaauaaauaucgaaggcuccguaggacguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2227 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt9)
gggagaaagcuuaccaugaaaugggucaccuucaucucucuacuguuccucuucucuagcgcauauagcaugaaacggaaaugucuauccaaacgccugaugcuggccauuacgauggccaccaucuucaccgucaacucuacccugccgaucuacgccgccguagacaagaacaacgccaccgccgcucgccgccgaagaaagaggguccaaaacgaaagcaaaagauacacaguaagcuaccuuaagacacucaacuacuacgaccucguagaccuacucgucaagacagaaauugagaaccuccccgaccuauuccaauacagcagcgacgccaaagaguucuacggcaacaaaacccgaaugucuuucauaauggaugaaauaggacgcagagcgccccaauacacggaaaucgaucacaaaggcauacccacccuaguggaagucguacgagcuggcuucuaucuggguuuccacaacaaagaacugaacgaaauaaacaagcgcagcuucaaagaacgcgugauccccucaauacuggcuauccagaaaaaucccaauuucaaacuagggaccgaaguccaagacaagaucguguccgcgacaggacuccucgccggcaacgaaaccgccccgccggaagucguuaacaacuucacgccaauacuacaagacugcauuaaaaacaucgaccgauacgcccuagacgaucugaaauccaaggcacuauucaacguucuggccgcaccaacauacgacaucacagaguaccugcgugccacaaaagaaaaaccagaaaauacccccugguacggcaaaaucgacggauucauuaaugaguugaaaaagcuagcacucuacggaaaaaucaacgacaauaacagcuggaucaucgacaacggcauuuaccacauagcgccccucggcaaacugcacuccaacaacaaaaucgguauagagacacucacagaggugaugaaaguuuacccauaccuaagcaugcaacaccuucaauccgccgaccaaaucaaacgccacuacgacuccaaagacgcggaaggcaacaaaauaccccucgacaaauuuaaaaaggagggcaaagaaaaauacugcccaaagaccuacaccuucgaugacggcaaaguaauaaucaaagcaggagccagagucgaggaggagaaggucaaaaggcuauacugggcaucuaaggaagugaacagccaauucuuucggguauacggaaucgacaagccccuagaagaagguaaccccgacgacauccuuacaaugguaauauacaacagcccggaagaguacaaacucaacaguguucuauacggauacgauacgaacaacggaggcauguacaucgaaccggagggcaccuucuucaccuacgagcgagaggcccaagaaagcacauacaccuuagaagaacuguuccgacacgaauacacccauuaccuccaaggcagauacgcuguccccggccaauggggacgcacuaaacuauacgauaacgaccgccuaacaugguacgaagaggguggcgccgaacucuucgccggcucaacgagaacgagcggaauccugccgcgcaaaagcaucgucagcaacauacacaacacaacgcgaaacaaucguuacaaacucucggacacgguccacucaaaauacggcgcgucauucgaguucuacaacuacgccugcauguucauggauuacauguacaauaaggacaugggcauccuaaacaaacucaacgaccucgcuaaaaacaacgacgucgacggcuacgacaacuauauccgagaccuaagcucgaacuacgcacucaaugacaaauaccaagaccacaugcaagagcgcaucgacaacuacgaaaaccuaacaguacccuucguugcggacgacuaucucgucaggcacgcauacaagaacccaaacgagauauacagcgaaaucagcgagguagccaaacuuaaggacgccaaauccgaagucaagaaaucgcaguacuucucaaccuucacgcuacguggcagcuacaccgggggagcaagcaaaggaaaacucgaggaccaaaaagcaaugaacaaguuuauugacgacagccuaaagaaacuagauacauauuccugguccggcuacaaaacgcuaacggcauacuucacgaacuacaagguugacucaaguaaccgcguaacauacgacguaguuuuccacggauaccuaccaaaugaaggcgacuccaaaaacucgcugccauacggaaaaaucaauggcacauacaaagggacagagaaggagaaaaucaaauucaguucagaaggauccuucgacccagacggcaaaaucguuucauaugaaugggauuucggagacgggaacaaaucaaacgaagaaaacccugagcacagcuacgacaaagucggcacauauacaguaaagcucaaagucacggacgacaagggcgagagcagcguaagcacgaccaccgcagaaaucaaggaccucuccgaaaauaaacucccagucauauacaugcacguaccaaaaucgggcgcccucaaccagaaaguaguguucuacggaaaaggcacauacgauccggacggauccauagcaggcuaccaaugggauuucggagaugggagcgacuucucgagcgaacaaaacccgucacacgucuacacuaaaaagggcgaguacaccguaacccuucggguaauggacuccuccggacaaaugucugagaaaaccaugaaaaucaagauaaccgacccaguauaccccaucggcaccgaaaaagaaccaaacaacuccaaagaaacugccuccggccccaucguaccgggaaucccagucuccggcaccaucgaaaacaccagcgaccaagauuacuucuacuucgacguaaucacccccggagaagucaaaaucgacaucaacaaacugggcuacggaggagcuaccuggguagucuacgacgaaaacaacaacgccgucaguuacgccaccgacgacgggcaaaaccuguccgguaaauuuaaggccgacaagccagggcgauacuacauccaccuguauauguuuaacggauccuauaugcccuaccgaauaaauaucgaaggaaguguaggccgcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2228 - RNA, 793 nt, Artificial Sequence
  mRNA product Design1 comprising derived and/or modified sequence from Homo sapiens__NP_001133.1__HsAMELX (opt9)
gggagaaagcuuaccaugggaacauggauacucuucgcaugccuccucggcgcagccuucgccaugccccucccuccccaccccggccaccccggcuacaucaacuucuccuacgaaguccucacaccccucaaaugguaucaauccaucagaccacccuaccccuccuacggcuacgaacccaugggcggcuggcuccaccaccaaaucauccccguccucucacaacaacacccucccacccacacccuccaaccccaccaccacauccccguaguccccgcccaacaacccgucaucccccaacaacccaugaugcccguccccggccaacacucaaugacccccauccaacaccaccaacccaaccucccaccacccgcccaacaacccuaccaaccccaacccguccaaccccaaccccaccaacccaugcaaccccaaccacccguacaccccaugcaaccccucccaccccaaccaccccuaccucccauguuccccaugcaaccccucccacccaugcuccccgaccucacccucgaagccuggcccuccaccgacaaaaccaaacgcgaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2229 - RNA, 352 nt, Artificial Sequence
  mRNA product Design1 comprising derived and/or modified sequence from Homo sapiens__NP_001133.1__HsAMELX-TRAP (opt9)
gggagaaagcuuaccaugccccuacccccccacccaggccaccccggcuacauaaacuucuccuacgaaguacucacaccccuaaaaugguaccaauccauccgaccccccuaccccucauacggcuacgaacccaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2230 - RNA, 385 nt, Artificial Sequence
  mRNA product Design1 comprising derived and/or modified sequence from Homo sapiens__NP_001133.1__HsAMELX-LRAP (opt9)
gggagaaagcuuaccaugccccuccccccccaccccggccaccccggcuacauaaacuucucauacgaaguccucaccccccuaaaaugguaccaauccauccgccccccccccaugcuccccgaccucacacucgaagccuggcccucaaccgacaaaacaaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2231 - RNA, 424 nt, Artificial Sequence
  mRNA product Design1 comprising derived and/or modified sequence from Homo sapiens__NP_001133.1__HLA-A2-SP_HsAMELX(17-60) (opt9)
gggagaaagcuuaccauggccguaauggccccccgaacccucguccuccuacucucaggagcccucgcccucacccaaaccugggccaugccccucccaccccacccaggccaccccggauacaucaacuucuccuacgaaguacucaccccccuaaaaugguaccaauccauccgcccccccuaccccucauacggcuacgaacccaugggcggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2232 - RNA, 457 nt, Artificial Sequence
  mRNA product Design1 comprising derived and/or modified sequence from Homo sapiens__NP_001133.1__HLA-A2-SP_HsAMELX(17-47,168-191) (opt9)
gggagaaagcuuaccauggccguaauggcaccccgcacccucguccuacuccuauccggcgcccucgcccucacacaaaccugggccaugccccucccaccccaccccggccaccccggcuacauaaacuucuccuacgaaguccucaccccacucaaaugguaccaauccauccgcccaccacccaugcuacccgaccucacacucgaagccuggcccuccaccgacaaaacaaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2233 - RNA, 796 nt, Artificial Sequence
  mRNA product Design1 comprising derived and/or modified sequence from Homo sapiens__NP_001134.1__HsAMELY (opt9)
gggagaaagcuuaccaugggcaccuggauccucuucgccugccuagucggcgccgccuucgccaugccccucccaccccaccccggccaccccggcuacaucaacuucuccuacgaaguccuaacaccccuaaaaugguaccaauccaugauccgcccacccuacuccuccuacggcuacgaacccaugggcggauggcuccaccaccaaaucauccccgucgucucccaacaacacccccucacccacacccuccaaucacaccaccacauccccguaguccccgcccaacaaccccgcguacgacaacaagcccucaugcccguccccggccaacaauccaugacccccacccaacaccaccaacccaaccucccacuccccgcacaacaacccuuccaaccccaacccguccaaccccaaccccaccaaccaaugcaaccccaaccacccguccaacccaugcaaccccucuuaccccaaccaccccuaccacccauguucccccuccgcccccuaccacccauccuccccgaccuccaccucgaagccuggcccgccaccgacaaaacaaaacaagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2234 - RNA, 355 nt, Artificial Sequence
  mRNA product Design1 comprising derived and/or modified sequence from Homo sapiens__NP_001134.1__HsAMELY-TRAP (opt9)
gggagaaagcuuaccaugccccuaccaccccacccaggccaccccggcuacaucaacuucucauacgaaguccucaccccccuaaaaugguaccaaucaaugauccgccccccauacucauccuacggcuacgaacccaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2235 - RNA, 388 nt, Artificial Sequence
  mRNA product Design1 comprising derived and/or modified sequence from Homo sapiens__NP_001134.1__HsAMELY-LRAP (opt9)
gggagaaagcuuaccaugccccuccccccccacccaggccaccccggcuacaucaacuucuccuacgaaguacucaccccccuaaaaugguaccaauccaugauccgccccccccccauacuccccgaccuccaccucgaagccuggcccgccacagacaaaaccaaacaagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2236 - RNA, 427 nt, Artificial Sequence
  mRNA product Design1 comprising derived and/or modified sequence from Homo sapiens__NP_001134.1__HLA-A2-SP_HsAMELY(17-61) (opt9)
gggagaaagcuuaccauggcagucauggcaccccgcacccucguccuccuccucuccggcgcccucgcccuaacccaaaccugggcaaugccacuacccccacaccccggccaccccggcuacaucaacuucucauacgaaguccuaacaccccucaaaugguaccaaucaaugauccgcccacccuacuccuccuacggcuacgaacccaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2237 - RNA, 460 nt, Artificial Sequence
  mRNA product Design1 comprising derived and/or modified sequence from Homo sapiens__NP_001134.1__HLA-A2-SP_HsAMELY(17-48,169-192) (opt9)
gggagaaagcuuaccauggccgucauggcaccccgaacacucguccuccuccucuccggcgcccucgcccucacacaaacaugggccaugccccucccaccccaccccggccaccccggcuacaucaacuucuccuacgaaguccucacaccccuaaaaugguaccaauccaugauccgcccacccccaauacuccccgaccuacaccucgaagccuggcccgccaccgacaaaaccaaacaagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2238 - RNA, 787 nt, Artificial Sequence
  mRNA product Design1 comprising derived and/or modified sequence from Sus scrofa__NP_999071.1__SsAMELX-001-1 (opt9)
gggagaaagcuuaccaugggcaccuggauacucuucgccugccuccucggcgccgccuucuccaugccccuaccaccccaccccggacaccccggcuacaucaacuucuccuacgaaguccuaacaccccucaaaugguaccaaaauaugauacgccaccccuacacauccuacggcuacgaacccaugggcggauggcuccaccaccaaaucauccccgucgucucacaacaaaccccacaaucccacgcccuccaaccccaccaccacauccccaugguccccgcccaacaacccggcaucccccaacaacccaugaugccccuccccggccaacacuccaugacccccacccaacaccaccaacccaaccuaccccuacccgcccaacaacccuuccaaccccaacccguacaaccccaaccccaccaaccccuucaaccccaaucucccaugcaccccauccaaccccuccucccccaaccaccccuuccacccauguucucaaugcaaucacuccuccccgaccucccccucgaagccuggcccgccaccgacaaaaccaaacgagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2239 - RNA, 355 nt, Artificial Sequence
  mRNA product Design1 comprising derived and/or modified sequence from Sus scrofa__NP_999071.1__SsAMELX-TRAP (opt9)
gggagaaagcuuaccaugccccuaccaccccaccccggccaccccggcuacaucaacuucuccuacgaaguccuaacaccccuaaaaugguaccaaaacaugauccgccacccauacaccucauacggcuacgaaccaaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2240 - RNA, 388 nt, Artificial Sequence
  mRNA product Design1 comprising derived and/or modified sequence from Sus scrofa__NP_999071.1__SsAMELX-LRAP (opt9)
gggagaaagcuuaccaugccccucccaccccaccccggccaccccggcuacaucaacuucuccuacgaaguccuaacaccccucaaaugguaccaaaacaugauccgacaccccucccuacuccccgaccucccccuagaagcauggcccgccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2241 - RNA, 427 nt, Artificial Sequence
  mRNA product Design1 comprising derived and/or modified sequence from Sus scrofa__NP_999071.1__HLA-A2-SP_SsAMEL(17-61) (opt9)
gggagaaagcuuaccauggccgucauggcaccccgcacccuaguccuccuccucucaggcgcccucgcacucacccaaacaugggccaugccccuacccccacaccccggccacccaggcuacaucaacuucucauacgaaguccucaccccacuaaaaugguaccaaaacaugauacgccaccccuacaccucauacggauacgaacccaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2242 - RNA, 460 nt, Artificial Sequence
  mRNA product Design1 comprising derived and/or modified sequence from Sus scrofa__NP_999071.1__HLA-A2-SP_SsAMEL(17-49,167-189) (opt9)
gggagaaagcuuaccauggccgucauggcaccccgcacucucguccuccuacucuccggcgcccuagcccucacccaaaccugggccaugccccuacccccacaccccggccaccccggcuacaucaacuucucauacgaaguccucaccccacuaaaaugguaccaaaacaugauccgccaucccucacuccuccccgaccucccccuagaagccuggcccgccacagacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2243 - RNA, 751 nt, Artificial Sequence
  mRNA product Design1 comprising derived and/or modified sequence from Sus scrofa__P45561-2__SsAMELX-001-2 (opt9)
gggagaaagcuuaccaugggcaccuggauacucuucgccugccuccucggcgcagccuucuccaugccccucccaccccaccccggccaccccggcuacaucaacuucucuuacauccgccaccccuacaccuccuacggcuacgaacccaugggcggcuggcuacaccaccaaaucauccccgucguaucccaacaaaccccacaaucacacgcucuccaaccccaccaccacauccccaugguccccgcccaacaacccggcaucccccaacaacccaugaugccccuccccggccaacacuccaugacccccacccaacaccaccaacccaaccucccccucccagcccaacaacccuuccaaccccaacccguccaaccccaaccacaccaaccacuacaaccacaaucccccaugcaccccauccaaccacuccucccccaaccaccccucccacccauguucucaaugcaaucccuccuacccgaccuuccccuugaagccuggcccgccaccgacaaaaccaaacgagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2244 - RNA, 787 nt, Artificial Sequence
  mRNA product Design1 comprising derived and/or modified sequence from Sus scrofa__NP_998965.1__SsAMELX-001-3 (opt9)
gggagaaagcuuaccaugggcaccuggaucuucuucgcaugccuccuaggcgccucccucgccaugccccucccaccccaccccggacaccccggcuacaucaacuucuccuacgaaguccucaccccacuaaaaugguaccaaaacaugauccgccaccccuacaccuccuacggauacgaacccaugggaggcuggcuccaccaccaaaucauccccgucgucucacaacaaacaccccaaucccacgcacuccaaccccaccaccacauccccaugguccccgcccaacaacccggaaucccccaacaacccaugaugccccuccccggacaacacuccaugacccccacccaacaccaccaaccaaaccucccccuccccgcccaacaacccuuccaaccacaacccguccaaccccaaccccaccaaccacuccaaccccaaucccccaugcaccccauccaaccacuccucccccaaccaccccucccacccauguucucaaugcaaucccuccuucccgaccucccccucgaagccuggcccgccaccgacaaaaccaaacgcgaagaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2245 - RNA, 436 nt, Artificial Sequence
  mRNA product Design1 comprising derived and/or modified sequence from Sus scrofa__K7GPB2__SsAMELX-002 (opt9)
gggagaaagcuuaccaugggcaccuggauacucuucgccugccuacucggcgccgcauucucaaugccccuccccccccaccccggccaccccggcuacauaaacuucuccuacgaaguccucaccccccucaaaugguaccaaaacaugauuagacacccaucccuccuccccgaccucccccucgaagcauggcccgcaaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2246 - RNA, 829 nt, Artificial Sequence
  mRNA product Design1 comprising derived and/or modified sequence from Sus scrofa__K7GLD0__SsAMELX-003 (opt9)
gggagaaagcuuaccaugggcacauggauccucuucgccugccuacucggagccgcuuuuuccaugccccucccuccccaccccggccaccccggcuacauaaacuucuccuacgaagaccucuaccucgaagccauccgcaucgaccgcaccgccuucguccucacaccccuuaaaugguaccaaaacaugauccgccaccccuacaccuccuacggcuacgaacccaugggcgguuggcuccaccaccaaaucauccccguagucucacaacaaaccccacaaucccacgcccuccaaccccaccaccacauaccaaugguccccgcccaacaaccaggcaucccccaacaacccaugaugccccuccccggccaacacuccaugaccccaacccaacaccaccaacccaaccucccccuccccgcccaacaacccuuccaaccccaacccguccaaccccaaccccaccaaccccuccaaccccaaucccccaugcaccccauccaaccucuccucccccaacccccacucccaccaauguucucaaugcaaucacuccuccccgacuuaccccuagaagccuggcccgccaccgacaaaaccaaacgagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2247 - RNA, 715 nt, Artificial Sequence
  mRNA product Design1 comprising derived and/or modified sequence from Sus scrofa__K7GPE9__SsAMELX-004 (opt9)
gggagaaagcuuaccaugggcaccuggauccucuucgccugccuccucggcgccgccuucuccaugccccucccaccccaccccggccaccccggcuacaucaacuucucauaugaaguccucacaccccucaaaugguaccaaaacaugauccgccaccccacaccccaaucccacgcccuccaaccacaccaccacauccccaugguccccgcccaacaaccaggcaucccacaacaacccaugaugccccuaccaggccaacacuccaugacccccacccaacaccaccaacccaaccuaccccuccccgcacaacaacccuuccaaccacaacccguccaaccccaaccccaccaaccccuacaaccccaaucccccaugcacccaauccaaccccuccucccccaaccaccccucccacccauguucuccaugcaaucacuccuccccgaccucccccuagaagccuggcccgcaaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2248 - RNA, 739 nt, Artificial Sequence
  mRNA product Design1 comprising derived and/or modified sequence from Sus scrofa__J9JIM4__SsAMELX-201 (opt9)
gggagaaagcuuaccaugccccucccaccccaccccggccaccccggcuacaucaacuucuccuacgaaguacucaccccucucaaaugguaccaaaacaugauccgacaccccuacaccuccuacggcuacgaacccaugggcggcuggcuccaccaccaaaucauccccgucgucucccaacaaacaccccaaucccacgcacuacaaccccaccaccacauccccaugguccccgcccaacaacccggcaucccccaacaacccaugaugccacuccccggccaacacuccaugacccccacccaacaccaccaacccaaccucccccuacccgcccaacaacccuuccaaccccaacccguccaaccacaaccucaccaaccacuccaaccccaaucacccaugcaccccauccaaccacuccuaccccaacccccacucccacccauguucuccaugcaaucacuccuccccgaccucccccuagaagccuggcccgccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2249 - RNA, 3178 nt, Artificial Sequence
  mRNA product Design1 comprising derived and/or modified sequence from Homo sapiens__NP_006120.1__HsBMP1 (opt9)
gggagaaagcuuaccaugccaggagucgcccggcuaccccuacuccuaggacuccuccuacuaccacgcccuggacgaccccuagaccuggccgacuacacguacgaccuagccgaagaagacgacuccgaaccccucaacuacaaagaccccugcaaggccgccgccuuccuaggcgacauagcccuagacgaagaagaccuccgagccuuccaaguccaacaagcggucgaccugcgccgacacacggccaggaaaucauccauaaaagccgcuguaccgggaaacacaucaacccccucaugccaaucgacaaacggacaaccacaaaggggcgcaugcggaagauggcgcgggcgaucacgcucacgccgcgcagccacaagccgcccggagcgaguguggcccgacgggguaauacccuucgucauagggggaaacuucacuggaucacaacgggcagucuuuagacaagcaaugagacacugggaaaagcauaccugcgucacauuccuagaacggaccgacgaagauucauacaucguauucaccuaccgcccaugcggauguugcucauacguaggccgaagaggcggcggcccccaagcgauaucgauaggcaagaacugcgacaaauucgggauaguuguacacgaacuaggacacgucguaggcuucuggcacgaacacaccagacccgaccgggaccggcacguauccauaguccgcgaaaacauccaacccggacaagaauacaacuuccuaaaaauggaaccacaagaagucgaaucgcuaggcgaaaccuaugacuucgauuccaucaugcacuaugcucgcaacaccuucucacgaggcaucuuccucgacaccaucguccccaaauacgaaguuaacggagucaaaccacccauaggacaacgcacgcgacucucaaaaggcgauaucgcucaagcacgcaaacucuacaagugucccgccugcggcgaaacgcuccaggacucgacaggcaacuucucaucccccgaauacccgaacggauacagcgcacacaugcacugugucuggcgaaucucaguaacaccaggcgagaaaaucauccuuaacuucacaucccucgaccuguacagaucccgccucugcugguacgauuacgucgaagucagagacggguucuggcgaaaagcaccgcuccgaggccgauucuguggauccaaacugccagaacccauagucuccacagacucucgacucuggguugaguucagaagcucuaguaacugggucggcaaaggcuucuucgccgucuacgaagcaaucugcggaggagacguaaagaaagauuacggccacauacagucccccaacuaccccgacgacuaccggcccaguaaaguauguaucuggagaauccagguaagcgaaggcuuccauguugggcucaccuuucagagcuucgaaauagaacgccacgacucaugcgcuuaugacuaucucgaaguacgcgacggccacuccgaaucaagcacacucauaggcagauacugcggauacgaaaaacccgaugacaucaaauccacguccagccgccuauggcucaaauucgucucagauggaagcauaaacaaagccggauuugcuguuaacuucuucaaggaaguagacgagugcucccgacccaaccgcggcgggugcgaacaacgcugccucaacacacucgguuccuacaaaugcagcugcgacccaggcuacgaacuagccccugauaagcgucgcugcgaagcagccugcgguggguuccucacaaaacuaaacggauccauaacaagcccuggcuggccaaaagaauaucccccuaacaagaacugcaucuggcaacugguggcgcccacacaauaccgaauaagccuacaauuugacuucuucgagacagaaggaaaugacgugugcaaguacgacuucguagaaguccgcuccggguuaaccgccgacuccaagcugcaugggaaauucugcggauccgaaaaaccagaagugauuacgagccaauacaacaacaugcgagucgaguucaagucagacaacacagucuccaagaaaggcuuuaaagcucacuucuucucagacaaagacgagugcucaaaagacaauggagggugucaacaagacugcguuaacacauucggguccuacgaaugccaaugccgcucuggguucguacuucacgauaacaagcacgacugcaaagaagccggaugcgaccacaaggugacaagcaccuccggcaccauaacgucccccaacuggccagauaaauaccccucaaagaaagaaugcacgugggccaucaguagcacucccggccacagagucaaacucacauucauggaaauggacaucgaaagccagccggagugcgcguacgaccaccucgaaguguucgacggacgcgacgcgaaggcuccagugcucggccgauucugcggauccaagaagccagaaccagucuuagcaacuggaagccgaauguuccuacgauucuacuccgacaauuccguucaacgaaaaggcuuccaagccucccacgccaccgaaugcggcggacaaguccgagcggacguaaaaaccaaagaccucuacagccacgcgcaauucggggacaacaacuacccagguggcguagacugcgaauggguaauagucgcagaagaaggcuacggagucgagcuaguauuccagaccuucgaaguugaagaagaaacagacugcggcuacgacuacauggaacuauucgacgguuacgacuccaccgcaccccggcucggacgguacugcggcuccggcccaccagaagaaguauacucagcaggagacagcguccucgucaaauuccacuccgaugauaccauaacaaagaaaggguuucaccuacgcuacacgagcaccaaauuccaagacacucuacacagccgcaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2250 - RNA, 1408 nt, Artificial Sequence
  mRNA product Design1 comprising derived and/or modified sequence from Homo sapiens__NP_001191.1__HsBMP2 (opt9)
gggagaaagcuuaccaugguagccggcacccgaugccuacucgcccuccuucucccccaaguccuccuaggcggcgccgccggccuggucccagaacuaggccgccgcaaauucgcagccgcauccuccggacgcccaucaucacagcccuccgacgaaguccucuccgaguucgaacucagacuacuaucgauguucggccuuaaacaacgccccaccccaucccgugacgccguagucccaccauacaugcucgaccuauaccgccgccacuccgggcaacccggaucaccagcacccgaccaccgccucgaacgcgccgcaucccgcgccaacacaguccgcuccuuccaccacgaagaaucccucgaagaacuccccgaaacaucaggcaaaacaacccgccgauucuucuucaaccucuccuccauacccacagaagaguucaucaccuccgcagaauuacaagucuuccgcgaacaaaugcaagacgcacucggcaacaacuccuccuuccaccacagaaucaacaucuacgaaaucaucaaacccgcaaccgccaacagcaaauucccaguaacccgacuccuugacacacgacucgucaaccaaaacgccuccagaugggaaucauucgacgucacaccagcagucaugcgcuggaccgcccaaggccacgcaaaccauggauucgugguagaagucgcccaccuagaagaaaaacaaggagucuccaaacgccacguccgcaucucacgcucccuccaccaagacgaacacucauggucacaaauccgaccccuccuaguaacauucggacacgacggcaaaggccacccccuacauaaacgcgaaaaacgacaagccaaacauaagcaacgaaaacgccucaaaucaagcuguaaacgucauccacucuacgucgacuucucugacgucggcuggaacgacuggaucguagcaccacccggcuaccacgccuuuuacugccacggagaaugccccuucccccucgccgaccaccuaaauuccaccaaccacgcaauaguccaaacccuaguuaacuccgucaacuccaaaaucccaaaagcaugcugcguucccacagaacucucagcaaucuccaugcucuaccuugacgaaaacgaaaaagucguccugaaaaacuaccaagacauggucgucgaaggcugcggcugccgauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2251 - RNA, 1444 nt, Artificial Sequence
  mRNA product Design1 comprising derived and/or modified sequence from Homo sapiens__NP_001193.2__HsBMP4 (opt9)
gggagaaagcuuaccaugauacccggcaaccguaugcucauggucguccuccucugccaaguacuccucggcggagccucacacgcaucucucauacccgaaacuggcaaaaaaaaagucgccgaaauccaaggccacgcaggaggacgccgcucaggucaaucccacgaacuccuacgcgacuucgaagccacccuacuacaaauguucggccuccgacgccgaccccagcccuccaaauccgccgucauacccgacuacaugcgcgaccucuaccgacuucaauccggcgaagaagaagaagaacaaauacacagcaccggccucgaauaccccgaacguccagccucccgcgccaacaccguccgcucuuuccaccacgaagaacaccucgaaaacauccccggcacauccgaaaacuccgccuuccgauuccucuucaaccuauccucaauccccgaaaacgaagucauauccuccgccgaacuccgucucuuccgcgaacaaguagaccaaggccccgauugggaacgcggcuuccaccgcaucaauaucuacgaagucaugaaaccaccagccgaagucguacccggacaccucaucacacgcuuacuagacacccgccucguccaccacaacguaacacgcugggaaaccuucgacgucuccccagcuguucuccgauggacacgcgaaaaacaacccaacuacggccucgccaucgaagucacccaccuccaccaaacccgaacccaccaaggccaacacgucagaaucucccgcucucucccccaaggcucaggcaacugggcccaacuacgcccccuacuugucaccuucggccacgacggacgaggccacgcacuaacgcgacgccgccgcgccaaacgcucacccaaacaccacucucagcgcgccagaaaaaaaaacaaaaauugccgccgacacucacuguacgucgacuucagcgacgucggcuggaaugacuggaucgucgccccccccggcuaccaagcauucuacugccacggcgacugcccauucccacuagcugaccaccucaacucgaccaaccacgcaauuguacaaacccucgucaauuccgucaacagcuccaucccaaaagcaugcugcgugcccaccgaacucuccgcuaucuccaugcucuaccucgacgaauacgacaaagucguacucaaaaacuaccaagaaauggucgucgaaggaugcggcugccgcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2252 - RNA, 1759 nt, Artificial Sequence
  mRNA product Design1 comprising derived and/or modified sequence from Homo sapiens__NP_001709.1__HsBMP6 (opt9)
gggagaaagcuuaccaugcccggucuaggccgccgcgcacaguggcucugcuggugguggggacuacucugcuccugcugcggcccuccccccuuacguccacccuuaccagcagccgccgccgcggcagcaggaggccaacuacucggcgacgguggcucccccggacgaacggaacaacccccccccucaccccaauccucaagcggcuuccucuaccgccgccucaaaacccaagaaaaacgagaaaugcaaaaagaaauacuauccguccuaggccuuccacaccggccccgcccacuccacggccugcaacaaccccagccacccgcccuccgccaacaagaagaacaacaacaacaacaacaacucccccggggugaacccccuccaggccgccuaaaaucugccccucucuucaugcucgaccucuacaaugcccuauccgccgauaacgacgaagauggagcgucagaaggagaacgccaacaaucauggccccacgaagccgccuccucaucccaacgccgacaacccccgcccggcgccgcccacccccuaaaccguaaaucccugcucgcccccggcucaggcagcgguggugcauccccacucaccucggcccaagacuccgcauuccuaaacgacgcagacauggucaugagcuucgucaaccuagucgaauacgacaaagaauucuccccacgccaacgacaccauaaagaauucaaauucaaccucucacagauacccgaaggagaagucgucaccgccgcagaauuccgaaucuacaaagacugcguaauggguagcuucaaaaaccaaacauuccuaaucucuauauaccaaguacuccaagaacaccaacaccgugacagugaccuauuccuccucgacacccgagucguuugggccucagaagaaggcuggcucgaauucgacaucacagcaaccagcaaccuauggguaguaacaccgcaacacaacaugggccuacaacuauccguagucacccgagacggaguacacguucacccgcgcgcagccggccucguaggacgcgacggccccuacgacaaacagcccuucauggucgccuucuucaaagucuccgaaguacacguccgcaccacccgcuccgccuccucucgacgccgccaacaaucccgaaaccgauccacccaaucccaagacgucgcccgcguuuccucugccucagacuacaauuccucagaacucaaaaccgccugccgaaaacacgaacuauauguaucauuccaagaccuuggcuggcaagacuggaucaucgcccccaaaggcuacgcagccaacuacugcgacggcgaaugcuccuucccacuaaacgcccacaugaacgccaccaaccacgccaucguccaaacacucgugcaccuuaugaaccccgaauacguacccaaaccaugcugcgcccccaccaaacuaaacgccaucuccguacucuacuucgaugacaacuccaacgucauacuaaaaaaauaccguaacaugguaguacgcgccugcgguugccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2253 - RNA, 1513 nt, Artificial Sequence
  mRNA product Design1 comprising derived and/or modified sequence from Homo sapiens__NP_001710.1__HsBMP7 (opt9)
gggagaaagcuuaccaugcacgugcguucacuacgagcagccgccccacacucauucgucgcccucugggcuccccuuuuucuccuacgcucugcccucgccgacuucucccuagacaacgaaguacacagcucauucauccaccgccgucuccgcucucaagaaagacgcgaaaugcaacgugaaauccucuccauccucggccucccccaccgaccccgcccccaccuacaaggcaaacacaacuccgcccccauguucaugcucgaccucuacaacgccauggccguagaagaaggaggaggacccgguggccaaggcuucuccuaccccuacaaagccgucuuuuccacccaaggucccccgcucgcaucacuccaagacucccacuuccucaccgacgccgacauggucaugucauucgucaaccuugucgaacacgacaaagaguucuuccacccccgcuaccaccaucgcgaguuccgcuucgaccucagcaaaauucccgaaggcgaagccgucaccgccgccgaguuccgaaucuacaaagacuacauccgugaacgcuucgacaacgaaacuuuccgcaucucagucuaccaaguccuccaagaacaccuaggccgcgaaucagaccucuuucuccucgacucacgaacccucugggccucagaagaaggauggcucgucuucgacaucacagccacauccaaccacugggucgucaacccucgccacaaccuuggacuccaacuguccgucgaaacccucgacggccaauccauaaaccccaaacucgccggccucauaggccgacacggaccccaaaacaaacaaccauucauggucgcauuuuucaaagcaaccgaaguccacuuuagauccauccguuccaccggaucaaaacaacgcucccaaaaccgcuccaaaacccccaaaaaccaagaagcccuccgcauggccaacguagcagaaaacuccuccagcgaccaacgccaagccugcaaaaagcacgaacucuacguaucauuucgagaccucggcuggcaagacuggauaaucgccccagaaggcuacgccgcauacuacugcgaaggagaaugcgccuucccccuaaauuccuacaugaacgccaccaaccacgccaucguccaaacccucguccacuucaucaaccccgaaacugucccaaaacccugcugcgcccccacacaacuaaacgccaucucaguccucuacuuugacgacucaucuaacguaauccuaaagaaauaucgcaacaugguaguccgcgccugcgguugccacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2254 - RNA, 517 nt, Artificial Sequence
  mRNA product Design1 comprising derived and/or modified sequence from Homo sapiens__NP_006264.2__HsCCL7 (opt9)
gggagaaagcuuaccaugaaagccuccgccgcccuccuaugccuccuccucaccgccgccgcauucuccccccaaggccucgcccaaccagucggcauaaacaccuccaccaccugcugcuaccgauucaucaacaaaaaaaucccaaaacaacgacucgaauccuaccgccgcaccaccuccucccacugcccccgagaagccgucaucuucaaaaccaaacucgacaaagaaaucugcgccgacccaacccaaaaauggguccaagacuucaugaaacaccuagacaaaaaaacccaaaccccaaaacucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2255 - RNA, 3841 nt, Artificial Sequence
  mRNA product Design1 comprising derived and/or modified sequence from Homo sapiens__NP_001954.2__HsEGF (opt9)
gggagaaagcuuaccaugcucuuaacccuuaucauacuucuucccgucgucagcaaguucagcuuugucucacucagugcaccccaacacuggagcugccccgaaggaacacuugccggcaacggcaauagcacaugcguugggccggcucccuuccuaauauucagccacggaaacagcauauuccgaaucgacacagagggaaccaacuacgaacagcugguagucgacgcuggcguaagcgucaucauggacuuccacuacaacgagaagcgaaucuacuggguagaucucgaacgccaacuacugcaacggguauucuugaacggcucgcgacaggagcgcgucugcaauaucgaaaagaacgucucaggaauggcuaucaacuggauuaaugaagaggugauauggagcaaccaacaggagggaaucauaaccgucacagacaugaaggguaacaacucccacauccuucucagcgcgcucaaauacccugcaaaugucgccguggauccugucgaacguuuuauauucuggucaagugaaguagccggcucccucuacagagccgaccucgacgguguaggggucaaggcacuacucgaaacguccgagaaaauaacagcaguaucgcuggacguacucgacaaacgccuauucuggauucaguacaaccgagaaggcagcaacuccuuaaucugcaguugcgacuacgacggagguagcgugcauauaaguaaacacccaacgcagcacaaccuauuugccaugucacuguucggggaccgcaucuucuacagcaccuggaaaaugaaaacaauauggaucgcaaacaaacacaccggcaaggauaugguccgcaucaaccuacacucuucauucguaccccuaggggagcucaaaguagugcacccucucgcccaaccaaaagcagaggaugauaccugggaacccgaacaaaagcugugcaaacuccgaaagggcaacugcucgagcaccgucugcggacaagaccugcaaagccaccucugcaugugugcggaaggauacgcacucucacgagaccggaaguacugcgaggacgucaacgaaugcgccuucuggaaccacggaugcacucuuggauguaagaacaccccaggauccuauuacuguaccugcccagucggauucguacuacuaccagacggaaaacgaugccaccaacugguauccugcccccgaaacguauccgaaugcucccacgauugcguccuaaccucagaggggccccucugcuucugcccagagggauccguguuagaacgcgacggcaagacuugcagcggcugcagcagcccagacaacggcgggugcagccaacuaugcguaccacuaucaccaguuucaugggaaugcgacugcuucccggguuacgaccuccagcucgacgaaaaaucaugugcggccagcggaccacagcccuuccuccuauucgccaauucacaagacauccggcacaugcacuucgacggcaccgacuacgguacccuacugagccaacaaauggguaugguguacgcgcucgaccacgacccaguagaaaacaaaauauacuucgcccacacagcccucaaguggaucgaacgagccaacauggauggaucacaacgcgagcggcuaauagaggaagguguggacgugccagaaggccuggccguagacuggauaggccgcagauucuauuggacagacagagguaaaucacucaucggacgaucagaccucaacggcaaaagguccaaaaucaucacuaaagagaacauaucacaaccacgcggcauagccguccaccccauggccaaacgccucuucuggaccgacacgggcaucaacccaagaauagaguccagcagccuccagggccuaggaagacuuguaaucgcaucguccgaucucauuuggcccagcgggaucacaaucgauuuccuaacugacaaacucuacuggugcgacgccaaacaaaguguaaucgaaauggcaaaccucgacggaucgaaacgacggcgccucacccaaaacgauguuggccaucccuucgcaguagcagucuuugaggacuacgucugguucagcgacugggccaugcccuccguaaugcggguuaacaaacgcaccggcaaagaccgaguccgacuacaggguuccaugcuuaaaccgagcucccuaguuguaguacacccacuagcaaaacccggggccgaccccugcuuauaucaaaacggaggaugcgaacacaucugcaagaaacgccucggcaccgcaugguguagcugccgagaaggauuuaugaaagccuccgacggcaaaaccugucuggcccuagauggccaccaacuccuugcgggcggcgaaguagaccuuaaaaaccaagugaccccgcuagacauacucucaaaaacgcgcgucucagaagacaacaucacagaaagccaacacaugcucguagcagaaaucaugguaagcgaccaagacgacugcgcacccguaggaugcagcauguaugcacggugcauaagcgaaggagaagacgcgaccugccaaugccuaaaaggauucgccggagacgguaagcucugcucagauauugacgaaugcgaaaugggaguacccguguguccacccgccagcucaaagugcaucaacacugaaggaggcuacgucugcagaugcagcgagggcuaucaaggcgacggcauccauugccuagauauagacgagugccagcuaggcgagcacucgugcggcgagaacgcgucgugcacaaacacggaagguggcuauacaugcaugugcgccggaagacucagcgaaccgggucuaauuugccccgacagcaccccaccuccacaccuucgcgaagacgaccaccacuacuccguccgcaacucggacucagaaugcccccucagucaugauggcuacugcuugcaugacggcguuuguauguauaucgaagcccuagacaaguacgcaugcaacugcgucguagguuacaucggagagcgcugccaauaucgcgaccuaaaauggugggaacucagacacgcaggucacggucagcaacaaaagguuaucgucguagccguuugugucgugguccuagucaugcuccuucuccuaucgcucuggggcgcccacuacuacagaacccaaaaacuccuauccaaaaacccgaaaaaucccuacgaagaaucgaguagggacguacguucgcgacgacccgcagacacggaagacggcaugaguucgugcccccaaccaugguucguaguuauuaaggaacaucaagauuugaaaaacggcggacagccagucgccggagaggacggccaagcagcagauggauccaugcaacccacaucauggagacaagaaccccaacuaugcggaaugggaacggaacaaggcugcuggauuccagucaguuccgacaaaggcucaugcccacaaguaauggaacgaucguuccacaugccauccuacggaacccaaacacucgaaggcgguguagaaaagccacacagccuccucucggcaaacccccuauggcagcagcgcgcacuagacccuccccaucaaauggagcugacccaauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2256 - RNA, 727 nt, Artificial Sequence
  mRNA product Design1 comprising derived and/or modified sequence from Homo sapiens__NP_001423.1__HsEREG (opt9)
gggagaaagcuuaccaugaccgccggcagacgcauggaaaugcuaugcgccggccgaguccccgcacuccuacucugccucggcuuccaccuccuacaagccguccuauccaccacagucaucccaucaugcaucccaggcgaaagcucugacaacugcaccgcccuaguccaaaccgaagacaacccccgcgucgcccaagucuccaucacaaaaugcucauccgacaugaacggcuacugccuacacggccaaugcaucuaccucgucgacaugucccaaaacuacugcagaugcgaagucggcuacaccggaguccgcugcgaacacuucuuccucacaguacaccaaccucucuccaaagaauacgucgcccucaccgucauacucauuauccucuuccucaucaccguagucggcuccacauacuacuucugccgcugguaccgcaaccgcaaauccaaagaacccaaaaaagaauacgaacgcgucaccuccggcgaccccgaacucccccaaguauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2257 - RNA, 685 nt, Artificial Sequence
  mRNA product Design1 comprising derived and/or modified sequence from Homo sapiens__NP_000791.1__HsFGF1 (opt9)
gggagaaagcuuaccauggccgaaggcgaaaucacaaccuucaccgcccucaccgaaaaauucaaccucccccccggcaacuacaaaaaacccaaacuccuauacugcuccaacggcggacacuuccuccguauacuccccgacggcacagucgacggcacccgagaccgcucugaccaacacauccaacuccaacucucagccgaaucagucggcgaagucuacauaaaauccaccgaaacaggccaauaucucgcaauggacaccgacggccuucucuacggcucccaaacccccaacgaagaaugccucuuccucgaacgccuagaagaaaaccacuacaacacauacaucuccaaaaaacacgcagaaaaaaacugguucguaggccucaaaaaaaacggcuccugcaaacgcggcccccgcacccacuacggccaaaaagccauccucuuccucccccuacccgucucauccgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2258 - RNA, 1084 nt, Artificial Sequence
  mRNA product Design1 comprising derived and/or modified sequence from Homo sapiens__NP_001997.5__HsFGF2 (opt9)
gggagaaagcuuaccaugguagggguaggaggaggggauguagaagaugugacgccaaggccaggagggugucaaauaagcggaagaggggcaagaggcuguaacgggauaccgggggcagcggcgugggaggcagcgcugccgagaagacgaccacgaaggcauccgagugugaacccgcggucaagagcggcagggagcccgagaacgagagggagaagaacagaggaaaggccaaguggaaguagauuaggggauaggggaagagggagggcgcuaccgggagggagauugggagggcgagggagagggagagcgccagagaggguaggagggcgggggcgggggagggggacagcggcgccgagagcggcaccagcagcgagagggagcaggccagggccggcggggacgauggcggcgggaagcauaacaacacugccggcguuaccggaggacggagggaguggggcguucccgccagggcacuuuaaagauccaaagagguuguauugcaaaaacggaggguucuuucugaggauacauccagaugggagaguagauggaguaagggagaaaucggacccacacauaaaacugcaauugcaagcagaagagagagggguagugagcauaaaaggggugugugcaaacagauaccuagcgaugaaggaagauggaagacuguuagcgucgaaauguguaacggacgagugcuuuuucuuugaaaggcucgagagcaauaacuauaacacauacaggagcaggaaguauacaucaugguauguagcacucaagagaacgggacaauacaagcuagggagcaagacggggccggggcaaaaggcaauacuauuucuaccgaugucggcaaagagcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2259 - RNA, 802 nt, Artificial Sequence
  mRNA product Design1 comprising derived and/or modified sequence from Homo sapiens__NP_002000.1__HsFGF7 (opt9)
gggagaaagcuuaccaugcacaaauggauccucaccuggauccuacccacccuccuguaccgcagcugcuuccacaucaucugccucgucggaaccauaucccucgccugcaacgacaugacccccgaacaaauggccacaaacguaaacugcagcucccccgaacgccacacccgcuccuacgacuacauggaaggcggagacauccgcguacgccgccuauucugcagaacccaaugguaccuacgcauagacaaaagaggcaaagucaaaggcacacaagaaaugaaaaacaacuacaacaucauggaaauccgcaccgucgcagucggaaucguagccaucaaaggagucgaaagcgaauucuaccuagccaugaacaaagaaggcaaacuauacgccaaaaaagaaugcaacgaagacugcaacuucaaagaacuaauccucgaaaaccacuacaacaccuacgccuccgccaaauggacccacaacggcggcgaaauguucguagcccucaaccaaaaaggaauacccguccgcggaaaaaaaaccaaaaaagaacaaaaaaccgcccacuuccuccccauggccaucaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2260 - RNA, 844 nt, Artificial Sequence
  mRNA product Design1 comprising derived and/or modified sequence from Homo sapiens__NP_001936.1__HsHBEGF (opt9)
gggagaaagcuuaccaugaaacuccuccccuccgucguccucaaacucuuccuagccgcaguccucuccgcacucgucaccggcgaaucccucgaacgacuccgacgcggccuggccgcaggcaccuccaaccccgacccaccaaccgucucaacagaccaacuacuaccccucggcggaggccgcgacagaaaaguccgcgaccuucaagaagcagaccucgaccuccuccgagucacccucuccagcaaaccccaagcccucgccacacccaacaaagaagaacacggaaaacgcaagaaaaaaggcaaaggccucggcaaaaaacgcgaccccugccuacgcaaauacaaagacuucugcauccacggggaaugcaaauacgucaaagaacuacgcgcccccucaugcauaugccaccccggcuaccacggcgaacgcugccacggccucucccuccccguagaaaaccgacucuacaccuacgaccacaccaccauccucgccgucgucgccgucguccucuccuccguaugccuacucgucaucguaggccuccuaauguuccgcuaccaccgccgaggcggcuacgacgucgaaaacgaagaaaaagucaaacucggaaugaccaacucccacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2261 - RNA, 2404 nt, Artificial Sequence
  mRNA product Design1 comprising derived and/or modified sequence from Homo sapiens__NP_000592.3__HsHGF (opt9)
gggagaaagcuuaccaugugggucacgaaacuccucccagcacuacuacuacaacacguccuauuacaccuccuccuccuacccauagcaauacccuacgcggaagggcagcgaaaaagacgcaacacgauccacgaguucaagaaguccgcaaaaacaacccuaaucaaaauagaccccgcccucaaaaucaaaaccaagaaagucaauaccgcagaccaaugcgcaaaccgcugcacacgcaacaaaggccucccauuuaccugcaaagccuucguuuuugacaaagccagaaagcaaugccuuugguucccauucaacagcaugagcuccggcgucaagaaagaguucggacacgaguucgaccuguacgaaaacaaagacuacauccgaaacugcauaaucggcaaaggccgcagcuacaaaggaacagucuccauaaccaaaucaggcaucaaaugccagccuuggagcuccaugauaccccacgaacacucauuccucccgucaagcuaccgagggaaagaccuacaagaaaauuacugccgaaacccacgcggggaagaaggcggacccuggugcuucaccucaaacccagaaguccgcuacgaaguaugcgacaucccccaaugcucagaaguugaaugcaugaccugcaauggagaaagcuacagagggcucauggaccacaccgaaagcggcaaaauaugccaacgaugggaccaccaaacaccacaccgacacaaauuccuccccgaacgauacccggacaaaggguucgaugacaacuacugccguaaccccgacggccagccacgcccauggugcuacacacuagacccacacacucgcugggaauacugugcaaucaaaacaugcgccgacaauaccaugaacgacacagacgucccccuggaaacaaccgaaugcauccaaggccaaggugaaggcuaccgcggcacggucaauaccauauggaacggcauacccugccaacgaugggacagccaauacccgcacgaacacgacaugacaccagaaaacuucaaaugcaaagaccuucgggaaaacuacugccgaaaccccgacggauccgaaagccccuggugcuucacaaccgaccccaacauccgcguaggauacuguucacaaaucccaaacugugacaugagccacggacaggacugcuacagagguaacggcaaaaacuacaugggcaaccucucccaaacacgauccggacugaccugcagcaugugggacaagaacauggaagaucuccauagacacaucuucugggaaccagacgcaagcaaauuaaacgaaaacuacugccgaaaccccgacgacgacgcccacggccccuggugcuacacaggaaacccucugauucccugggauuauugucccaucucccgcugcgagggcgacaccacccccacaaucgugaaccuagaccaccccguaauaucaugcgcaaaaacgaaacagcuccgaguugugaacggcauaccaacuagaacuaacaucggcuggauggucucacuacgauaccguaacaaacacaucugcggagguucgcuaauaaaagaaagcuggguccucaccgcacgccaaugcuuccccagccgggaucugaaagacuacgaagccuggcugggaauacacgacguccacgguagaggagacgaaaaaugcaaacagguccucaacguaucccaacucguauacggcccggagggcagugaccucguacucaugaaacuagcccgacccgccguccuugacgacuucguauccaccauagaccuccccaacuacggcugcaccaucccagaaaagaccagcugcagcgucuacggauggggauacaccggccuaauaaauuacgacgggcuacuccgcgucgcccaccuguacaucaugggcaacgaaaaaugcucccagcaccacagaggcaaaguaacccuaaaugaaagcgaaauaugcgcaggggccgagaaaaucggcaguggcccaugcgaaggcgacuacgggggcccccuaguaugcgaacaacauaaaaugcgcaugguccucggagugaucguccccggacgaggcugcgcgaucccaaaucgcccaggcaucuucguccgcguggcuuacuacgccaaauggauacacaaaauaauacuaaccuacaaaguaccccaaagcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2262 - RNA, 2143 nt, Artificial Sequence
  mRNA product Design1 comprising derived and/or modified sequence from Homo sapiens__NP_005336.3 __HsHSPA1A (opt9)
gggagaaagcuuaccauggcuaaagcggcggcaaucggaauagaccucggaaccaccuacucaugcgugggcguuuuucagcacggcaaaguagaaauaauagcaaacgaucaaggaaacaggacaacucccucguacguggcauuuacagacacagagagacugauuggggacgccgccaaaaaccaagucgcacugaacccccagaacacaguuuucgacgcgaaaaggcucauaggacgaaaauucggagacccagugguccaaagugacaugaagcacuggccauuccaagugauaaaugacggcgacaaacccaagguacaagucucguacaaaggcgaaaccaaggcauucuacccagaagagauaucguccaugguccucacaaagaugaaagaaauagccgaagccuaccucggguacccagucacaaacgcggucauaaccguacccgcguacuucaacgacagccaacgacaagcgacaaaagacgccggagucauagcaggccucaacguacugcgcauaaucaacgaaccgaccgcggcagccauagccuacgggcuagaccgcacaggaaaaggggagcgcaacgucuuaaucuucgaccuaggcggaggcacauucgacgucucaauacuaaccauagacgacggcaucuucgaaguaaaagccacagccggggacacgcaccuaggcggcgaagacuucgauaaccgccuaguaaaccacuucguagaagaguucaagagaaagcacaagaaagacauaagccaaaacaaacgggccgugcgcaggcuaaggaccgcaugcgaacgcgcaaaacgaacccucagcucaaguacccaagcaagccuggaaaucgacagucucuucgaaggaauagacuucuacaccuccaucacccgagcgcgauucgaagaacuaugcagcgaccuauuccgcucgacacuggaaccgguggaaaaagcacucagagacgcgaagcuagacaaagcccaaauccacgaccuaguauuggugggaggcaguacaagaaucccaaaaguacaaaagcuccuacaagauuucuucaacggaagggaccucaacaaauccaucaaccccgacgaagcaguggccuacggggcagcaguccaggcagccauacugaugggagacaaaagcgaaaacgugcaagaccuacuccuccuggacguagccccacuaagccuaggacucgaaacagccggaggaguaaugacagcacugauaaaaaggaacagcaccauccccacgaaacaaacccaaaucuucacaacguacucagacaaccaacccggagugcuaauacaaguauacgaaggcgagcgcgcaaugacuaaagacaacaaccuccugggcagguucgagcuaucaggaauaccaccggcaccacggggagucccgcaaauagaagugaccuucgacauagacgccaauggcauacuaaacguaaccgcaaccgacaaaucuaccgggaaagcaaacaagauaacgaucacgaacgauaaagggcgcuuaagcaaggaagaaaucgaacgcaugguccaagaagcagaaaaauacaaagccgaggacgaaguacaacgcgaaagagugagcgcgaaaaacgcacuagaaucauacgcguucaacaugaaaagcgcagucgaagacgaaggccucaaagggaaaauauccgaggccgauaaaaagaaaguacuagacaaaugccaagaagucauaagcuggcuagacgccaacaccuuagccgaaaaagacgaguucgaacacaaaaggaaagaacuggaacaaguaugcaaccccauuauauccggccuauaccaaggagcuggaggaccgggacccggcggauucggagcccaaggccccaaaggaggaagugggagcgggcccacgauagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2263 - RNA, 2143 nt, Artificial Sequence
  mRNA product Design1 comprising derived and/or modified sequence from Homo sapiens__NP_005337.2 __HsHSPA1B (opt9)
gggagaaagcuuaccauggcgaaagccgcagccaucggaauagaccucggcaccaccuacucaugcgucggcguauuccaacacgggaaaguagagaucaucgcaaacgaccaaggaaacaggaccacaccaucauacguagccuucacagacaccgagcgccuaaucggagacgccgccaagaaccaaguugcgcucaacccacaaaacacagucuucgacgcaaaacgacugauaggccgaaaauucggcgacccagugguccaauccgacaugaagcacuggccauuccaaguaaucaaugacggagacaaacccaaaguacaggucagcuacaaaggagaaacaaaggccuucuacccagaagaaauaagcucaaugguccugaccaaaaugaaagaaauagcagaggcuuaccucggcuaccccguaacaaacgcggucaucaccguacccgcauacuucaacgacagccaacggcaagccacgaaagacgccggagucauagcaggccuaaacguacuccgcauuauaaacgaaccaaccgccgccgccaucgcauacggacucgaccgaacaggcaagggcgagagaaacguacugaucuucgaccucggaggaggaacauucgacgucaguauacucacgaucgacgacggaauauucgagguaaaggcaacggcuggagacacacaccuaggcggagaagacuucgacaacaggcuugucaaccacuucgucgaagaguucaaacgaaaacacaagaaagacauaagccaaaacaaaagggccguccguagacuaagaaccgccugcgaaagagcgaaaaggacacucagcuccucaacccaagcaagccuagaaauagacucacuauucgaaggcaucgacuucuacaccucgaucacccgugcacguuucgaagaacuaugcagcgaccucuuccgcucaacccuagaacccguagaaaaagcacuacgagacgcgaaacuagacaaagcgcaaauacacgaccugguccuaguaggaggcucaacaagaauaccuaaaguacaaaaacucuugcaagauuucuucaauggccgcgaccucaacaaaagcauaaacccagacgaagccgucgcauauggagccgcggugcaggcagcaauccuaaugggagacaaaagcgaaaacgugcaagaccugcugcuccuagacguagcaccacucucacuuggccucgaaaccgcaggaggcguaaugacugcacuuaucaaaaggaacucgaccauacccaccaaacagacacaaaucuucacuacauacucggacaaccagcccggaguccuuauccaaguauacgagggcgaacgcgcgaugacaaaagacaacaaccuacucggaagauucgaacucucaggaauaccaccagccccacgcggcgucccacaaaucgaaguaacauucgacaucgacgcgaacggaauauuaaacgucacagccacagacaaaucgaccggaaaagcaaacaaaauaacaaucacaaacgacaaaggccgacuuaguaaagaagaaaucgagcgaauggugcaagaagcggagaaauacaaagcagaagacgaaguacaaagagagcgaguauccgccaagaacgcccucgaaucauacgccuucaacaugaaaagcgcggucgaagacgaaggccuaaaggggaagauaagcgaagcagacaagaagaaaguacuagacaaaugccaagagguaaucagcuggcuagacgcaaacacccucgcugaaaaagacgaguucgaacacaaacgaaaagaacucgagcaagucugcaaccccauaaucucgggccucuaucagggagcgggaggacccggcccagggggcuucggagcgcaaggacccaaaggcggcagcggaagcggccccacaaucgaagaaguagacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2264 - RNA, 2143 nt, Artificial Sequence
  mRNA product Design1 comprising derived and/or modified sequence from Homo sapiens__NP_005518.3 __HsHSPA1L (opt9)
gggagaaagcuuaccauggccacagccaaggggaucgcaaucggcaucgaccuaggaaccacauauuccugcguaggagucuuccagcacggcaaaguggaaauaaucgcaaacgaucaaggcaacagaacaaccccaagcuacguagcauucaccgacacagagagacugaucggcgacgccgcgaaaaaccaaguggcaaugaacccacagaacaccgucuucgacgccaaacggcucauaggcagaaaauucaacgaccccguaguacaagccgacaugaaacucuggcccuuucaagucauaaacgaaggcggaaagcccaaaguccuaguaagcuacaaaggcgaaaacaaggccuucuaccccgaagaaaucucgagcaugguccucaccaagcugaaggaaacagcagaagccuuccuaggccacccaguaacaaacgccguaauaacagugccagcauacuucaacgacagccaacgacaagcgaccaaggaugcggguguaauagcgggccucaacguccuacgaaucauaaacgaaccuacagcggccgccaucgccuacggacuggacaaaggaggccagggagaaagacacguacugauauucgaccuaggaggcggcaccuucgacgucucaauacugaccaucgacgauggcaucuucgaaguaaaagccacugcaggcgacacccaccucggcggcgaagacuucgacaaccggcucgucagccauuucgucgaagaauuuaaaaggaaacacaagaaagacaucucccagaacaaaagagcagucagacgacuucggaccgcgugcgaacgcgcaaaacgcacgcuaagcagcaguacacaagcaaaccuagaaaucgacucccuuuacgaaggaaucgacuucuacacaucaaucacccgcgcaagguucgaggagcucugcgccgaccucuuccguggcacccuagaacccgucgaaaaagcacuccgcgacgccaaaauggacaaggcaaaaauacacgacaucguacucgucgggggcucaaccagaauccccaagguccagcgccuacuacaagauuacuucaacggacgagaccucaacaaaagcauaaauccagacgaagcggucgcguacggcgcagcaguacaggccgcgauccuaaugggggacaaaagcgaaaaaguccaagaccuccuccugcuagacguagcaccgcuuucccuaggccuagaaacagccggagguguaaugaccgcccuaaucaaacgcaacagcacaauacccaccaaacaaacccaaaucuucaccacauacagcgacaaccagccgggcguccucauacagguuuacgaaggcgaacgcgcaaugacaaaagacaacaacuuacuaggacgauucgaccugaccggcaucccaccagcacccagaggcgucccccaaauagaaguaaccuuugacauagacgccaacggcauacuaaacguaacagccacagacaaaaguacgggcaaagucaacaaaaucaccauaaccaacgacaaaggcaggcucucaaaagaagaaaucgaacggaugguccuagacgcagaaaaauacaaagcagaagacgaaguacagcgagagaaaauagcggccaaaaacgcacucgaaagcuacgccuucaacaugaaaagcguuguauccgacgaaggauuaaaaggaaaaauaagcgaaagcgacaaaaacaaaauacucgacaaaugcaacgaacuccuguccuggcuggaaguaaaccaacucgccgaaaaagacgaguucgaccacaaacgaaaagaacucgaacaaaugugcaaccccauaaucaccaaacuguaccaaggcgguugcaccggaccagccugcggaaccggcuauguacccggacgcccagcgacaggcccaaccaucgaagaggucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2265 - RNA, 2137 nt, Artificial Sequence
  mRNA product Design1 comprising derived and/or modified sequence from Homo sapiens__NP_068814.2 __HsHSPA2 (opt9)
gggagaaagcuuaccaugagcgcacgcggccccgcaaucgggaucgaucuaggcaccacauacucgugcguaggcguauuccaacacgggaaagucgaaaucaucgcaaacgaccaaggaaaccgcaccacccccagcuacguagccuucaccgacaccgaacgacucaucggagacgcagccaaaaaccagguagcaaugaacccaaccaacacaaucuucgacgcaaaaaggcugauaggccgaaaauuugaggacgccacgguccaaagugacaugaaacauuggcccuuccgcguaguauccgaaggaggcaaacccaaaguccaaguagaauacaagggcgagaccaagaccuucuucccggaagaaauauccagcaugguccugaccaaaaugaaagaaauagccgaagccuaccuugggggaaaaguccacagcgccgucauaaccguuccagccuacuucaacgacagccaacggcaagccacgaaagacgcaggcacaauaacaggacucaacguccuucgaauaauaaacgaaccaaccgcagccgcgaucgcauacgggcucgacaaaaaggggugugcagggggcgagaaaaacguguuaauauuugaccuaggcgggggcaccuucgacguaagcauccucaccauagaagacggcauauuugaagucaaaagcaccgccggagacacacaccugggaggagaagacuucgacaaucggaugguaagccaccucgcagaagaguucaagcgcaagcacaagaaagacauugggccaaacaaaagggccgugcgacgccucagaaccgcaugcgaacgcgcaaaacgcacccugagcucaaguacgcaagcaagcaucgaaauugacagucuguacgaaggaguagacuucuacacaucaauaacacgagcacgcuucgaagaacucaacgccgaccucuuccgcggaacacuagaacccgucgaaaaagcacuccgggacgcaaaacuggacaaaggccaaauccaagaaauaguacucgucgggggauccacccgaauaccaaagauacagaaacuacugcaagacuucuucaacgggaaagaacuaaacaagucgauaaaccccgacgaagcaguagcguacggcgccgccguacaagccgcgauccugauaggagauaaaagugaaaacgugcaagaccuacugcuccuggacgucacgccccuaucacucgggaucgaaaccgcuggcggaguaaugacaccccucauaaaaaggaacaccaccauaccaaccaaacaaacccaaacauucaccaccuacucggacaaccaaucaucugugcuaguacaaguauacgaaggcgaacgggcuaugacgaaagacaacaaucuacuagguaaguucgaccuaacaggcauacccccggcaccccgaggaguaccacaaauagaaguaaccuucgacaucgaugcaaacgggauacuaaacguaaccgcagccgacaaaucgaccggaaaagaaaacaaaaucacaaucacaaacgacaaaggacgccucagcaaagacgacauagaccgaaugguucaggaagcagagagguacaagagcgaagacgaagcgaaccgagaccgaguggcggccaaaaacgcacuggaaagcuacaccuacaauauaaaacaaacaguugaagacgaaaaacuccguggaaagaucagcgaacaagacaaaaacaaaauacuagacaaaugccaagaagucauaaacuggcuggaccgaaaccagauggccgaaaaagaugaauacgaacacaaacaaaaagagcuagagcgcguaugcaaccccauaaucucgaaacuguaccaaggcggaccaggaggaggaagcggaggaggaggaucgggcgcaagcggcggcccgacaaucgaagaggucgacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2266 - RNA, 2740 nt, Artificial Sequence
  mRNA product Design1 comprising derived and/or modified sequence from Homo sapiens__NP_002145.3 __HsHSPA4 (opt9)
gggagaaagcuuaccaugagcguaguaggcaucgaccuaggguuucagagcugcuacgucgcagucgcaagagcggguggcauagaaacaauagcaaacgaauacagcgacagaugcacccccgcaugcaucucguuuggccccaaaaauagaagcauuggagcugcagccaaaagccaagucaucagcaacgcgaaaaacacgguacaaggcuucaagcgguuucacggaagggcauucagcgaccccuucguugaagcggagaaguccaaccuagcguacgacaucguccaacuacccaccggacugaccgguauaaaaguaacauacauggaagaagaaaggaacuuuacaacagaacaaguaaccgccaugcuccucagcaaacuaaaagaaacagcagaauccguccucaagaaacccgucgucgacugcgucgugucgguccccugcuucuacaccgaugcagaaaggcgcucagucauggacgcgacgcagauagcggggcucaacugccuacgccuaaugaacgagacgacagcagucgcccucgccuacggcaucuacaaacaagaccuucccgcacuagaagaaaaaccccgaaaugucgucuucgucgacaugggacacucagcauaccaaguaucuguaugcgcguucaaccgaggcaaacuuaaagugcuggccaccgccuucgacacaacacucggcggccggaaauucgacgaaguccuaguaaaucacuucugcgaagaguucggcaagaaauauaaacuagauauaaaauccaaaauacgcgcccuccugcgcuugagccaggaaugcgaaaaacucaaaaagcuaaugagcgcaaacgcgucagaccugccacugagcauagaaugcuucaugaacgacguagacguauccggaaccaugaaccggggaaaauucuuagaaaugugcaacgaccuccuagcacgcguugaacccccucuaagaucugugcuggaacaaacaaaacugaagaaagaagacaucuacgcaguagaaaucgucggaggggcaacucgaauaccggccgucaaagagaaaaucagcaaauucuucgggaaggaacucagcaccacccugaacgcagacgaagcgguaaccaggggcugcgcgcuccaaugcgccauacugucaccagccuucaaaguacgagaguucagcauaacagacguggucccauacccaauaagccuccgauggaacucaccagcagaagaaggcucgagcgacugcgaaguauucagcaaaaaccacgcagcaccauucuccaaaguccucacguuuuaccggaaagaaccguucacccucgaggcauacuacuccucaccccaagaccuccccuaccccgacccagccaucgcacaauucagcguccaaaaggucacuccccagagcgacggcaguagcagcaaagucaaagucaaaguccgcgucaacguacacgggaucuucagcguaucaucagccagccucguggaaguccacaagagcgaggaaaacgaggaaccaauggagaccgaccaaaacgccaaagaagaagagaaaaugcaagucgaccaggaagaaccccacguagaagaacagcagcagcaaacccccgcggaaaacaaagcagaauccgaagaaauggaaaccucgcaagccggcaguaaagacaagaaaauggaccaaccaccccaagcaaagaaagcaaaaguaaaaacguccacaguagaccugccaauagagaaccaacuacuuuggcaaauagaccgagaaaugcuaaacuuauacaucgagaacgaagggaaaaugaucaugcaagauaaacuagaaaaagaaagaaacgaugccaaaaacgcagucgaagaguacguuuacgagaugcgggacaaacuaagcggcgaguacgagaaguucgucuccgaggacgaccgcaacagcuucacacugaaacucgaagacaccgaaaacuggcuauacgaagacggcgaagaccaaccaaagcaaguauacgucgacaagcucgcggaacucaaaaaccucggccaaccaauaaaaauccgguuccaagaaagcgaggagagaccaaagcuauucgaagaacucggaaaacaaauccagcaauacaugaaaauuauaucaaguuucaaaaacaaagaagaucaauacgaucaucuggacgccgcagacaugacaaaaguagaaaaaucgaccaacgaagcaauggaauggaugaacaacaaauuaaaucugcaaaacaaacaaagccuaaccauggaccccguaguaaaaucaaaagagaucgaagccaaaaucaaagaacucaccuccacaugcagccccaucauaagcaaacccaagcccaaagucgaaccacccaaagaggaacagaaaaacgcagaacaaaacggccccgucgauggacagggcgauaaccccggaccgcaagccgccgaacaaggcacggacacagccgugcccucagacagcgacaagaaacuaccagaaauggacaucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2267 - RNA, 2737 nt, Artificial Sequence
  mRNA product Design1 comprising derived and/or modified sequence from Homo sapiens__NP_055093.2 __HsHSPA4L (opt9)
gggagaaagcuuaccaugucagucgucggaauagaccucggauuccucaacugcuacauagccguagcacgcuccggagguauagagacaaucgccaaugaguacuccgacagguguacccccgcgugcaucagccugggcucccgcacucgcgccaucggcaacgcggcgaagucccaaaucgucaccaacgucagaaacacaauccacggauucaagaaacuccacggacgauccuucgacgaccccauaguccaaaccgagcgcauacgccugcccuacgaacuacagaaaaugccaaauggcagcgccggcguaaaaguccgcuaccucgaggaggaacgccccuucgccaucgaacaagucacaggcaugcuauuagcaaagcucaaagagaccuccgaaaaugcacucaagaaacccguggcagacugcguaaucagcauuccguccuucuucacagacgcagagcgacggucagucauggcagccgcacaagucgccggccugaacugucuccgacugaugaaugagacaacggccgucgcccucgcauacggcaucuacaaacaagacuuaccuccgcucgacgaaaaaccgagaaacgucgucuucaucgacaugggacacagcgcauaccaaguccucguaugugcauucaacaaaggaaaacuaaaaguucuugccaccacauucgauccauaccucggaggccgcaacuucgacgaagcacucguugacuacuucugugacgaguucaaaacaaaauacaaaauaaacgucaaagaaaacagccgcgcccuucuccgucuauaccaggagugcgaaaaacucaagaaacucaugagcgccaacgccagcgaucucccacuaaacaucgaauguuucaugaacgaccuggacgugaguuccaaaaugaaccgugcccaauucgagcaacucugcgccagcuuacuagcaagaguagaaccaccacucaaagcggucauggagcaagccaaucuccaacgggaagacaucagcuccauagagaucgucgggggagcaacccgaauacccgcuguaaaagaacaaauaacuaaauucuuccuaaaagacauaagcacaacccugaacgccgacgaagcagucgcccgaggcugcgcacuccagugcgccauacucucccccgcguucaaaguacgcgaguucaguaucacagaccucguaccauacucaaucacccuacgcuggaagacaucuuucgaagacggcuccggagaaugcgaagucuucugcaaaaaucaccccgcccccuuuuccaaagucaucacauuccacaaaaaggaaccguucgaacucgaagcguuuuacacgaaccuccacgagguaccauaccccgacgcgagaauaggaucauucaccauacaaaacguauucccacaauccgacggcgauucauccaaggucaaagucaaaguaagagucaacauacacggcaucuuuucagucgccagcgccagcgugauugagaaacaaaaccuugaaggcgaucacagcgacgcccccauggaaaccgaaacgagcuucaagaacgaaaacaaggacaacauggacaagaugcagguagaccaagaggaaggacaccaaaaaugccaugcagaacacacacccgaggaagaaaucgaccacaccggagccaaaacgaagucugccgucagcgauaagcaggaccgucucaaccaaacccucaagaaaggcaaaguaaaaagcauagaccuaccaauccaaagcucacucugccgccaacucgggcaagaccuccuaaacuccuacauagaaaacgaaggcaaaaugaucaugcaagauaaacuagaaaaagaacgcaacgacgccaaaaacgcagucgaagaauacgucuaugacuuccgagaccggcucggaaccgucuacgaaaaauucauaacccccgaggaccuaucaaaacuaagcgcuguccuagaagacaccgagaacuggcuauacgaagacggagaggaccaaccaaaacaaguauacguagacaagcuccaggagcucaagaaauacggccaacccauccagaugaaauacauggagcaugaagaaagacccaaagcacucaacgaccucggcaagaaaauccagcucguuaugaaaguaauagaagccuaccgaaacaaagacgagcgcuacgaccaccuagacccaaccgaaauggaaaaagucgaaaaaugcaucagcgaugccaugagcuggcucaacuccaagaugaacgcgcagaacaaacuaucccucacccaagaccccguaguaaaaguaucagaaauagucgcaaaaucgaaagaacuggacaacuucugcaacccaaucaucuacaagccgaaaccuaaagcagaggugccagaagacaaaccaaaagcaaauagcgaacacaacggaccaauggacgggcaauccggaacagaaaccaaaagcgauagcacaaaagacucaucccagcacacaaaaagcucaggggaaauggaggucgacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2268 - RNA, 2182 nt, Artificial Sequence
  mRNA product Design1 comprising derived and/or modified sequence from Homo sapiens__NP_005338.1__HsHSPA5 (opt9)
gggagaaagcuuaccaugaaacuaagccuaguagcggcaaugcuccugcucuuaagcgccgcaagagcagaagaagaggacaagaaagaggacgucggcaccgucgucggcauagaccuaggcaccacguacagcugcgucgggguauucaaaaacggaagagucgaaaucaucgccaacgaccaaggcaacagaaucacacccagcuacguagccuucacccccgaaggagaacgccucauaggagacgcggccaaaaaccaacucaccagcaacccagagaacacaguauucgacgcaaaacggcuaaucggccggaccuggaacgaccccagcguccaacaagacauaaaauuccuccccuucaaggucgucgagaagaaaacaaaaccauacauucaagucgacauaggaggaggucaaacgaaaacauucgcacccgaggagauaagcgcaaugguacucaccaaaaugaaagaaaccgcagaagcauaccuuggaaagaaagucacgcaugccgucgucacagucccagccuacuucaacgacgcacaaagacaggcgaccaaagacgccggcacaaucgcaggacugaacguaaugcgcauaaucaacgagcccaccgccgcagccaucgcuuacgggcuagacaaacgagaaggagagaaaaacauccucguguucgaccuaggaggaggcacauucgacgucagccuccuaacaaucgacaacggaguguucgaagucguagccaccaacggcgacacgcaccucggaggagaggauuucgaccaaagaguaauggaacacuuuaucaaacuauacaaaaagaaaacaggcaaagacguacgaaaagacaacagagccgugcaaaaacuucgacgugagguagaaaaagccaaacgagcacugucgagccaacaccaagcaagaauagaaaucgagagcuucuacgaaggcgaagacuucagcgaaacccucacucgagcaaaauuugaagaacuaaacauggaccucuucagaagcacaaugaagccaguacagaaggugcucgaagacucagaccucaagaaaagcgauauagacgaaaucguccucgucgggggcagcacccggauaccgaaaauccaacaacucgucaaagaguucuucaacggaaaagaaccuagccguggaaucaacccagacgaagccgucgcguacggagccgcgguccaggcaggcguccuaucaggcgaucaagacacaggcgaccucguccuacuagacgugugcccacuaacacucggaaucgaaaccgugggcggagucaugaccaaacuaauaccccgcaacacagucguucccacgaagaaaagccaaauauucagcacggccucagacaaccagcccaccguaacaaucaaagucuacgaaggggaacgcccacucaccaaagacaaccaccuccugggcacguucgaucugacaggcauaccacccgcgccccgcggagucccgcaaaucgaaguaacauucgaaauagacgugaacgggauacugcgcgucacagccgaagacaaaggaaccggaaacaaaaacaaaaucacaauaacaaacgaccaaaaccgccuaacaccagaagaaauagaaagaaugguaaacgacgccgaaaaauucgcagaagaggacaagaaacuaaaagaacgcauagacacccgaaacgaacucgaaucauaugcauacucccucaaaaaccagaucggcgacaaagaaaaacuagggggcaaacugagcuccgaggacaaggaaacaauggaaaaagcaguagaggagaaaaucgaauggcuggaaagccaucaagacgcagacauagaggacuucaaagccaagaagaaagaacuugaagagaucguacaaccaauaaucucaaaacucuacggcucggcaggaccaccaccgacaggagaagaagacacggccgaaaaagacgaacuguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2269 - RNA, 2149 nt, Artificial Sequence
  mRNA product Design1 comprising derived and/or modified sequence from Homo sapiens__NP_002146.2__HsHSPA6 (opt9)
gggagaaagcuuaccaugcaagccccaagagaacuagccguggggaucgaccucgggacaacauacuccugcguaggcguguuccaacaaggaagagucgaaauauuagcaaacgaccaaggcaacaggaccacaccaucguacguagcguucacagacacagaacgccuagugggagacgcagcaaagucgcaagcagcacuaaauccacacaacacggucuucgacgcaaagaggcuaauaggaaggaaguucgccgacacaaccguucaaagcgauaugaagcacuggccauucagagucgucucggaaggagggaaaccaaaagugcgggucugcuacagaggcgaagacaaaacauucuacccagaagagaucuccagcaugguacugagcaaaaugaaggaaacagccgaagccuaccucggccaaccagucaagcacgcggucauaaccguacccgccuacuucaaugacagccagcgccaagccacaaaagacgccggggcaauagccggacuaaacguacuacgaaucaucaacgaacccacggcagcagcgauugcauacggccuagaccgaaggggcgccggagaacgcaauguccugauauucgaccugggagggggcacauuugacgucuccguacuaucaauagacgcaggaguauucgaagugaaagcgacggcaggagacacgcaccuaggcggcgaagacuucgacaaccgucuagugaaccacuucauggaagaguucaggcgaaaacacggaaaagaucucagcggaaacaaacgcgcacuccgcaggcuaagaaccgcaugcgaacgcgcaaaaaggacccuaagcuccucgacacaggccacccucgaaauagacucccuauucgaaggagucgacuucuacacaagcaucacccgcgcgcgauucgaagaacuaugcagcgaccuuuuccgcucaacccuagaaccagucgaaaaagcucuccgcgacgcaaaauuagacaaagcacaaauccacgaugucguccuaguaggcggcucaacgcgcauaccaaaaguacaaaagcuccugcaagacuucuucaacgggaaagaacuaaacaaauccauaaaccccgacgaagcggucgccuacggcgcggcgguacaagcagcgguccugaugggcgacaagugcgaaaaagugcaagaccuacuacuccucgacgucgccccauuaagccucggacuggagacggcaggaggaguaaugacaacacuaauccagcgaaacgcgaccauacccacaaagcaaacccaaaccuuuaccacguacucagacaaccaaccgggagucuucauccaaguauaugagggcgaacgcgcaaugacaaaagacaacaaccucuugggccgcuucgaacucuccggcaucccacccgcgccccgaggcguaccgcaaauagaagugaccuucgacauagacgccaacgggauacuaagcguaaccgcgacagaccggucaaccggcaaagcgaacaaaaucacaaucaccaacgacaaaggacggcuaagcaaagaagaaguagaacgcaugguccacgaagccgaacaauacaaagccgaagacgaagcccaacgugaccgcgucgcagcgaaaaacucacucgaagcccacguguuccacguuaaaggaucccuccaagaagaaagccugcgcgacaagauacccgaagaagaccggagaaaaaugcaggacaaaugccgugaaguacucgccuggcucgaacacaaccaacuagccgaaaaagaagaauacgagcaucaaaaacgagaacuggaacaaauuugcagacccauauuuucgagacuguacgggggcccaggcgucccaggaggcucaagcugcggaacccaagccagacaaggagaccccagcacaggaccaaucauagaggaaguagacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2270 - RNA, 1321 nt, Artificial Sequence
  mRNA product Design1 comprising derived and/or modified sequence from Homo sapiens__P48741__HsHSPA7 (opt9)
gggagaaagcuuaccaugcaagcaccccgcgaacucgcaguaggcaucgaccuaggcaccaccuacuccugcguaggcgucuuccaacaaggccgcguagaaauacucgccaacgaccaaggcaaccgcaccacccccuccuacgucgcauucaccgacaccgaacgccucguaggcgacgccgcuaaaucccaagccgcccuaaacccccauaacaccgucuucgacgccaaacgacucaucggccgaaaauucgcagacaccaccguacaauccgacaugaaacacuggccuuuccaagucguaucagaaggaggaaaaccaaaaguccgcgucugcuaccgcggagaagacaaaacuuucuaccccgaagaaauauccagcaugguccuaucaaaaaugaaagaaaccgccgaagcauaccucggccaacccgucaaacacgccgucaucaccgucccaaccuacuucuccaacucccaaagacaagccaccaaagaugcaggcgccauagccggccuaaaaguacuccccaucaucaacgaggccaccgccgcagccaucgccuauggacuagaucgccgcggcgccggcaaacgaaacguccugauauucgaccucggcggcggcaccuucgacgucucaguacucagcauagacgcaggcgucuucgaaguaaaagcaaccgcaggagauacacaucucggcggcgaagacuucgacaaucgacuugucaaccacuucauggaagaguucagacgcaaacacggcaaagaccuaucaggcaacaaacgcgcccuacgccgccuacgaaccgccugcgaaagagccaaacgaacacccagcuccucuacgcaagcaacacucgaaauagacucccucuucgaaggcgucgacuucuacaaauccaucacccgagcacgauucgaagaauuaugcuccgaccuguuccgcagcacccucgaacccguagaaaaagcccucagagacgcaaagcuggacaaagcccaaauccacgacuucguccucggaggcggccuccacucccacccccaaggcgcagaaguagcugcaggccuccuacaacgacagggagccgaacaagaacaccaacccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2271 - RNA, 2158 nt, Artificial Sequence
  mRNA product Design1 comprising derived and/or modified sequence from Homo sapiens__NP_006588.1 __HsHSPA8 (opt9)
gggagaaagcuuaccaugucaaaaggaccggccgucggaaucgaccucggcaccaccuacagcugcgucggcguguuccaacacggaaaaguggaaaucaucgcaaacgaucaaggcaacaggaccacacccucguacguggcauuuaccgacaccgaacgccucauuggagacgcggccaaaaaccagguagcaaugaaccccaccaacaccgucuucgacgcaaaaaggcuaaucggcagacgauucgacgacgcagucguccagagcgacaugaaacacuggccauucaugguggucaaugacgcaggccgaccaaaaguccaagucgaauacaaaggcgaaaccaagagcuucuaccccgaagaaguauccagcauggugcugaccaaaaugaaagaaauagcagaggcauaccuaggaaagaccgucacgaacgcagucgugacaguacccgcauacuucaacgacucacaacgccaagccacaaaagacgccggaacaauagccggccuaaacguacuacgcauaauaaacgaaccaacagcagcagcaaucgccuacggacucgacaaaaaggucggggccgaacgcaacguccuaaucuucgaucuaggaggagggacauucgaugucagcauccugacaauagaagacgggauauucgaagucaaaagcacagccggcgacacccaccucggaggagaagauuucgacaaccgcauggucaaccacuuuauagccgaguucaagcgcaagcacaagaaggacaucagcgaaaacaaacgagccguacgccgacuacgcaccgccugcgaacgagcaaaacgcacccugucaagcagcacgcaagcgagcauagagaucgacagccucuacgaaggcauagacuucuacacauccauaacgcgagcacgguucgaagaacucaacgccgaccuguuccgcggcacccuagacccaguagaaaaagcccuacgagacgccaaacucgacaaaucacaaauccacgacauaguucuggucggcggcuccacaagaaucccuaaaauccaaaaacuacuccaagacuucuucaacggaaaagaacucaacaaaagcauaaaccccgacgaagcaguggcguacggagcagccguccaagccgcgauccuauccggcgacaagagcgaaaacguucaagaccuucuccucuuggacguaaccccgcuaucauuaggaauagaaaccgcgggaggaguaaugacaguacuaaucaaaaggaacacuacaauaccgaccaaacaaacacaaaccuucacgacauacucagacaaccaaccaggcgugcucauacaagucuaugaaggagaacgcgcaaugacaaaagacaacaaccuacucggcaaguucgaacucacagggaucccacccgcaccccgcggaguaccacaaauagaaguaaccuucgacaucgacgccaacggaauccucaacgucagcgccgucgacaaaucaacaggaaaagagaacaaaaucacgauaacaaacgacaaagggcgccugagcaaagaagauaucgaacgaaugguucaggaagccgagaaauacaaagcagaggacgaaaagcaacgcgacaaagucagcuccaaaaacucccuagaaucauacgcguucaacaugaaagcgacggucgaagacgaaaaacuacaaggcaaaauuaacgaugaggauaaacagaaaauacuagacaagugcaacgaaaucauaaacuggcucgacaagaaccaaacagcagaaaaagaagaguucgaacaucaacaaaaagaacucgaaaaagucugcaaucccauaauaaccaaacuguaccaaagcgcgggcgggaugcccggcgguaugccgggaggcuuccccggaggcggcgccccaccaagcggcggcgcauccucaggcccaaccaucgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2272 - RNA, 2257 nt, Artificial Sequence
  mRNA product Design1 comprising derived and/or modified sequence from Homo sapiens__NP_004125.3 __HsHSPA9 (opt9)
gggagaaagcuuaccaugauaagcgccagccgcgcagccgcggcgaggcuaguaggcgcagcggcaaguagaggaccgacggcggcaagacaccaagacucauggaacggccugagccacgaggcguucagacuggugagccgacgcgacuacgcaagcgaggccaucaaaggagcagucgucggaaucgaccuagggacgacgaacucgugcguagcagugauggagggaaagcaggcgaagguccuggagaacgcggaaggagcgagaaccacgccaucagucguagcauucaccgcggacggagagaggcucgugggaaugccagcgaaaaggcaggcaguaacaaacccaaacaacaccuucuacgcgacaaaaaggcuaauagguagaagauacgacgauccagaagugcaaaaggacaucaaaaacguacccuucaagauaguacgagccagcaacggagacgcauggguagaggcacauggcaagcuauauagcccgagccagauaggggcguucguccucaugaagaugaaggaaacggcagagaacuaccugggacacacggcaaagaacgcggucauaacagugccagcguacuucaacgacagccaacggcaagcgacaaaggacgcagggcagauaaguggacucaacguccuacgcgucauaaacgaaccaacagcggcugcccucgcauacgggcucgacaagagcgaagacaaaguaauagcaguauacgaccugggcggaggcacauucgacauaucuauacuagaaauccagaaagggguauucgaaguaaaguccacaaacggcgacacguuccuuggaggggaagacuucgaccaagcgcuauugcgucacaucguaaaggaguucaagagagagacaggaguagaccucacaaaagacaacauggcgcugcaacgaguaagagaagcagcagaaaaagcgaagugugaacuaagcucuagcguacaaacagacauuaaccucccauaucucacaauggacaguucagggccgaaacaccuaaacaugaagcucacaagagcccaguucgagggaauagugaccgaccuaauccgcaggacaauagcgccgugccaaaaggcgaugcaggacgcagaagugagcaagagcgacaucggagaagucauauuaguagggggaaugaccaggaugccgaaagugcaacagacggugcaggaccuguucggcagagcaccgagcaaggcaguaaacccagacgaggcaguagcgaucggagcggccauacaagggggaguacuugcgggagacguaacggacguacuacuauuggacgugacgccauuaagccuaggaauagaaacacuagguggcguguucacuaaacucaucaaucgaaacaccacgauacccacaaagaaaucacaaguguucagcacagcggccgacggacagacccaggucgagauaaaaguaugccaaggagagcgagaaauggccggggacaacaaacuacucgggcaauucacacugauaggaauaccgccagcacccaggggaguaccccagauagagguaacauucgacaucgacgcgaacggaauaguccacgucagcgcaaaagacaaaggaacuggcagggagcaacaaauagugauccaaagcagcggcggacugagcaaggacgacauagagaacauggugaaaaacgcggaaaaauacgcggaggaggacaggagaaagaaagaaaggguagaagcaguaaauauggcggaagggauaauacacgauaccgagaccaagauggaagaguucaaggaucaacucccagcggacgaaugcaacaaauuaaaagaagaaauaagcaagaugagggaacuacuagcgcgcaaagauagcgaaacgggagaaaacauaagacaagccgcgagcagucuccagcaggccagccuaaaacuauucgaaauggcguacaagaaaauggcaagcgaaagagaagggagcgggagcagcggaacaggagagcaaaaagaagaucagaaagaagagaagcaguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2273 - RNA, 2245 nt, Artificial Sequence
  mRNA product Design1 comprising derived and/or modified sequence from Homo sapiens__NP_079291.2__HsHSPA12A (opt9)
gggagaaagcuuaccauggccgacaaagaggcaggcggaagcgacggaccccgagaaacagccccaacauccgccuacuccagcccagcaagaucacucggcgacaccggcaucacaccacucucaccgucucacaucgucaacgacaccgauucaaacguauccgagcaacaauccuuccuaguagucgucgccgucgacuucgggacaaccuccuccggcuacgcauauuccuucacaaaagaacccgaaugcauccacgucaugcgccgcugggaaggaggagaccccggcguauccaaccagaaaacgcccacuaccauccuacuaacccccgaacgaaaauuccacuccuucggcuacgcugcccgagacuucuaccacgaccucgacccaaacgaagccaaacaauggcucuaccuagaaaaguucaaaaugaaacuucauaccacaggcgaccucaccauggacaccgaucuaaccgccgcaaacggcaagaaagugaaagcucuugaaaucuucgccuacgcccuucaauacuucaaagaacaagcacuaaaagaacucuccgaccaagcaggcucagaguucgaaaacuccgacguucgcugggucaucacaguccccgcaauauggaaacaacccgccaagcaauucaugcgacaagcagcauaccaagccggucucgcaagcccagaaaauucagaacaauuaaucauagcacucgaacccgaagccgcguccauauacugccgcaaacuucgccuccaccaaaugauagaacucuccucaaaagccgcugucaacggguacuccgguagcgacacagucggcgccggcuucacacaagccaaggagcacauacgccgcaaccgccaaucgcgaacauuccucgucgagaacgucaucggagaaaucuggucagaacucgaagaaggcgacaaauacgugguagucgacagcggcggcggaaccguggaccuaaccguccaccagauacgccugccagaagggcaccuuaaagaauuguacaaagccacaggaggacccuacggaucauuaggagucgacuacgaguucgaaaagcugcucuacaaaaucuucggcgaagauuucauugaacaauucaaaauaaaacgccccgccgcaugggucgaucugaugauagccuucgaaucacguaaacgcgcagccgcucccgaccgaaccaauccacucaacaucacccuacccuucucauucaucgacuacuauaagaaauuccgcgggcacuccgucgaacaugcucuccgaaaaucaaacgucgauuucgucaaauggucaucccaaggcaugcuccgcaugucaccggacgccaugaacgcacuauucaaacccacuauagacucaauaaucgaacaccuacgcgaccucuuccaaaagcccgaaguaagcacagucaaauuccucuuccucgugggcggguucgccgaagccccacuccuccaacaggccguccaggccgcauucggagaccagugccguaucauaaucccacaagacguaggccuaaccauacucaaaggcgcaguccuauucggccuagaccccgccgucauuaagguccgccguucccccuuaacauacggagucggcguccuuaaccgcuaugucgaaggaaaacacccacccgaaaagcuccuagucaaggacggcacccgauggugcaccgacgucuucgacaaauucauauccgcagaccaaagcguugcacucggcgaacuugucaaacgaucauacacccccgcgaaacccucacaauuagucauagucauaaacaucuacuccucagaacacgacaacguuuccuucaucaccgaccccggcguaaagaaaugcggaacccucagacuggaccucaccggcacauccggcacugccguacccgcacgacgcgaaauacaaacccucaugcaguucggcgacaccgaaaucaaagcaacugccaucgacauagccacaucaaaauccguaaaaguaggaaucgacuuccuaaacuacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2274 - RNA, 2278 nt, Artificial Sequence
  mRNA product Design1 comprising derived and/or modified sequence from Homo sapiens__NP_443202.3 __HsHSPA12B (opt9)
gggagaaagcuuaccaugcuagcaguccccgaaaugggccuacaaggccucuacaucggcuccagccccgaacguucacccguacccucaccaccaggcucaccaagaacccaagaaaguugcggcaucgccccacucacgcccucccaaucccccaagcccgaaguccgagcaccccaacaggcuucauucucugucgucguagcaauagacuucggaaccaccucuagcggcuacgcuuucucauucgccagcgaccccgaagccauccacaugaugcgcaaaugggaaggaggagaccccgguguagcacaccagaaaaccccaaccugccuacuccucacacccgaaggagccuuccacagcuucggcuacaccgcccgagacuacuaccacgaccucgaccccgaggaggcucgugacuggcucuacuucgaaaaauucaaaaugaaaauccacuccgccaccgaccucacccucaaaacucaacuagaagcgguuaacggaaaaacaaugcccgcccuagaaguuuucgcacacgcccugcgcuucuuccgagaacacgcacuccaagaacuucgcgaacaaagcccgagccuuccugaaaaagacaccguucgaugggucuugacaguccccgcaauauggaaacaaccggcgaaacaauucaugcgagaagcagccuaccuagccggacugguaucccgagaaaacgccgagcaacuacucaucgcacucgaacccgaagcugcauccgucuacugccgcaaacuacgccuccaccaacuccucgaccuguccggccgcgcaccaggaggcgguagauugggugagcgacgcaguauagacaguuccuuucgacaagcacgcgaacagcuacgccgaagccggcacucccgaacuuuccuuguagaaucaggcgucggcgaacucugggccgaaaugcaagcaggagacagauacguaguugcggacugcggcggcggcaccguugaccugacaguccaccaauuagaacaaccacacggcacucucaaagaacuuuacaaagcauccggcggacccuauggcgccguaggagucgacuuagcauuugaacaacuccugugcagaaucuucggggaagacuuuauagcaaccuucaaaagacaaagacccgcagccugggucgaccuuaccaucgcauucgaagcacggaaacgaacagccggcccacaccgagcaggagcccugaacaucagccuaccauucucauucaucgauuucuaccggaaacaacgcggccacaacgucgaaacagcccuccggcgaagcagcgucaacuucgucaaauggucaucccaaggaaugcuacgaauguccugcgaagcaaugaacgaacucuuccaaccaaccgucucgggcaucauccaacacaucgaagccuuacuagcccgcccagaaguacaaggagucaaacuccucuuccuagucggaggcuucgcagaguccgcaguccuacaacacgcgguucaggccgccuuaggagcacgcggccuccgagucgugguaccccacgacguaggccucacaauccuaaaaggcgccguucucuucgggcaagcucccggcgucguacgcguacgccgcagcccacuaaccuacggcguuggcguacucaaccgcuucgucccgggaagacacccacccgaaaaacuccuaguccgagacgguagacgcuggugcaccgacgucuuugaaagauucguggccgccgaacaaucagucgcccucggcgaagaaguccgacgcagcuacugccccgcacgccccggccaacgacgcguccucaucaaccuauacugcugcgcagcagaagacgcacgcuuuauaaccgaccccggcguccgaaaaugcggcgcacucucacucgaauuagaacccgcagacugcggucaagacaccgccggagccccgcccggaagacgagaaauccgcgccgcaaugcaauucggcgacaccgaaaucaaagucacagccgucgaugucuccacaaaccgaagcguaagggccucgauagacuuccuaaguaacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2275 - RNA, 1633 nt, Artificial Sequence
  mRNA product Design1 comprising derived and/or modified sequence from Homo sapiens__NP_008879.3__HsHSPA13 (opt9)
gggagaaagcuuaccauggcaagagaaaugacaauccuuggcuccgccgugcuaacccuccuacuagccgguuaccucgcccaacaguaccuaccccuccccaccccaaaagucaucggaaucgaucucggcaccaccuacugcucagucggcgucuucuuccccggcaccggaaaaguaaaaguuauaccggacgaaaacggccacaucuccauccccucaauggucuccuucaccgacaacgacgucuacgucggcuacgaaagcguggaacucgccgacuccaacccccaaaauacaauauacgacgccaaacgcuucaucggcaaaaucuucaccgccgaagaacucgaagccgaaauaggccgcuacccuuucaaagugcucaacaaaaacggcauggucgaguucuccgucaccagcaacgaaacaauaacaguaucgccagaauacgucggcucccgccuccuccuuaaacuaaaagaaauggcagaagccuaccuaggcaugcccgucgccaacgcaguaaucucagucccagccgaguucgaccuuaaacaaaggaacuccaccaucgaagcagcuaaccucgccggccugaaaauccuccgagucaucaacgaacccaccgccgcggccauggcauacggacuucacaaagccgacgucuuccacguccucguaaucgaccugggcggcggcacccuagacgucagccuucucaacaaacagggaggcauguuccucacacgcgcgaugucaggaaacaacaaacuaggaggccaggacuucaaccaacgccuacuccaauaccuauacaaacaaauauaccaaaccuacggauucguuccaucccgaaaagaagaaauccacagacuccgacaagcaguagaaaugguaaaacucaaccuaacccuacaccaauccgcacaacuaagcguccuccuuacaguagaagaacaagaccgaaaagaaccacacuccuccgacaccgaacuccccaaggauaagcuauccagcgcugacgaccacagaguaaacuccgguuucggccguggccucagcgacaagaaaucuggugaaucacagguccuauucgaaaccgagauaucccgaaaacucuucgacacccucaacgaagaccucuuccagaaaauccucguccccauccaacaaguccucaaagaaggccaccucgagaaaacagaaaucgacgaagucguacucguaggaggcuccacacgcaucccccgcauccgacaaguaauccaagaguucuucggcaaagaccccaacaccucaguagacccugaccuggccgucguaaccggagucgccauccaggccggaauugauggcggauccuggccccuacaagugagcgcccucgaaaucccaaacaaacaccuccagaaaacaaacuuuaacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2276 - RNA, 1747 nt, Artificial Sequence
  mRNA product Design1 comprising derived and/or modified sequence from Homo sapiens__NP_057383.2__HsHSPA14 (opt9)
gggagaaagcuuaccauggccgcaauaggcguccaccuaggcugcaccagcgccugcgucgccgucuacaaagacggcagagcaggcguagucgccaacgacgccggagaccgcgucaccccagcagucgucgccuacagcgagaacgaagaaaucguggggcucgcagccaaacaaucccgcauccgaaauaucuccaacacagucaugaaaguaaaacaaauccuaggacgcaguucgucagauccccaggcccaaaaauacauagccgaaucaaaaugccuaguaauagagaaaaacggcaaacuccgauacgaaaucgacaccggugaagaaacaaaauucguaaacccagaagacgucgcacgccuaauauucagcaagaugaaagaaaccgcccacucugugcucggaagugacgccaacgacguagucaucaccguaccauucgacuucggcgaaaaacagaaaaacgcccuaggcgaagccgcaagagccgccgguuucaacguccugcgacucauacacgaaccaagcgccgcgcuccucgccuacggcaucggccaagacuccccaaccgggaaguccaacauccuaguauucaagcuaggaggcaccagucuaucccuauccgucauggaagucaacagcggcauauaccgcguacucucaaccaacacagacgacaacaucggcggagcccauuucaccgaaacacuagcccaauaccucgccuccgaguuccaacgcucuuucaaacacgacguccgcggcaacgcgcgcgccaugaugaaacuaaccaacagcgccgaaguagcuaaacacucacucucaacacucggcuccgcaaacugcuuucuugacagccuauacgaaggccaagacuucgacugcaacgucucaagagccagguucgaacuacuaugcucaccacucuucaacaaaugcaucgaagccauacguggacuacucgaccaaaacggauucacugccgacgacaucaauaaaguaguacucugcggaggaucuucacgaauaccuaaacuacaacaacucaucaaagaccucuucccagccgucgaacuucuuaacuccaucccacccgacgaagucauccccaucggcgccgccaucgaagccggcauccucaucggaaaagaaaaccuacuuguagaggacucccucaugaucgaaugcuccgccagagacauccuagucaaaggcguagacgagagcggcgccagccgauucaccguccuauuccccuccggaacaccacuaccagcccgacgccaacacacacuacaagccccaggaucaauauccuccgucugccucgaacucuacgaaagcgacggcaaaaacuccgcaaaagaagaaaccaaauucgcacaagucguccuccaagaccucgacaagaaagaaaacggccuccgcgacaucuuagcagugcucaccaugaaacgcgacggcagccugcacguaacaugcacagaccaggaaaccggcaaaugcgaagccaucuccauagaaaucgccucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2277 - RNA, 2794 nt, Artificial Sequence
  mRNA product Design1 comprising derived and/or modified sequence from Homo sapiens__NP_006635.2 __HsHSPH1 (opt9)
gggagaaagcuuaccaugagcguaguaggacucgacguagggagccaauccugcuacauagccgucgcccgcgccgguggcaucgaaaccaucgcaaacgaguucagugaccgaugcacccccuccguaauauccuucggaagcaaaaacagaaccauaggcguagcugcuaaaaaucagcaaaucacacacgcgaauaacacggucucaaacuucaaacgauuccacggcagagccuucaaugaccccuucauccaaaaagaaaaagaaaaccuaucauacgaccuaguaccccucaaaaacggaggcguaggaaucaaagucauguacaugggagaagaacaccuauucagcguagaacaaauaacugccaugcuacucaccaaacucaaggaaaccgcagaaaacucacugaaaaagccagucaccgacugcgugauaagcguccccucuuucuucaccgacgccgaacgccgaucgguccuagacgcagcccaaauagucggccuaaacugucuacgacuaaugaacgacaugacagcaguggcccugaacuacggcaucuauaagcaagaccugcccucgcucgacgaaaaaccacgcaucguaguauucgucgauaugggccacucagcauuccaagugucagccugcgcauucaacaagggcaaacucaaagugcuaggcaccgccuucgaccccuuucucggaggcaaaaacuucgacgaaaagcuaguggaacacuucugcgcagaauuuaaaaccaaauauaaacucgacgccaaauccaaaaucagagcccugcuacgacucuaccaagaaugcgaaaaacuaaagaaacugauguccuccaacucaaccgaccugccccugaacaucgaaugcuucaugaacgacaaagacgucuccgggaaaaugaacagaucacaauucgaagaacuuugcgccgaacuacuccagaaaaucgaaguaccacucuacucccuccuggaacaaacccaccuaaaagucgaagacguguccgccguagaaauugucggcggcgcaacacgcauaccggccguaaaagaacgaauagcgaaauucuucggcaaagacaucuccaccacccuuaacgcagacgaagccgucgcacgcggcugcgcccuccagugcgcaauacucucgccggccuucaaaguccgcgaguucuccgucacggaugccgucccauucccgaucucccugauuuggaaccacgacagcgaagacacugaaggaguccaugagguauucagccgaaaccacgcagcucccuucagcaaaguacucacauuccuacgccgcggaccauucgaacuggaagcguucuacagugacccccagggaguaccguacccggaagcaaaaaucggacgcuucguggugcaaaacguaucagcacaaaaggacggcgagaaaagccgcgucaaaguaaaaguaagaguaaauacgcacggaaucuucacaaucucaacagccucaauggucgaaaaaguacccaccgaggaaaacgaaaugagcuccgaagccgauauggaaugccucaaccaacgcccacccgaaaaccccgauacagacaagaacguccaacaagacaauuccgaagcgggcacacaaccccagguccaaacagacgcacagcaaacaagccaguccccacccucacccgagcucaccucggaagagaacaaaauacccgaugccgacaaagcuaacgagaaaaagguggaccaaccacccgaagccaagaaacccaaaaucaaagucguuaacguagaacuaccaauagaagccaaucuuguauggcagcucgggaaagaccuccugaauauguacaucgaaacagaaggcaaaaugaucaugcaggacaaacucgaaaaagaacgaaacgaugccaaaaacgccgucgaagaauacguauacgaguuccgagacaaacuaugcggccccuacgaaaaguucaucugcgaacaagaccaucaaaacuuccuccgacuccucaccgaaacagaagacuggcuauacgaagaaggcgaagaccaagccaagcaggcguacguagacaaacuagaggaacuaaugaaaaucgggaccccuguaaaaguacgauuccaagaagccgaagaacgaccaaaaauguuugaagaacugggacagcgccuccagcacuacgccaagaucgccgcagacuuccgcaauaaagacgaaaaauacaaccauauagacgaaagcgaaaugaaaaaggucgaaaagagcgucaacgaggucauggaauggaugaacaacgucaugaacgcucaagccaagaaaagucuagaccaagaccccguagugagggcgcaagaaaucaaaaccaaaauaaaagagcugaacaacacaugugaaccagucgucacgcaaccgaaaccaaaaaucgaaagcccgaaacucgagcgcacacccaacggacccaacaucgacaagaaagaagaagaccuagaagacaaaaacaacuucggugccgagcccccgcaccaaaacggugaaugcuaucccaacgagaaaaacagcgugaacauggaccuugacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2278 - RNA, 3217 nt, Artificial Sequence
  mRNA product Design1 comprising derived and/or modified sequence from Homo sapiens__NP_006380.1 __HsHYOU1 (opt9)
gggagaaagcuuaccauggcagacaaagugagacgacaacguccgcgucggcggguuugcugggcacucguggcaguccuccuagcagacuugcucgcccuaagcgauacccuagcagugaugucuguagacuuaggaucggaaucgaugaaaguagccaucgucaaaccgggagugccaauggaaaucguacuaaacaaagaaucacgcaggaaaacccccgugaucgucacgcugaaagagaaugagcgauucuucggcgauuccgcagcauccauggcgaucaaaaacccgaaggcaacacugagauacuuucagcaccuccucggaaaacaggcagacaacccacacguagcccucuaccaagcacgcuuccccgagcacgaacuaacauucgacccccaacgccaaaccgugcacuuccaaaucagcagucagcuccaauuuagcccagaagagguacucggaaugguacucaacuacuccaggagccucgcugaagauuuugccgaacagcccauaaaagacgcagucauaacaguacccgucuucuucaaccaagccgaaagacgagcgguacuccaagcagcaagaauggccggccucaagguccuucaacugaucaacgacaacacagcgacagcacucuccuacggaguauucagaagaaaagacauaaacaccacagcacagaacaucauguucuacgacaugggaagcggaaguacuguuugcacaauaguaaccuaccaaaugguaaagaccaaagaggcaggaaugcaaccacaacuucaaauacgaggggucggcuuugacaggacucuaggaggacuggagauggaacuccggcuucgagaacgccuagcaggacucuucaacgaacaacgaaagggccagagagccaaagacguacgagaaaauccacgagcaauggccaaacuccuaagagaagcgaaccgacucaaaacgguccuaagcgcaaacgcggaccacauggcccaaaucgaaggacuaauggacgacguugacuucaaagccaaaguaacacgaguagaguuugaagaacucugcgccgaccucuucgaacgagugccaggaccgguacaacaagcacuccagagcgcagaaaugucccuagacgaaaucgagcaagugauccuaguaggaggcgcaacccggguaccacgcguacaagaaguauuacugaaagcggugggaaaagaagaguuagggaaaaacauaaacgccgacgaagccgcagcaaugggagcaguauaccaagccgcggcccucagcaaagccuucaaaguaaaacccuucguagugcgggacgcagucguauacccaauacugguggaguuuaccagagaagucgaagaggaacccggcauccacagccuaaaacacaacaaaagaguccuguucuccaggaugggacccuacccacaacgcaaggugauaacauucaaccgauacagucacgacuuuaacuuccacauaaacuauggggaccugggcuuccuaggacccgaggaccuccgcgucuucggaucccaaaaccuaacaaccguaaaacucaaaggaguaggagacucuuucaaaaaguaccccgacuacgaaucaaaggggauaaaagcccacuuuaaccucgacgaaagugggguccucagccuggaccgcguagagucggucuucgaaacacucgucgaagacagugccgaagaagaaucaacccuaacgaaacuaggcaacacaauaucaagccucuucggaggaggcacaacaccugacgccaaagaaaacggaacagacaccguacaagaagaagaggaaagccccgcggagggaucaaaagacgaaccaggcgaacagguggaacucaaagaagaagcggaagccccagucgaggauggaagccaacccccaccacccgaaccgaaaggcgacgcaacaccggaaggcgaaaaggccaccgagaaagaaaacggggacaagucagaagcccaaaagccaagugaaaaagccgaagcaggcccagaaggaguagccccggccccagaaggagagaaaaagcagaaacccgccaggaaacgccgaaugguggaggagauaggcgucgaacucguaguacuggaucuaccagaccuccccgaagauaagcuagcacaaagcgugcaaaaacuccaggaccucacccugcgcgacuuagaaaaacaagagagagagaaagcagcaaacagccuggaggccuucaucuucgaaacacaagacaagcuguaccagcccgaauaccaagaagugagcacggaagaacaaagagaagagaucuccggcaagcuauccgcagccagcacguggcucgaagacgaaggaguaggggccacaacaguuaugcucaaagaaaaauuagcagaacuaagaaagcuaugccaaggacuauuuuucagaguggaagagagaaagaaauggccggaaaggcucagugcccucgacaaccuacucaaccauuccagcauguuccugaagggcgcaaggcuaauaccagaaauggaccaaauauucacagaaguagaaaugaccacucucgagaaaguaauaaacgagacaugggcguggaaaaacgcaacccucgcagaacaagcgaagcugccagccacggagaagccgguucuacucagcaaggauauagaagcaaagaugauggcacuagacagagaaguccaguaccuguuaaacaaagcaaaauucacaaaaccacgcccaaggccgaaagacaaaaacggaacacgagcagaaccaccacugaacgcgucagcuucagaccaaggagaaaaaguaauacccccagcagggcaaaccgaggacgcagaaccaaucagugaaccagagaaaguugagacgggaagcgaaccaggagacacggaacccuuagaauuaggaggcccaggcgcagaaccagaacaaaaagagcaaagcacuggccaaaagcguccccucaaaaacgacgagcuaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2279 - RNA, 2416 nt, Artificial Sequence
  mRNA product Design1 comprising derived and/or modified sequence from Homo sapiens__NP_005339.3 __HsHSP90AA1 (opt9)
gggagaaagcuuaccaugcccgaagagacgcaaacgcaagaucaaccgauggaggaggaagaaguggaaaccuucgcguuccaggcagaaaucgcgcaacugaugagccucauaaucaacacguuuuacagcaacaaagaaauauuccugcgcgagcuaauaagcaacagcagcgacgcacucgacaagauacguuacgaaucccuaacggacccgagcaaacuagacagcgggaaggaacuacacaucaaccucauccccaacaagcaggaccgaacccugaccauagucgacaccggaauagggaugacgaaagcagaccucaucaacaaccucggaacgaucgccaaaagcggcacgaaggcuuucauggaagcacuacaagcgggcgccgacauaaguaugauaggccaauucggaguaggauucuacagugccuaccuaguggcagagaaagucaccguaauaacaaaacacaacgacgacgaacaauacgccugggaaagcagcgccgggggcuccuuuacaguaagaacagacaccggagaaccaaugggccgcggaacaaaaguaauacuccaccuaaaagaggaccaaacagaauaccucgaggaaagacgaauaaaggagaucgucaaaaagcacagccaauucauaggauacccaauaacgcuauucguggaaaaagaacgagacaaagaagugucagacgacgaagcggaggaaaaagaggauaaggaagaagagaaagagaaagaagaaaaagaaagcgaagacaagccagaaaucgaggacguagggucggacgaagaggaggaaaagaaagacggcgauaagaaaaagaaaaagaaaaucaaagaaaaguacaucgaccaagaggagcuaaacaaaacaaaaccgaucuggacacgaaacccagacgacaucacgaacgaggaauacggcgaguucuacaaaucacucacaaacgacugggaagaccaucuagcaguaaagcacuucagcgucgaaggccaacuggaguucagagcucuccuguucguacccaggcgcgcccccuucgaccucuucgaaaacagaaagaagaaaaacaacauaaaauuauacguaagacgaguauucauaauggacaacugcgaagaacugaucccggaauaccucaauuucauccgcggagucguagacagcgaggaccuaccacuaaacauaagcagagagaugcuacagcagaguaaaauccuaaaaguaauacggaaaaaccuugucaaaaagugccuggagcuauucaccgaacuugcagaggacaaagaaaacuacaagaaguucuacgagcaguucagcaagaauauaaaacuaggcauacacgaagacucacagaaccgcaagaaacuaagcgaacuccugagauacuacaccagcgccagcggggacgagauggucagccuaaaagacuacugcacaagaaugaaagaaaaccaaaaacacaucuacuauaucacgggagaaacaaaagaccaggucgcgaacucagccuucgucgagcgacuccgcaaacacgggcucgaaguaaucuauaugauagagcccauugacgaguacugcguacagcaacuaaaagaguucgaaggaaaaacccucguaagcgucacgaaagaaggccuagaacugcccgaagacgaagaggagaaaaagaaacaagaagaaaagaaaacaaaauucgaaaaccugugcaaaaucaugaaagacauccuggagaagaaaguggagaaaguagucguaagcaaccgccuaguaacgagcccaugcugcauagucacaagcacauacggauggacggcgaacauggagcgaauaaugaaagcccaagcccugcgagacaacagcacaaugggauacauggcggccaaaaagcaccuagaaaucaaccccgaccacuccaucaucgaaacacucagacaaaaagccgaagccgacaaaaacgacaaaagcguaaaggaccuggugauacuccuuuacgaaaccgcccugcucucaagcggcuucucccuggaggacccacagacccacgcgaacagaaucuacagaaugauaaagcugggccuaggaauagacgaagacgacccaacagccgacgacacauccgcagccgucaccgaagaaaugccaccccuagaaggggacgacgacacaagcagaauggaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2280 - RNA, 556 nt, Artificial Sequence
  mRNA product Design1 comprising derived and/or modified sequence from Homo sapiens__NG_005218__HsHSP90AA3P (opt9)
gggagaaagcuuaccauggacucaucaaaacuagacuccggcaaaggccuacacauaaaccucguccccaacaaacaaaaccaaacccucaccaucguagacacacgcaucggcaugaccaaaaccgaccucaucaacaaccucggaaccgucaccaaauccggcacaaaagccuucauggaagcccuccaagcagacgcagacauauccaugaucggccacuucggaguaggcuucuacuccgccuaccucgucgccaaaaaagucaccgucaucucaaaacacaacaacgacgaacaauacaccugggaauccuccgcaggaggcagcuucaccguccgcaccgacgaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2281 - RNA, 2392 nt, Artificial Sequence
  mRNA product Design1 comprising derived and/or modified sequence from Homo sapiens__NP_031381.2__HsHSP90AB1 (opt9)
gggagaaagcuuaccaugcccgaggaaguacaccacggagaagaggaagucgaaaccuucgccuuccaagcggaaaucgcccaacuaaugagcuugauaauaaacacguucuacuccaacaaagagauauuccugcgggagcuaauaucgaacgccagcgacgcccuagacaagaucagguacgagucccucaccgaccccagcaaacuagacucgggcaaggaacugaaaaucgacauaaucccgaacccgcaagagcgcacccucacccuaguggacacgggaauaggcaugaccaaagcagaccucauaaacaaccucggcaccauagccaagagcggaaccaaggccuucauggaagcacugcaagcaggagcagacauaaguaugaucgggcaauuuggcguaggguucuacucagcguaccucgucgccgaaaaaguaguagucauaacgaaacacaacgacgacgagcaauacgcgugggagucaagcgcaggagggagcuucaccguacgggcagaccauggcgaacccauaggcagaggcaccaaaguaauccuccaccuaaaggaagaccaaacagaguaccuagaagaacggagaguaaaagaagucgucaagaaacacucccaauucauaggcuaucccaucacacuauaccucgagaaagaacgagaaaaagaaauauccgacgacgaagccgaagaagaaaaaggggaaaaagaagaggaagacaaagacgacgaagaaaagcccaaaauagaagacguuggcucggacgaggaggacgacagcggcaaagacaagaaaaagaaaacgaagaaaauaaaagagaaauacaucgaucaagaagaacucaacaaaaccaaaccgaucuggacacggaaccccgacgauaucacgcaagaggaguacggcgaguucuacaaaucacuaacgaacgacugggaagaccaccucgcggucaagcacuucaguguggaaggccaacuagaguuccgagcgcuauuguucaucccaagacgcgcacccuucgaccucuucgaaaacaaaaagaagaaaaauaacauaaaacuguacguacgacggguguucaucauggacagcugcgacgaauugauaccggaauaccugaacuucauccgaggagucguggacucagaagaccucccacuaaacaucucccgagaaaugcuucaacagagcaaaauccuaaaagugaucaggaaaaacaucguaaagaaaugcuuagaacuauucagcgaacuagcagaggacaaagaaaacuacaagaaauucuacgaagccuucagcaaaaacuugaaacuaggcauacacgaagacagcacgaaccgaaggcgcuuguccgaacuacuacgcuaccacacgucccagagcggcgacgagaugaccagccugagugaauacgugagccgcaugaaagaaacgcagaaaagcauauacuacauaacaggcgaaagcaaagaacaaguagcgaacagugccuuugucgaaagaguacgaaaacgcggauucgaggucguauacaugacggaaccaauagaugaguacugcguccaacaacuaaaagaguucgacgggaaaagccuagucaguguuacgaaagagggccucgaacuacccgaagacgaggaggagaaaaagaaaauggaagaaagcaaagcaaaauucgaaaaccugugcaagcucaugaaagaaauauuggacaagaaagucgaaaaaguaacgaucucgaaucgacucguaucaucccccugcugcauagucacgagcacauacggauggacagcgaauauggagcggaucaugaaggcacaagcccuacgcgacaacagcaccaugggcuacaugauggcgaagaaacaccucgagauaaacccagaccacccgaucguggagacgcuaagacagaaagcagaagccgacaaaaacgacaaagccguaaaagaccuaguaguacugcuauucgaaacagcccugcucagcagcggauucucacucgaagacccgcaaacccacagcaaccgaaucuaccgcaugaucaagcucggacucggcaucgacgaagacgaaguagccgccgaagaaccgaacgcagccgucccugacgagauaccgccccucgaaggcgacgaggacgcaagccgaauggaggaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2282 - RNA, 2629 nt, Artificial Sequence
  mRNA product Design1 comprising derived and/or modified sequence from Homo sapiens__NP_003290.1__HsHSP90B1 (opt9)
gggagaaagcuuaccaugcgagccuuauggguccucggacucugcugcgugcuacugaccuucggcagcguaagagcagacgacgaggucgacguagacggcacgguagaggaagaccucggcaaaucgcgagaaggcucacgcacagacgacgaaguaguccagcgagaagaagaagcgauacaacuugacgggcugaacgcgagccagauccgcgaacucagggagaaaagugaaaaauucgcauuucaggcagaaguuaacaggaugaugaagcuaaucauaaauucccuguacaaaaacaaagagaucuuccuacgggaacuaauaucaaacgccagcgacgcucuagacaaaaucagacuaauaagccuaacagacgaaaacgcacuaagcggaaacgaagaauugacagucaaaaucaagugcgacaaagagaaaaaccugcugcacgucaccgacacaggcgugggcaugacccgagaggaacucgucaaaaaccugggaacgauagcaaagucagggaccagcgaguuccucaacaaaaugacagaagcccaggaggacgggcagagcacgagcgaacugauagggcaauucggaguaggauucuacagcgcguuccugguagcggacaaagucauagucaccagcaaacacaacaacgauacccagcacaucugggagagcgacaguaacgaauuuagcguaaucgcagacccucgaggcaacacacuagggcgagggaccacaauaacacugguacuaaaggaagaagccagugacuaccucgagcuagauaccaucaagaaucucguaaagaaauacucacaauucaucaacuucccaaucuacgucuggagcagcaaaacagaaacgguugaagaaccuauggaggaagaggaagcggcaaaagaggaaaaggaagaaucagacgacgaggccgccguggaagaggaagaagaggaaaagaaaccaaaaacgaagaaaguggagaaaacaguaugggacugggaacugaugaacgacaucaagcccauauggcaaagaccaagcaaggaaguagaagaagacgaguacaaggcguucuacaaaaguuucuccaaggagucagacgaccccauggcauauauacacuucacggcagagggcgaagucacauucaagagcauacucuucgugcccaccucggcaccacgcggacuauucgaugaguacgggagcaagaaaagcgacuacauaaaacuauacgucaggaggguauucauaacggacgacuuccacgacaugaugcccaaguaccugaacuucgucaagggaguagucgauagcgaugaccuaccccugaacguaagcagggaaacccuacaacaacacaaacuucucaaaguaauccggaaaaagcucgugaggaagacccuagacaugauaaagaaaauagcggacgacaaauacaacgacacauucuggaaagaguucgggacaaacauaaaacuaggugugauagaggaccacagcaacaggacgagacuggccaaacuccuacgauuccaaucaagccaucaccccacagacaucacgagccuagaccaguacguagaaagaaugaaggaaaaacaggacaaaauuuacuucauggcaggguccagcagaaaagaggccgaaagcucccccuucgucgaaaggcugcucaagaaaggguaugaagucauauaccuaacagagccagucgaugaauacugcauacaggcacugccagaguuugacggcaagagauuccaaaacgucgcaaaagaaggagugaaauucgacgaaagugagaagaccaaagagagcagagaagccgucgagaaagaguucgaaccucuccucaacuggaugaaagacaaagcgcuaaaagacaagauagaaaaagcagucguaagccaacgacucacagaaagcccaugcgcgcuagucgccucgcaauacggauggucagggaacauggaaagaaucaugaaagcgcaagcguaccaaacugggaaagacauauccacgaacuacuacgccagccaaaagaaaacguucgaaaucaaccccaggcauccacugauaagggauaugcuacgcagaauaaaagaagacgaggacgacaaaacaguccucgaccucgcagucguccucuucgaaacggcaacccuuagaagcggcuaccugcugccagacaccaaagccuacggagacaggaucgagcgaaugcuacgacucucacuaaacauagacccggacgcaaaaguagaggaagaaccggaggaggagccagaagaaacagccgaagauacaacagaggacacggaacaagacgaagacgaagaaauggacguagguacagacgaggaagaagaaacagccaaagagagcacagcggagaaggacgagcuauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2283 - RNA, 2332 nt, Artificial Sequence
  mRNA product Design1 comprising derived and/or modified sequence from Homo sapiens__NP_057376.2__HsTRAP1 (opt9)
gggagaaagcuuaccauggcccgagaauuaagagcccuauuacucuggggacgucgucuccguccccuccuccgcgcaccagcccuagcagccguacccggcggcaaacccauucucugcccaagaagaaccacugcccagcuagggccccgacgaaaccccgcguggucgcuccaagcuggacgacucuucucaacccaaaccgcagaagacaaagaagaaccccuccacagcaucauaucuucaacagaauccguccaagguagcacauccaaacacgaguuccaagccgaaaccaagaaacuguuagauaucgucgcccgcucccucuacagcgaaaaagaagucuucauccgcgaacugaucucaaacgccagcgacgcccuagagaaacuacgccauaagcuagucucagacggccaagcacuacccgaaauggaaauucaccuccaaaccaacgccgaaaaaggcaccauaacaauccaagacaccggaaucggcaugacccaagaggaacucguaagcaaccucggcacuaucgcgcgcucagggucaaaagcauuccuagacgcuuuacaaaaccaggccgaggcuucauccaaaauaaucggccaauucggcguaggcuucuacucagccuucauggucgcggaucgcgucgaagucuacucccgcagcgcagccccagggagccuaggguaccaguggcucagcgacggcuccggcguauucgaaaucgccgaagccuccggagucagaacaggaaccaaaaucauaauucaccugaaaucugacugcaaagaguucagcuccgaagcacgcguucgagacguagucacaaaauacuccaacuucgucuccuucccacucuaccucaacggaagacgcaugaacacccuccaggccaucuggaugauggaccccaaggacguccgugaauggcaacacgaagaguucuaccgauacguggcacaagcccacgauaaaccacguuacacccuacacuacaaaaccgacgccccacucaacaucagaagcaucuuuuacguccccgacaugaaaccgucaauguucgacgucucccgugaacuaggauccuccgucgcacucuacucacgcaaaguccuaauccaaacuaaagccacagacauccuucccaaauggcuccgguucauacgcggcgucguggacucagaagacaucccccuaaaccucucccgcgaacuacuccaagaauccgcgcuaauccgaaaacuuagagacguacuacaacaacggcuaaucaaauucuucaucgaccagaguaagaaagacgccgaaaaauacgcuaaauucuucgaagacuacggacuauucaugcgagaaggcaucgucaccgccaccgaacaagaagucaaagaagauaucgcaaaacuccuacgcuacgagucuuccgcccuacccucaggacaacuuaccucacuaagcgaauacgccagccgcaugcgcgcgggcacacggaauauauacuaccuaugcgcacccaaccgacaucucgccgaacacagcccauacuaugaagccaugaagaagaaagacacugaaguccuauucugcuucgaacaauuugaugagcucacccuacuacaccuccgggaauuugacaaaaagaaacuaauauccgucgagaccgacaucgucguagaccacuacaaagaggaaaaauucgaggaccgcuccccagcagccgagugccuaagcgaaaaagaaaccgaagaacuaauggccuggaugcgcaacguucuaggcucaagaguaaccaacguaaaaguaacccuacgacucgacacccaccccgccaugguaaccguacucgaaaugggagcagcccgccacuuccuacgaaugcaacaacucgccaaaacacaggaggaacgagcccagcuccuacagccaacacucgaaaucaacccccgacacgcacucaucaagaaacucaaccaacuccgggcauccgaaccaggacucgcccagcuccuaguagaccagaucuaugaaaacgccaugaucgcugcaggccuagucgacgacccaagagcaaugguuggacgacuaaacgaacugcucgucaaagcccucgagcgccacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2284 - RNA, 679 nt, Artificial Sequence
  mRNA product Design1 comprising derived and/or modified sequence from Homo sapiens__NP_000609.1__HsIGF1 (opt9)
gggagaaagcuuaccaugggcaaaaucuccucccuacccacccaacuauucaaaugcugcuucugcgacuuccuaaaagucaaaaugcacacaauguccucaucccacuuauucuaccucgcacucugccuccucacauucaccucauccgccaccgcaggccccgaaacccuaugcggcgccgaacucgucgacgcacuccaauucgucugcggcgaccgcggcuucuacuucaacaaacccacaggcuacggcuccuccucaagacgagcaccccaaaccggcaucguagacgaaugcuguuuccgaucaugcgaccuucgccgccucgaaauguacugcgcaccccucaaacccgccaaaucagcccgcuccguccgugcccaacgacacaccgacaugcccaaaacccaaaaagaaguccaccucaaaaacgccucccgcggcuccgcaggcaacaaaaacuaccgcauguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2285 - RNA, 760 nt, Artificial Sequence
  mRNA product Design1 comprising derived and/or modified sequence from Homo sapiens__NP_000603.1__HsIGF2 (opt9)
gggagaaagcuuaccaugggaauccccaugggcaaaucaaugcucguccuccucaccuuccucgccuucgccuccugcugcauagccgccuaccgacccuccgaaacacucugcggcggagaacucgucgacacccuacaauucgucugcggcgaccgaggcuucuacuucucccgacccgccucacgaguaucccgccgcucccgcggcaucgucgaagaaugcugcuuccgcucaugcgaccucgcccuccucgaaaccuacugcgccaccccagccaaauccgaacgagacgucuccaccccacccacaguacuucccgacaacuuuccccgauaccccguaggcaaauucuuccaauacgacaccuggaaacaaucaacccaacgacuccgccguggccuccccgcccuacuccgcgcacgccgcggacacguccuagcaaaagaacucgaagccuuccgcgaagccaaacgacaccgcccccucaucgcccuccccacccaagaccccgcccacggaggcgccccacccgaaauggccuccaaccguaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2286 - RNA, 856 nt, Artificial Sequence
  mRNA product Design1 comprising derived and/or modified sequence from Homo sapiens__NP_000591.1__HsIL6 (opt9)
gggagaaagcuuaccaugaacuccuucuccaccuccgccuucggccccgucgccuucucccucggccuccuccucguccuccccgccgccuuccccgcccccgucccccccggcgaagacuccaaagacgucgcugccccccaccgccaaccccuaaccuccuccgaacgcaucgacaaacaaauccgcuacauccuagacggcaucucugcacuccgaaaagaaaccugcaacaaaucuaacaugugcgaauccuccaaagaagcccuagccgaaaacaaccucaacuuacccaaaauggccgaaaaagacggcugcuuccaauccggcuucaacgaagaaaccugccucgucaaaaucaucaccggccuccucgaauucgaagucuaccucgaauaccuacaaaaccgauucgaauccucagaagaacaagcccgagccguccaaauguccaccaaaguccucauccaauuccuccaaaaaaaagccaaaaaccucgacgccaucaccacaccugacccaaccaccaacgccucacuccucacaaaacuccaagcccaaaaccaauggcuccaagacaugacaacacaccucauccuccgcuccuucaaagaauuccuucaauccucccucagagcccuccgccaaauguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2287 - RNA, 1498 nt, Artificial Sequence
  mRNA product Design1 comprising derived and/or modified sequence from Homo sapiens__NP_002183.1__HsINHBA (opt9)
gggagaaagcuuaccaugccccuacucuggcuacgcggcuuccuacuagcaagcugcuggaucauaguaagaagcucacccaccccaggaagcgaaggacacagcgccgcgccagacugcccaucaugcgcacucgccgcccuccccaaagacguacccaacagccagcccgaaaugguagaagcagugaaaaaacacauacuaaacaugcuccaccuaaaaaagcgacccgacguaacccaacccgucccaaaagcagcacuacuaaacgcaaucagaaaacuccacguagggaaagucggcgaaaacggauacguagaaaucgaagacgacauaggaaggcgcgccgaaaugaacgaacucauggaacaaacgucggaaauaaucacauucgcagaaucagguacggccagaaaaacccuacacuuugagaucagcaaagaagggagcgaccuaagcgucgucgaaagagcagaggucuggcuguuccucaaaguuccaaaagccaacagaacacgcacaaaaguaacaauacgccuauuccagcaacaaaaacacccacaaggcagccuagacaccggagaagaggccgaggaaguaggacuaaaaggagaacggagcgaacuacuacuaagcgaaaaagucguagacgcccgcaaaagcacauggcauguauuccccguaagcagcuccauacaacgacuccuagaccaaggcaaaucaucacucgacguaagaaucgcgugcgaacaaugccaagaaagcggagccagccuuguacuacugggcaagaaaaaaaaaaaagaagaggaaggcgaagggaaaaaaaaaggcggcggagaaggaggcgccggagcagacgaagaaaaagaacaaagccacagacccuuccuaaugcugcaagcacgacagagcgaagaccacccccaccgcagacgccgacgcggacucgaaugcgacggaaaaguaaacaucugcugcaagaaacaauucuucgucagcuucaaggacauaggauggaacgacuggauaauagcaccgagcggcuaccaugcaaacuacugcgaaggcgaaugcccaagccacaucgcaggcacaagcggaagcagccuaagcuuccacagcaccgucaucaaccacuacagaaugcgaggacacagcccauucgccaaccugaaaagcugcugcgucccgacgaaacuaagaccaaugagcaugcuauacuacgacgacggccaaaacauaauaaagaaagacauacaaaacaugauaguagaagagugcggcugcagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2288 - RNA, 1441 nt, Artificial Sequence
  mRNA product Design1 comprising derived and/or modified sequence from Homo sapiens__NP_002184.2__HsINHBB (opt9)
gggagaaagcuuaccauggacggccuccccggccgagcacuaggcgccgcaugccuccuccuacucgcagccggauggcuuggccccgaagcauggggcuccccaacaccaccucccacccccgcagcaccacccccacccccaccacccggcucccccggcggcagccaggacacaugcaccucaugcggcggcuuccgacgccccgaagaacucggccgcgucgacggagacuuccucgaagccguaaaacgccacauccuuucccgccuccaaaugcgaggccgacccaacaucacucaugccguccccaaagccgccauggucaccgcccuacgcaaacuccacgccggcaaaguccgagaagacggccgcgucgaaaucccccaccucgacggccacgccagccccggcgccgacggccaagaacgaguuuccgaaaucaucuccuucgccgaaaccgacggccuugcauccagccgaguacgccucuacuucuucaucucaaacgaaggcaaccaaaaccucuucguaguacaagccucccuuuggcucuaucucaaacuccuacccuacguacuagaaaaaggcucucgccgcaaaguaagagucaaagucuacuuccaagaacaaggccacggcgaccgauggaacauggucgagaaacgcgucgaccuaaaacgcuccgguuggcacacauucccccucaccgaagcaauccaagcccucuucgaacgaggggaacgccgccucaaccuagauguccaaugcgacagcugccaagaacuagccgucguccccgucuucgucgaccccggcgaggaaucccaccgacccuucgucgucguccaagcacgacucggcgacucucgccacagaauacguaaacgaggacucgaaugcgacggccgcaccaaccucugcugcagacaacaauucuucaucgacuuccgccucauuggauggaacgacuggaucauagcacccacuggauacuacggcaacuacugcgaaggcuccugccccgcauaccucgcaggaguccccggaagcgcauccucuuuccacaccgcaguagugaaccaauaccgcaugcgcggccucaaccccggaaccgucaacagcugcugcauccccaccaaacuuuccaccaugagcaugcucuacuucgacgacgaauacaacaucguaaaacgagacguccccaacaugauaguagaagaaugcggaugcgcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2289 - RNA, 3676 nt, Artificial Sequence
  mRNA product Design1 comprising derived and/or modified sequence from Homo sapiens__NP_000623.2__HsITGAM (opt9)
gggagaaagcuuaccauggcacuaaggguacuccuccucaccgcccucacacucugccacggauucaaccucgacacugaaaacgcaaugacauuccaagaaaacgcgcggggcuucggacaaucagugguccagcugcaagguagccgcgucgucgugggcgccccgcaagagaucguagcagccaaccagcgcggcucucuauaucaaugcgacuacucaacuggcaguugcgaacccaucagacuacaagucccagucgaagcugucaacaugagccuuggacuaucgcuagccgcaacaaccucgccuccucaacuccucgccugcggcccaaccguccaccagaccugcuccgagaauaccuacgucaaaggccucugcuuuuuguucggcucuaaccugcgccaacaaccgcaaaaauucccggaagcccugcgaggcugcccccaggaagacucagacauagcuuuccuaauugacggguccggcuccaucauaccccacgacuuccgucgaaugaaagaguucguaucaacuguaauggaacaacucaagaaaucuaaaacgcuguucucacucaugcaauacagcgaagaguucaggauccacuucaccuucaaagaguuccaaaacaacccaaacccacgcucgcucgucaagccaauaacccaacuccucggcagaacccauacagcuacaggcauccgaaaagucgucagagaacucuucaacaucaccaacggcgcccggaaaaaugccuucaaaauccuuguagucaucaccgacggugaaaaauucggcgauccucuuggauacgaagacguaauuccugaagccgacagagaaggagugauucgauacgucaucggagugggcgacgcauuccgcagugaaaagucccgacaagaacugaacaccaucgccuccaaaccuccccgagaccacguuuuccaaguaaacaacuucgaagcacucaagaccauccaaaaccaacugcgcgagaaaauauucgcaaucgaaggcacgcaaaccggguccaguucauccuucgaacacgaaaugucccaggaaggauuuuccgcagcgaucacuuccaacggacccuuacuauccacagucggcucguacgacugggccggcggcguauuccuauacaccagcaaagaaaaauccaccuucaucaacaugacccgggucgacagcgacaugaacgaugccuaccucggguaugcagccgcaauuauacuaaggaaccgcguucaaucccucguacugggagcaccccgcuaccagcacauaggccuaguggcuauguuccgucaaaacacaggcaugugggaauccaaugccaacguuaagggcacgcaaauaggagccuacuucggcgccucucuaugcuccguagacguagacuccaacggauccacagaccuaguacugaucggcgcaccccacuacuacgaacaaaccagaggcggacaagucucaguguguccacucccccgcggucgagcacgauggcaaugugaugccguccuauacggcgaacagggacaaccguggggccgcuuuggagcugcccucaccguccucggcgauguaaacggugacaaacucacugauguagccauaggcgcccccggagaagaggauaacagaggagccgucuaccuauuccacggcaccucaggaagcgggaucagcccaucccacucccaacgcauagcgggcucaaagcuaucgccucgccugcaguacuuuggccaaagccucuccggcggccaagaccucaccauggacggucuaguagaccucacaguaggagcccaaggacauguacuccuccuucgcucgcagcccguacucagaguaaaggccaucauggaauuuaauccaagagaagucgcccgaaacguauucgaaugcaacgaucaggugguuaaagguaaagaagccggugagguacgcguaugucuccacguacaaaaaucgacccgggacagacuucgcgaaggacaaauccaaucaguagucaccuacgaccucgcucuagacuccggucguccccauucacgagccguguucaacgaaaccaaaaacucuacaagacgccaaacucagguacucggcuugacacaaacuugugagaccuuaaaacuucagcugccaaacuguaucgaggaccccgucuccccaaucguacugcggcuuaacuucucucucgucggcacaccccuuuccgcguucgguaaccugagacccguccucgcagaagacgcccaacgacucuucaccgcacucuuccccuuugagaaaaacugcggcaacgacaacaucugccaagaugacuuaagcauuacauucucauuuaugagccuagacugucucguaguaggcggaccccgggaauuuaacgucacuguaaccgugcgcaacgacggugaagacuccuacaggacgcaagucacauucuucuucccccucgacuuaagcuaccguaaagucagcacccuucagaaccagcguucucaacgauccuggaggcuugcgugcgaaucagcuagcucaaccgaggucuccggcgcgcucaaauccaccucaugcuccaucaaccaccccaucuuccccgaaaacagcgaaguuaccuucaacauaaccuucgacguagacuccaaggcaucacuaggaaacaaacuccuccucaaggccaacguaaccuccgagaauaacaugccacgcacgaauaaaacagaguuccaauuggaacuccccguaaaauacgcgguauacauggucgucacuucucacggaguaucuaccaaauaccuaaacuuuacagccuccgaaaacacaagccgaguaaugcagcaucaauaccaagugucaaaccugggacaaagaucgcuaccuaucucacucgucuuccugguaccggucaggcuuaaccaaacggucauaugggaccgcccccaaguaaccuuuucagaaaaccucuccagcacaugccacaccaaagaaaggcucccaucacauagcgacuuccuagcagagcuccgcaaggcgcccgucguuaacugcuccauagcagugugccaacgcauccagugcgacauaccauucuuuggcauccaggaggaguucaacgcaacccucaagggaaaccucucuuucgacugguacauaaaaacuucccacaaucaccuccuaaucgucuccaccgcagaaauccucuucaacgacagcguauucacccuacuaccaggccagggagcguucguccggagccaaaccgaaaccaaaguggaaccauuugaaguacccaaccccuuaccccuaaucgucggguccucagucggcggccuacuacuucucgcuuuaaucaccgccgcccucuacaaacuaggcuuuuucaaaagacaauacaaagacaugauguccgaaggaggcccacccggggccgaaccgcaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2290 - RNA, 1621 nt, Artificial Sequence
  mRNA product Design1 comprising derived and/or modified sequence from Homo sapiens__NP_002415.1__HsMMP8 (opt9)
gggagaaagcuuaccauguucagccucaaaacgcuccccuuccuccuacuccuccacguccaaauaucuaaagccuuucccgucuccucuaaagaaaagaacacaaaaacaguacaagacuaccuggaaaaauucuaccaacucccauccaaccaauaccagucaacccgcaaaaacggcaccaacguaaucgucgaaaaacucaaagaaaugcaacgcuucuucggacucaacgucacugguaaaccaaacgaagaaacccucgacaugaugaaaaagccgagaugcggcguaccagacuccggcggcuuuaugcucacccccggaaacccgaaaugggaacgcaccaaccucaccuaccgcauacgaaacuacacaccccaacucucugaagccgaagucgaacgugccaucaaagacgccuucgaacucuggucaguagccuccccacucauuuucacacgaaucucccaaggugaagccgacaucaacaucgccuucuaccaacgagaccacggcgacaauucccccuuugacggcccaaacggaauacuagcccacgccuuccaacccggucaaggcaucggcggcgacgcccacuucgacgcagaagaaaccuggaccaauaccuccgcaaacuacaaccucuuccucgucgcagcccacgaauuuggacacucacucggccucgcacacucuagcgaccccggcgcccucauguaccccaacuacgccuuccgagaaaccuccaacuacucacucccgcaagacgacaucgauggaauccaagccaucuacggccucuccuccaacccaauccaacccacuggccccucaacccccaaacccugugacccaucccucacauucgacgccauuaccacccuccgcggggaaauccucuucuucaaagaucgcuacuucuggcgccgacacccccaacuacaacgcgucgaaaugaauuucaucucccucuucuggcccucccucccuaccggcauucaagccgccuacgaagacuucgaucgcgaccuuauuuuucucuuuaaaggcaaccaauacugggcccucucgggcuacgacauccuacaaggauaccccaaagacaucuccaacuacggauuccccucuuccguccaagcuauagacgccgccgucuucuaccgauccaagacauacuucuucgucaaugaccaauucuggcgauacgacaaccaacgacaguucauggaacccggguaccccaaauccauuuccggagccuucccaggcaucgaauccaaagucgacgccgucuuccagcaagaacacuucuuccacgucuucucaggcccccgcuacuacgccuucgaccuaaucgcccaacgcgucacccgcgucgcccgaggcaacaaauggcucaacugcagauacggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2291 - RNA, 2341 nt, Artificial Sequence
  mRNA product Design1 comprising derived and/or modified sequence from Homo sapiens__NP_004985.2__HsMMP9 (opt9)
gggagaaagcuuaccaugagccuguggcaaccccucguccucguccuucuuguccucgguugcuguuucgccgcaccccgccaacgacaguccacccucguccucuuccccggagaccuccgcacaaaccuaacugaccgccagcucgccgaagaauaucuuuaccgcuacggcuacacccgcgucgcagaaaugagaggcgaauccaaaucucuggggcccgcccuccuccuccuccaaaaacagcucucccuccccgagaccggagaacuugacuccgccacccucaaagcaaugcgaacaccacgcugcggcgucccagaccucggccgcuuccaaacguucgaaggcgaccuaaaauggcaucaucacaacauuaccuacuggauccaaaacuacuccgaagaccucccccgcgccguaauagacgacgccuucgccagagccuucgcgcucugguccgccgucaccccacuaacauucacccgcgucuacucacgcgacgccgacauagugauucaauucggugucgcugaacacggggacggcuaccccuucgacggaaaagacggccuacuggcccacgcauucccacccggacccggaauccaaggugacgcccacuuugacgacgacgagcuuuggucccuaggaaagggcgucguagucccaacacgcuucggaaacgcagacggcgccgcuugccacuuccccuucauauucgaaggaagguccuacucagcaugcaccaccgacggccgaucagacggccucccguggugcucgaccacagcgaacuacgacacagaugaccgcuucggcuucugccccucagaacgacuauacacccaggacggcaacgccgacggaaaacccugccaauucccauucauauuccagggucagagcuacuccgccuguacgacggacggcagaagcgauggcuaccgcuggugcgcaaccacagcgaacuacgaccgagacaaacuuuucgguuucuguccaacccgcgcagacuccaccguaaugggcggcaacagcgccggagaacuaugcgucuucccauucaccuuccucggaaaagaauacuccacuuguaccucggaaggcagaggcgacggaagacucuggugugcuacaaccucaaacuucgacuccgacaagaaauggggcuucugccccgaucaaggcuacagucuauuccucgucgcagcccacgaguucggacacgcccucgggcucgaccacuccuccguacccgaagcgcuaauguacccaauguacagguuuaccgaaggaccaccccuacacaaagacgacgucaacggaauccgccaccuuuacggcccccgccccgaacccgaaccucguccacccaccacaacaacaccccaacccaccgcaccgccaaccguaugucccacggggcccccuaccguccacccgagcgaaagacccacagcaggcccuaccgguccacccucagcaggacccacaggacccccuacugccggccccucuacagccacuacugucccccuaagcccaguugacgacgcaugcaacguaaacauauuugacgcaaucgccgaaaucggcaaccaacuuuaccuauucaaagacgguaaauacuggcgauucuccgaaggacgcggaagucgcccccagggcccauuccuaaucgcagacaaauggccagcccuaccgagaaaacuagauucagucuucgaagaaagacuaagcaagaaacucuucuucuuuucuggccgacaaguauggguauacacaggagccagcguacuaggccccagaagacucgacaaacuaggccuaggagcagacguugcacaaguaaccggagcucuccguuccggcagaggcaaaaugcuauuguucucuggccgcagacuuuggcgcuucgacgucaaagcucaaaugguagacccccgauccgcauccgaggucgaccgcauguuccccggcguccccuuagacacacacgacguuuuccaguaccgagagaaagccuacuucugccaagaccgcuucuacuggagaguaagcagcagguccgaacucaaccaaguagaccaagucggauacguaacauacgacauccuccaaugcccagaagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2292 - RNA, 1633 nt, Artificial Sequence
  mRNA product Design1 comprising derived and/or modified sequence from Homo sapiens__NP_002418.1__HsMMP13 (opt9)
gggagaaagcuuaccaugcaccccggaguccucgccgcauuccuauuccucuccuggacccacugccgagcccuaccccucccauccggcggagacgaagaugaccucuccgaagaagaccuccaauucgcagaacgcuaccuucgcuccuacuaccacccaaccaaucucgcaggcauccuaaaagaaaacgccgcauccucaaugaccgaacgccuccgagaaaugcaauccuucuucggccucgaagucaccggcaaacucgacgacaacacccucgacguaaugaaaaaaccuagaugcggagucccagacgucggagaauacaacguauucccccguacccugaaauggucaaaaaugaaccucacguacaggaucguaaacuacacccccgacaugacccauagcgaagucgaaaaagccuucaaaaaagccuucaaagucugguccgacgucacuccacuaaacuucacccgucuccacgacggcauagccgacaucaugauauccuucggaaucaaagagcacggcgacuucuaccccuucgacggacccagcggucuccucgcacacgccuuccccccgggccccaacuacggcggagacgcccacuucgaugacgacgagaccuggacauccuccucaaagggcuacaaccucuuccucgucgccgcccacgaauucgggcacucacuuggacucgaccauuccaaagaccccggagcccucauguucccaaucuacacauacaccggcaaaagucacuucaugcuccccgacgacgacguccaaggaauucaaagccucuacggccccggcgaugaagaccccaaccccaaacaucccaaaacacccgacaagugcgacccuucccucagccucgacgcaaucaccucacucagaggcgaaaccaugauauucaaagaccgauucuucuggcgacuccacccgcaacaaguagacgccgaacuauuccuaaccaaauccuucuggccagaacuaccuaaccgaaucgacgccgccuacgaacaccccagccacgaccucaucuucaucuuccgcggcagaaaauucugggcccucaacggcuacgacauccucgaaggcuaccccaaaaaaauaucugaacucggccucccaaaagaagucaaaaaaauauccgccgccguccacuucgaagacaccggcaaaacccuacucuuuagcggcaaccaagucuggcgauacgacgacacgaaccacaucauggacaaagacuacccucgccucaucgaagaagacuucccaggaaucggcgauaaaguagacgcgguuuacgaaaaaaacggcuacaucuacuucuucaacggcccaauacaauucgaauacuccauaugguccaaccgaauagucagagugaugccagcaaauucaauccucuggugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2293 - RNA, 1285 nt, Artificial Sequence
  mRNA product Design1 comprising derived and/or modified sequence from Homo sapiens__NP_001286.1__HsCCR1 (opt9)
gggagaaagcuuaccauggaaacccccaacacaaccgaagacuacgacaccaccacggaguucgacuacggcgacgccacccccugccaaaagguaaacgaacgagccuucggcgcacaacuucucccaccccuguacucccuaguguucguaauaggccucgucggcaauauccuagucguauuaguccucguccaauacaaacgccucaagaacaugaccucuauauaccuacucaaccuagcaaucuccgaccuccuuuuccuguucacccuccccuucuggaucgacuauaaacucaaagacgauugggucuucggagacgccaugugcaaaauccucuccggcuucuauuauaccggucucuacuccgaaaucuucuucauaauccuccucaccaucgacagauaucucgccauaguccacgccgucuuugcacuccgcgcccgcaccgucaccuucggugucaucaccuccaucauaaucugggccuuagccauccucgccuccaugcccggacucuacuuuuccaaaacccaaugggaguucacccaccauaccugcucccuccacuucccccacgaaucccuacgcgaauggaaacucuuccaagcacuaaaacuaaaccucuuuggccucguccuuccccuccuagucaugaucaucugcuacacaggcaucaucaaaauccuacuucgucgcccuaaugaaaagaaauccaaagccguccgacucaucuucgucaucaugauaaucuuuuuccucuucuggacacccuauaaucucaccauccucaucucugucuuccaagacuuccucuucacacacgaaugcgaacaaucccgccaccuagaccucgccguccaagucaccgaagucaucgcauacacccacugcugcgucaaccccgucauauacgcauucgucggcgaacgcuuccgcaaguaccuccgccaacucuuccaccgacgcgucgcaguccaucucgucaaaugguuacccuuucucucugucgaccgccucgaacgcguauccucaacaucacccuccaccggcgaacaugaacuuucagccggcuucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2294 - RNA, 853 nt, Artificial Sequence
  mRNA product Design1 comprising derived and/or modified sequence from Homo sapiens__NP_002598.4__HsPDGFA (opt9)
gggagaaagcuuaccaugcgaacccucgccugccuccuccuccucggcugcggcuaccucgcccacguacucgccgaagaagcagaaaucccccgcgaagucaucgaacgccucgcacgcucccaaauccacuccauccgugaccuccaacgacuccuggaaaucgacuccgucggauccgaagacucccuagacaccucccuaagagcccacggcguacacgccacaaaacacguccccgaaaaacgaccccuccccauccgcagaaaacgauccauagaagaagccguccccgccguaugcaaaacacgcacagucaucuacgaaauaccccgcucccaagucgacccaaccuccgccaacuuccuaaucuggccccccugcgucgaagucaaacgcugcaccggcugcugcaacaccuccucagucaaaugccaacccagccgcguccaccaccgcagcgucaaagucgcaaaagucgaauacguacgcaaaaaacccaaacucaaagaaguccaagucagacucgaagaacaccuagaaugcgcaugcgccaccaccagccuaaacccagacuaccgcgaagaagacaccggccgaccccgcgaauccggcaaaaaacgcaaacgcaaaagacuaaaacccaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2295 - RNA, 943 nt, Artificial Sequence
  mRNA product Design1 comprising derived and/or modified sequence from Homo sapiens__NP_002599.1__HsPDGFB (opt9)
gggagaaagcuuaccaugaaccgcugcugggcccuauuccuaagccuaugcugcuaccuccgccuagucucggccgagggcgaccccauccccgaagaacucuacgaaaugcucagcgaucacucaauccgcuccuucgacgaccuccaacgccuccuccacggcgaccccggcgaagaagacggagccgaacuagaccucaacaugacacgcucacacuccggaggggaacucgaaucccucgcacgcggccgccgcagccuaggcucacuaacaaucgccgaaccagcaaugaucgccgaaugcaaaacaagaacagaagucuucgaaaucucacgccgccuaaucgaccgcaccaacgccaacuuccuagucuggccacccugcgucgaaguccaaagaugcuccggaugcugcaacaacagaaacguccaaugccgccccacccaaguccaacuccgaccaguacaaguaagaaaaauagaaaucguccgcaaaaaacccaucuucaaaaaagcaaccguaacccucgaagaccaccucgcaugcaaaugcgaaaccgucgccgcagcccgccccgucacccgcagccccggcggaagccaagaacaacgagcaaaaacaccccaaaccagagucaccauccgaacaguccgcguacgcagaccccccaaaggaaaacaccgcaaauucaaacacacacacgacaaaaccgcccuaaaagaaacccuaggcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2296 - RNA, 1255 nt, Artificial Sequence
  mRNA product Design1 comprising derived and/or modified sequence from Homo sapiens__NP_057289.1__HsPDGFC (opt9)
gggagaaagcuuaccaugucccucuucggccuacuccuccuaacaucugcacucgccggccaacgccaaggcacccaagccgaauccaaccucagcucuaaauuccaauucuccucaaacaaagaacaaaacggcguccaagacccccaacacgaacgcauaaucacagucucaaccaacggcuccauccauucaccccguuucccccacaccuacccccgcaacaccguccuaguauggcgccuaguagcaguagaggaaaacgucuggauccaacucaccuucgacgaacgcuuuggacucgaagauccagaagacgauaucugcaaauacgacuucgucgaaguagaagaaccuuccgacggcacaauccuaggccgauggugcggcuccggcaccgucccaggcaaacaaauauccaaaggcaaccaaauccgcauccgcuucgucuccgacgaauacuuccccuccgaacccggcuucugcauccacuacaacaucgucaugccccaauucaccgaagccgucucccccuccguccucccacccuccgcacucccccuagaccugcucaacaacgccaucaccgccuucucaacccucgaggaccucauacgcuaccuagagcccgaacgcuggcaacucgaccucgaagaccucuaccgcccaacauggcaacuccucggcaaagccuucgucuucggccgcaaaucccgcguagucgaccuaaaccuacuaaccgaagaaguacgccucuacagcugcacaccacgcaacuucucagucuccauccgcgaagaacucaaacgcaccgacaccaucuucuggccaggcugccuccuaguaaaacgcugcggcgggaacugcgccugcugccuccacaacugcaacgaaugccaaugcgucccauccaaagucaccaagaaauaccacgaagugcuacaacuaagaccaaaaaccggcguccgcggacuccacaaaucucucaccgacguagcccuagaacaccacgaagaaugcgacugcgucugccgcggcuccaccggcggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2297 - RNA, 1312 nt, Artificial Sequence
  mRNA product Design1 comprising derived and/or modified sequence from Homo sapiens__NP_149126.1__HsPDGFD (opt9)
gggagaaagcuuaccaugcaccgccucauauuugucuacacacugauaugcgccaacuucuguucaugccgcgacaccuccgccaccccccaaucugccuccauaaaagcccucagaaacgccaaccuacgacgcgacgaccucuaccgacgcgacgaaacaauacaagucaaaggcaacggcuacguacaauccccacgcuuccccaacuccuacccccgcaaccuccuccucaccuggcggcuacacucccaagaaaacacccgcauacagcuuguauucgacaaccaauucggccuagaagaagccgagaacgacaucugccgauacgacuucgucgaagucgaagacaucagcgaaaccuccaccaucaucagaggaagauggugcggccacaaagaaguccccccucgaaucaaaucccgcacaaaccagauaaaaauaacauucaaauccgacgacuacuucgucgccaaacccggcuucaaaaucuacuacucccuccucgaagauuuccaacccgccgccgccuccgaaacaaacugggaauccgucaccuccuccauauccggugucucauacaacuccccaagcgucacagacccaacccucauugcagacgcacuagacaaaaaaaucgccgaauucgacaccgucgaggaccuccuaaaauacuucaaccccgaauccuggcaagaagaccucgaaaacauguaccucgacacaccccgcuacagaggccgcuccuaccacgaccgcaaauccaaggucgaccucgaccgccucaacgacgacgccaaacgcuacagcugcacaccccgcaauuacagugucaacaucagagaggaacuaaaacuagccaacguagucuucuucccacgcugccuacuaguacagcgaugcggcggcaacugcggcugcggcaccgugaacuggcgguccugcaccuguaacuccggcaaaacaguaaaaaaauaucacgaaguccuacaguuugaacccggacacaucaaacgccguggccgcgccaaaacuauggcccucguugacauccaacucgaccaccacgaacgcugcgacugcauaugcucuucccgcccaccccgauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2298 - RNA, 895 nt, Artificial Sequence
  mRNA product Design1 comprising derived and/or modified sequence from Homo sapiens__NP_003946.3__HsSOCS3 (opt9)
gggagaaagcuuaccauggucacccauucaaaauuccccgccgccggcaugucccgcccccucgacaccucccuccgccucaaaacauucuccuccaaauccgaauaccaacucgucgucaacgccguccgcaaacuccaagaauccggcuucuacuggucugccgucaccggaggcgaagccaaccuccuacuaucagccgaaccagcuggcaccuuccuaauccgugacuccuccgaccaacgccacuucuucacccucucagucaaaacccaauccggcaccaaaaaccuccgcauccaaugcgaaggcggauccuucucccuacaauccgacccccgcucaacucaaccagucccccgauucgacugcguccucaaacucguccaccacuacaugcccccacccggagcccccuccuuccccuccccacccaccgaacccuccuccgaaguccccgaacaacccuccgcccaaccccuccccggaucaccaccccgccgcgccuacuacaucuacuccggcggcgagaaaaucccccuaguccucucccgcccacucucauccaauguugccacccuacaacaccucugccguaaaaccguaaacggacaccuagacuccuacgaaaaaguuacccaacuacccggccccauccgcgaauuucucgaccaauacgaugcaccccucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2299 - RNA, 700 nt, Artificial Sequence
  mRNA product Design1 comprising derived and/or modified sequence from Homo sapiens__NP_003227.1__HsTGFA (opt9)
gggagaaagcuuaccaugguccccuccgccggccaacuagcccucuucgcccuaggcaucguccucgcagccugucaagcacucgaaaacuccaccuccccccucucagccgacccacccguagccgcagccguagucucccacuucaacgacugccccgacucccacacccaauucugcuuccacggaaccugccgauuccucguccaagaagacaaacccgccugcguaugccacuccggcuacgucggcgcccgcugcgaacacgccgaccuccuagccguaguagccgccucacaaaaaaaacaagccauaaccgcacucguagucgucuccaucgucgcccucgccguccuuauaauaaccugcguccucauccacugcugccaaguacgcaaacacugcgaauggugccgcgcccucaucugcagacacgaaaaacccuccgcacuacucaaaggccgcaccgccugcugccauuccgaaaccguaguauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2300 - RNA, 1390 nt, Artificial Sequence
  mRNA product Design1 comprising derived and/or modified sequence from Homo sapiens__NP_000651.3__HsTGFB1 (opt9)
gggagaaagcuuaccaugccaccauccggccuacgucuccucccucuccuccugccacuccucuggcuauuaguccuaacaccaggccgcccagccgccggccucucaaccugcaaaacuaucgacauggaacuugucaaacgcaaacgaauagaagccauccgcggccaaauccuauccaaacuccgccucgccuccccacccucacaaggcgaaguaccacccggaccccuacccgaagccguccuugcacucuauaacuccacccgcgaccgaguugcuggagaaucagccgaacccgaaccagagccagaagccgacuacuacgccaaagaagucacccgcguacucauggucgaaacacacaacgagauauacgauaaauucaagcaauccacccacuccauauacauguucuucaacaccucagaacuacgagaagccguccccgaacccguccuacuaucacgagccgaacuucgucuccuccgacucaaacucaaggucgaacaacacgucgaacucuaccaaaaauauucaaacaacucauggcgcuaccuaucaaaccgccuacuagcaccaucagacucacccgaauggcuaucauucgacgucaccggagucguccgccaauggcuaucacgaggaggcgaaaucgaaggcuucagacucucagcccacugcuccugcgacucccgagacaacacccuccaagucgacaucaacggcuucaccaccggccgacgcggagaccucgccacaauacacggaaugaaccgacccuuccuacuccucauggcaacaccacucgaacgcgcccaacaccuccaaucuucccgccaccgccgagcccuggacaccaacuacugcuucuccuccacugagaaaaauugcugcgugagacaacucuacaucgacuuccgcaaagaccucggcuggaaauggauccacgaaccaaaaggcuaccacgcaaacuucugccucggccccugcccauacauauggucccuagacacccaauacuccaaaguucuagcccuauacaaccaacacaaccccggcgccuccgcggcucccugcugcguuccccaagcccucgaaccccucccaauagucuacuacgucggccgcaaaccaaaagucgaacaacucuccaacaugaucguccgauccugcaaaugcuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2301 - RNA, 1462 nt, Artificial Sequence
  mRNA product Design1 comprising derived and/or modified sequence from Homo sapiens__NP_003229.1__HsTGFB2 (opt9)
gggagaaagcuuaccaugcacuacugcguacucucagccuuccucauccuccaccucgucaccgucgcacuaucacuaucuaccugcagcacacucgauauggaccaauucaugcgcaaacgcauagaagcuauccguggccaaauccuauccaaacucaagcucaccagcccacccgaagacuauccugaacccgaagaagucccacccgaaguaaucuccaucuacaacuccacacgcgaccuccuacaagaaaaagccucccgacgcgcagccgccugcgaacgagagcgcuccgacgaagaauacuacgccaaagaaguauacaagauagacaugccacccuucuucccuuccgaaaacgccauacccccaaccuucuaccgcccauacuuccgcaucguccgcuucgacgucucugcuauggagaaaaaugcauccaaccucgucaaagccgaguuccgcguauuccgccuacaaaaccccaaagcgcgcgucccugaacaacgcaucgaacucuaccagauccucaaauccaaagaucuuaccucgcccacacaacgcuacaucgacuccaaagucguaaagacccgcgccgaaggagaauggcucuccuucgacguaaccgacgccguccacgaauggcuacaccacaaagaccgcaaccucggcuucaaaaucucccuacacugccccugcugcaccuucguccccuccaacaauuacaucauccccaauaaauccgaagaacucgaagccagauucgccggcaucgacggcaccucaaccuacacauccggcgaccagaaaaccaucaaaucaacccgcaagaaaaacuccggcaaaaccccacaucuccuccucaugcuucucccuucauaccgucucgaaucucaacaaaccaaccgacgcaagaaacgcgcccucgacgccgccuacuguuuccgcaacguccaagacaacugcugccuacgaccccucuacauagacuucaaacgcgaccucggcuggaaauggauccacgaacccaaaggcuacaacgcuaacuucugcgcgggcgccugccccuaccuaugguccuccgacacccaacacucacgcguccucucccucuacaacaccaucaauccugaagccuccgccucacccugcugcgucucccaagaccucgaaccacucaccauacuauacuacaucggcaaaacgccuaaaauagaacaacuaucuaacaugaucgucaaauccuguaaaugcagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2302 - RNA, 1456 nt, Artificial Sequence
  mRNA product Design1 comprising derived and/or modified sequence from Homo sapiens__NP_003230.1__HsTGFB3 (opt9)
gggagaaagcuuaccaugaaaaugcaccuccaacgcgcccuagucguacucgcacuacucaacuuugccaccguaucacuuucacucuccacaugcaccacacucgacuuuggccacaucaaaaagaaacgagucgaagcuauacgaggccaaauccuaucaaaacuacgccucacauccccacccgaacccacaguaaugacccacguccccuaccaaguacucgcccuauacaacuccacccgcgaacuccuagaagaaaugcacggagaaagagaagaaggaugcacccaggaaaacaccgaaucagaauacuacgccaaagaaauacacaaauucgacaugauccaaggccucgccgaacacaacgaauuagccgucugccccaaagguaucacuagcaaaguauuccgauucaacguuuccucggucgagaaaaaccgcaccaaccuauuccgagccgaguuccguguccuccgcguccccaacccaagcucaaaacgcaacgaacaacgcaucgaacuuuuccaaauacuaagacccgacgaacacaucgccaaacaacgcuacauaggcggcaaaaaccucccaacccgcggcaccgcagaauggcucucuuucgacgucaccgacaccguacgugaauggcuacucagacgcgaauccaaccuaggucuagaaaucucaauacacugccccugccacaccuuccaaccaaacggagacauccucgaaaacauccacgaagucauggaaaucaaauucaaaggagucgacaaugaagacgaccacggacgaggcgaccucggacgacucaaaaagcaaaaagaccaccacaacccccaccucauccuaaugaugaucccaccccaccgccucgacaaccccggacaaggcggccaacgcaagaaacgcgcccucgacaccaacuacugcuuccgcaaccuagaagaaaacugcugcguacgcccccucuacaucgacuuccgacaagaccuaggcuggaaauggguccacgaacccaaaggauacuacgcaaauuucugcagcggaccaugcccauaccuacgguccgccgacacaacccacuccacaguccuaggacuuuauaacacccuaaacccagaagccuccgccucccccugcugugucccccaagaccuugaaccucucaccauccuuuacuacgucggcagaacccccaaagucgaacaacuauccaacauggucgucaaauccugcaaaugcuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2303 - RNA, 1603 nt, Artificial Sequence
  mRNA product Design1 comprising derived and/or modified sequence from Homo sapiens__NP_001057.1__HsTNFRSF1B (opt9)
gggagaaagcuuaccauggcacccguugcagucugggcagcccuugccgucggccucgaacucugggccgcugcccacgcccuccccgcccaaguugccuucacuccuuacgccccagaaccaggcuccacaugccgacuccgagaauacuaugaccaaacagcccaaaugugcugcuccaagugcucccccggccaacacgccaaagucuucuguaccaaaaccucugacaccgucugcgacuccugcgaagacuccacuuacacccaacuauggaacuggguacccgaaugccucuccugcggcuccagaugcucauccgaccaagucgaaacccaagcaugcacacgcgaacaaaaccgaaucugcacaugcaggcccggaugguacugcgcacucuccaaacaagaaggcugccgccucugcgcaccccuccgaaaaugccgaccaggcuucggcgucgcccgcccaggaacagaaaccuccgacguagucugcaaacccugcgccccuggcacuuucuccaacacaaccagcucaaccgacauaugccgcccacaccaaaucugcaacgucguugcaauacccggcaacgcauccauggacgccgucugcaccuccacaucgcccacccgauccauggcacccggcgccguccaccucccccaaccugucucaacccgaucacaacacacacaacccacccccgaacccucaaccgccccauccaccucauuccuucuacccaugggccccuccccacccgccgaaggcuccaccggagacuucgcccucccagucggccuaaucgucggcgucaccgcccuaggccugcucaucaucggagucgucaacugcguaaucaugacccaagucaaaaagaagccccuaugucuccaaagagaagcaaaaguaccucaccuccccgccgacaaagcccgcggcacacaaggccccgaacaacaacaccuccuaaucaccgccccaucauccuccucaucaagccucgaaucaucagcaucagcucucgaccgccgcgccccaaccagaaaccaaccccaggccccaggcguagaagccuccggagccggagaagcccgagccucaacaggcuccuccgacagcucucccggcggccacggcacacaaguaaacguaaccugcaucgucaauguaugcucgucauccgaccauuccucccaaugcucaagccaagccucaucaaccaugggcgacaccgacucaagcccaucugaaucccccaaagacgaacaaguacccuucaguaaagaagaaugugccuuccgaucccaauuagaaacccccgaaacacuccuaggauccaccgaagaaaaacccuuaccccucggugucccagacgccggcaugaaacccuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2304 - RNA, 730 nt, Artificial Sequence
  mRNA product Design1 comprising derived and/or modified sequence from Homo sapiens__NP_002623.2__HsPGF (opt9)
gggagaaagcuuaccaugccggucaugcgcuuguucccgugcuuucuacagcucuuggcagggcucgcacucccagccgugcccccgcaacagugggcguuaucggccgggaacgggagcucggaaguggaagugguaccguuccaggaagugugggggcgcucguacugucgcgcgcuagagcgccuggucgaugucgugagugaguacccgagcgaggucgagcacauguucucgcccucaugcgugagcuugcucaggugcacgggcuguugcggggacgagaaccugcacugugucccggucgagaccgcgaacgugaccaugcaauugcucaagaucaggagcggggacaggcccucguacguggaauugaccuucagccagcacguacgcugugaaugucgcccacucagggaaaagaugaagccagaacgcaggcgaccgaaagggcgcgggaaaaggcgcagagaaaagcaaaggcccacagacugucacuuaugcggggacgcggucccgaggcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2305 - RNA, 1456 nt, Artificial Sequence
  mRNA product Design1 comprising derived and/or modified sequence from Homo sapiens__NP_001020537.2__HsVEGFA (opt9)
gggagaaagcuuaccaugacagaccgccagacagacaccgcgccaucgcccucguaccaccuccugcccgggagaaggcgcacggucgacgccgcagccucgcgaggacaagggcccgagccagcgccaggaggcgggguagagggcgugggagcgcgaggggucgcgcucaaacucuucguccagcuucugggcugcagcagguucgggggcgcaguagugcgcgcaggcgaagccgagcccucaggcgcggccaggagcgcaagcucaggcagagaggaaccccagcccgaggagggggaagaagaagaggaaaaagaagaagaaagggguccacaauggcgccugggcgcgcgcaagccaggaaguuggaccggagaagcagcagugugcgcggacucugcaccagccgcgcgagcgccccaggcauuggccagagcaucaggcagaggaggacgaguggcaagaagaggagccgaggaaucaggaccgccccauagcccaagcaggcgagggagugcgagcagagccggaccagggcgcgcaagcgagacaaugaacuuccuccugagcuggguacacuggucgcuagcacuguugcucuaccuccaucacgcaaaauggagccaggccgcgccaauggccgagggaggaggacaaaaccaccacgagguagugaaauucauggacgucuaccaaaggagcuauugccaccccauagaaacgcuaguggacauauuccaggaauauccagacgaaauagaguacauauucaaaccaagcugcgugccgcucaugaggugcggcggaugcuguaacgaugaagggcuagagugcguacccacggaagagagcaacaucaccaugcagaucaugaggauaaaaccgcaccagggccagcacauaggagagaugucauuccugcaacacaacaagugcgagugccggcccaagaaagaccgagcaagacaggaaaagaaaucaguaaggggaaagggcaagggacagaaaagaaaaagaaagaagaguagguacaagagcuggaguguauacguaggggcgagaugcugccugaugccauggagccuaccgggaccgcacccaugcggacccugcagcgaacgcaggaaacaccuguucguccaggacccacaaacaugcaaguguucaugcaagaacacagacucgcgcuguaaagcacgccaacucgagcuuaacgaaaggacaugccgcugcgacaaacccaggagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2306 - RNA, 916 nt, Artificial Sequence
  mRNA product Design1 comprising derived and/or modified sequence from Homo sapiens__NP_001165094.1__HsVEGFA (opt9)
gggagaaagcuuaccaugaacuuccuacucagcuggguccacuggucacucgcccuccuccucuaccuccaccacgccaaauggucccaagccgcccccauggccgaaggcggcggccaaaaccaccacgaaguaguaaaauucauggacguauaccaacgcagcuacugccaccccaucgaaacccuaguagacaucuuccaagaauaccccgacgaaaucgaauacauauucaaacccuccugcgucccacucaugcgcugcggcggcugcugcaacgacgaaggccucgaaugcguccccacagaagaaagcaacaucacaaugcagauaaugcgaaucaaaccccaccaaggccagcacaucggcgaaaugucauuccuccaacacaacaaaugcgaaugccgaccaaaaaaagaccgcgcaagacaagaaaaaaaauccgucagaggcaaaggcaaaggccaaaaacgaaaacgcaaaaaaucccgcuacaaaagcuggucagucuacguaggcgcccgcugcugccucaugccauggucccuccccggcccccaccccugcgggcccugcagcgaacgccgcaaacaccucuucguccaagacccacaaaccugcaaaugcuccugcaaaaacaccgacucccgcugcaaagcccgccaacucgaacuaaacgaacgcaccugccgcugcgacaaaccccgaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2307 - RNA, 841 nt, Artificial Sequence
  mRNA product Design1 comprising derived and/or modified sequence from Homo sapiens__NP_003368.1__HsVEGFB (opt9)
gggagaaagcuuaccauguccccccuccuccgccgacuccuacuagccgcccuccuacaacucgcccccgcacaagcccccgucucccaacccgacgcccccggccaccaacgcaaagucguauccuggauagacguauacacccgcgccaccugccaaccacgagaagucguagucccacucacagucgaacucaugggcaccgucgcaaaacaacucguaccaucaugcguaaccguccaacgaugcggcggcugcugccccgacgacggccuagaaugcguccccaccggccaacaccaagucagaaugcaaauccucaugauccgcuaccccuccucccaacucggcgaaaugucacucgaagaacacucccaaugcgaaugccgccccaaaaaaaaagacucagccguaaaacccgaccgcgccgccacaccacaccaccgaccccaaccccgcucagucccaggcugggacuccgcccccggcgcacccucccccgccgacaucacccaccccacccccgcacccggccccuccgcacacgccgccccauccaccaccuccgcccucacccccggccccgccgccgccgccgccgacgccgccgccagcuccgucgcaaaaggcggcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2308 - RNA, 1477 nt, Artificial Sequence
  mRNA product Design1 comprising derived and/or modified sequence from Homo sapiens__NP_005420.1__HsVEGFC (opt9)
gggagaaagcuuaccaugcaccuccucggauucuucuccgucgccugcucccuacucgccgccgcacuccuccccggcccacgcgaagcaccagcagccgccgccgcauucgaaucaggccucgaccuauccgacgccgaaccagacgccggcgaagccaccgccuaugcaagcaaagaccucgaagaacaacuacgauccguaucauccguggacgaacuaaugaccguccucuacccagaauacuggaaaauguacaaaugccaacuccgaaaaggcggauggcaacauaaccgcgaacaagccaaccucaacagccgaaccgaagaaacaaucaaauucgccgccgcccacuacaacacggaaauacuaaaauccaucgacaacgaauggagaaaaacacaaugcaugccccgugaagucugcaucgacgucggcaaagaauuuggcgucgccaccaacacauucuucaaaccacccugcgucucaguauaccgaugcggcgggugcugcaacuccgaaggccuacaaugcaugaacaccuccaccucauaccucucaaaaacccucuucgaaauaacaguuccacucagccaaggccccaaacccgucacgauauccuucgcaaaccauacuucaugccgcugcaugucaaaacuugacguauaccgccaaguccacuccaucauccgaagaucacuacccgccacccuaccccaaugucaagccgccaacaaaaccugccccaccaacuacauguggaacaaccacauuugccgcugccuagcccaagaagacuucauguucucaucggacgccggcgacgacucaaccgacggcuuccacgacauaugcggccccaacaaagaacuagacgaagaaacaugccaaugcgucugccgcgccggccuccgacccgcauccugcggaccccacaaagaacuggaccgcaacucaugccaaugcgucugcaaaaacaaacucuuccccucccaaugcggcgcaaaccgcgaguucgacgaaaauaccugccaaugcgucugcaagcgaaccugcccacgcaaccaaccccucaaccccggaaagugcgccugcgaaugcaccgaaagcccacaaaaaugccuucucaaaggaaagaaauuccaccaccaaaccugcucaugcuaccgccgccccugcaccaaccgccaaaaagccugcgaacccggcuucucauacuccgaagaaguaugccgcugcguuccaagcuacuggaaacgcccccaaauguccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2309 - RNA, 1282 nt, Artificial Sequence
  mRNA product Design1 comprising derived and/or modified sequence from Homo sapiens__NP_004460.1__HsVEGFD (opt9)
gggagaaagcuuaccauguaccgagaauggguagucgucaacgucuucaugaugcucuacguccaacugguccaagguucauccaacgaacauggccccgucaaacgcuccucccagagcacccucgagcgcuccgaacaacaaauccgcgcugccuccucucuagaagaacuucuccgaaucacccacucugaagacuggaaauuauggcgaugccgccuacgucucaagagcuucaccucaauggacucccgauccgcaucccaccgcucuacacgauucgccgccaccuucuacgacaucgaaacccucaaagucauagacgaagaauggcaacgcacccaaugcuccccaagggaaaccugcgucgaaguagccuccgaacucggcaaauccaccaacacauucuucaaaccucccugcgucaacgucuuccgcugcggcggcugcugcaacgaagaaucccucaucugcaugaacacauccaccuccuacauauccaaacaacuauucgaaauuucugucccccucaccucgguccccgaacucguccccgucaaaguagccaaccacaccggcugcaaaugccugcccaccgccccacgacaccccuauuccaucauccgacgcuccauacagauucccgaagaagaccgaugcucccacucaaagaaacucugccccauagacaugcuaugggacucaaacaaaugcaaaugcguccuccaagaagaaaacccacucgccggcacugaagaccacucgcaccuccaagaacccgcccucugcggaccccacaugauguucgacgaagaccgcugcgaaugcgucugcaaaaccccaugccccaaagaccucauccaacaccccaaaaacugcucaugcuucgaaugcaaagaaucccucgagaccugcugccaaaaacacaaacucuuccaccccgauaccugcuccugcgaagaccgcugccccuuccacacacgcccaugcgccuccggcaaaaccgcaugcgcaaaacacugccguuucccaaaagaaaaacgcgccgcccaaggcccccacucccgcaaaaaccccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2310 - RNA, 847 nt, Artificial Sequence
  mRNA product Design1 comprising derived and/or modified sequence from Homo sapiens__NP_061986.1__HsFGF21 (opt11)
gggagaaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2311 - RNA, 1627 nt, Artificial Sequence
  mRNA product Design1 comprising derived and/or modified sequence from Homo sapiens__NP_002412.1__HsMMP1 (opt11)
gggagaaagcuuaccaugcacagcuucccaccccuccuccuccuccuguucuggggcgucgucucacacuccuuucccgcuacccucgaaacccaagaacaagacgucgaccucguacaaaaguaccucgaaaaauacuacaaccuuaaaaacgacggccgucaagucgaaaagcgccgcaacucaggccccgucguugaaaaacucaaacaaaugcaagaauuuuucggccugaaagucacaggaaaacccgacgccgaaacccucaaagucaugaaacaaccccgcugcggaguccccgacguagcccaauucguccuaaccgaaggcaacccccgcugggaacaaacccaccucacauaccgcaucgaaaacuacacccccgaccuuccccgcgccgacgucgaccacgccauagaaaaagcauuccaauuaugguccaacgucaccccacucaccuucacuaaggucuccgaaggccaagcagacauaaugaucucuuucguccgcggcgaccaccgagacaacucccccuucgacggccccggaggcaaccuggcccacgcauuccaaccaggccccggcaucggaggagacgcccacuucgacgaagacgaacgcuggacaaacaauuucagagaauacaacuuacaucgcgucgccgcccacgaacucggccacagccucggccucucacacuccacagauaucggcgcccuaauguaccccuccuacaccuucuccggcgacguccaacuagcccaagacgacauagacggcauccaagccauauacggccgaucccaaaaccccguacagcccaucggaccacaaacucccaaagccugcgacuccaaacucaccuucgacgccaucaccacaauacgaggcgaagugauguucuucaaagacagauucuauaugagaaccaacccguucuaccccgaagucgaacuuaacuucaucucagucuucuggccacaacuaccaaacggccucgaagcagccuacgaauuugccgaccgcgacgaaguccgauucuucaagggcaacaaauacugggccguccaaggccaaaacguccugcacggcuacccaaaagacaucuauuccagcuucggcuucccacgcacugucaaacauaucgaugccgcccucagcgaagaaaacacaggcaaaacauacuucuucgucgcuaacaaauacuggcgcuacgaugaauacaaacgcuccauggacccaggcuauccuaaaaugaucgcccacgacuuccccggcaucggccacaaggucgaugccgucuucaugaaggacggauucuucuacuucuuccacggaacccgccaauacaaguucgaccccaaaacuaagcgaauccucacccuccaaaaagccaacuccugguucaacugccgcaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2312 - RNA, 1387 nt, Artificial Sequence
  mRNA product Design1 comprising derived and/or modified sequence from Homo sapiens__NP_002412.1__HsMMP1(1-19,100-469) (opt11)
gggagaaagcuuaccaugcauucauucccaccacuacuacuccuccuauucuggggagucgucucccauuccuucguccucacagaaggcaacccccgcugggaacaaacccaccucaccuaccgcauagaaaacuacaccccagaccucccccgcgccgacgucgaccacgccaucgaaaaagcguuccaacuauggucuaacguaacaccccucaccuucaccaaagucuccgaaggccaagccgacauaaugaucucauucgucagaggcgaccaccgcgacaacucucccuucgacggccccggaggcaaccucgcacacgccuuccaacccggccccggaaucggcggcgacgcccacuucgacgaagacgaacgcuggaccaacaacuuccgagaauacaaccuccaccgcgucgccgcacacgaacucggccacagccucgggcucucacacuccaccgacaucggugcccucauguaccccucauacacauucucuggcgacguccaacucgcacaagacgacaucgacggcauccaagccaucuacggccgaucccaaaacccaguccaacccauaggcccacagacacccaaagcaugcgacuccaaacucaccuucgacgccauaaccaccauccgcggcgaaguaauguucuucaaagacagauucuacaugcgcaccaaccccuucuacccagaaguugaauuaaacuucaucuccgucuucuggccacagcucccaaacggucucgaagccgcauacgaauuugcagaccgagacgaaguacgauucuucaaaggcaacaaauauugggccguacaggggcaaaauguccuccacggcuacccuaaagacaucuacuccuccuucggcuucccccgcacagucaaacacaucgacgccgcccucuccgaagaaaacaccggcaaaaccuacuucuucgucgccaacaaauacuggcgauacgacgaauacaaacgcuccauggaccccggauaccccaaaaugaucgcccacgacuuccccggcaucggccacaaaguagacgccguuuucaugaaagacggauucuucuacuucuuccacggaacaagacaguacaaauucgacccaaagaccaaacggauccucacccuccaaaaagcaaacuccugguucaauugccgcaaaaauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2313 - RNA, 3574 nt, Artificial Sequence
  mRNA product Design1 comprising derived and/or modified sequence from Clostridium histolyticum__BAA77453.1__ColG (opt11)
gggagaaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgccgaacgaggagaacagcaagaagguggaggacuccaagaacgacaaggucgagcacgugaagaacaucgaggaggccaagguggagcaggucgcccccgaggucaagagcaaguccacgcugcggagcgccuccaucgccaacaccaacagcgagaaguacgacuucgaguaccugaacggccucuccuacaccgagcugaccaaccugaucaagaacaucaaguggaaccagaucaacggccucuucaacuacagcacggggucccagaaguucuucggggacaagaaccgcgugcaggcgaucaucaacgcccugcaggagagcggccggaccuacaccgccaacgacaugaaggggaucgagaccuucacggaggugcugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggucaagagccaguuccaccgcguggugggcaacgacaaggcccucgagguggggaacgcggacgacguccugacgaugaagaucuucaacucccccgaggaguacaaguucaacaccaacaucaacggcgugagcaccgacaacgggggccuguacaucgagccccgggggaccuucuacacguacgagcgcacgccccagcaguccaucuucagccucgaggagcuguuccggcacgaguacacccacuaccugcaggcccgcuaccucguggacggccuguggggccaggggccguucuacgagaagaaccggcugaccugguucgacgagggcaccgccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccucaacaccgacgucaagagcuacgacgagaucaucaagaagcuguccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagucccaguacuucaacaccuucacccugcgcggcaccuacacgggcgagaccagcaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2314 - RNA, 3298 nt, Artificial Sequence
  mRNA product Design1 comprising derived and/or modified sequence from Clostridium histolyticum__BAA77453.1__HsALB(1-18)_ColG(111-1118) (opt11)
gggagaaagcuuaccaugaagugggugacauucaucagccuccucuucuuauucuccagcgccuacuccaucgccaacaccaacagcgagaaguacgacuucgaguaccugaacggccucucuuacacggagcugaccaaucugaucaagaacaucaaguggaaccagauuaacggguuauucaacuacagcaccggcucccagaaguucuucggggacaaaaaccgcguccaggcgauuaucaacgcccugcaggagagcggucggaccuacaccgcuaacgacaugaaggggaucgagaccuucaccgagguucugcgcgccggcuucuaccucggcuacuacaacgacgggcuguccuaccugaacgaccggaacuuccaggacaagugcauccccgccaugaucgcgauccagaagaacccgaacuucaagcucggcaccgccgugcaggacgaggucaucacgagccuggggaagcugaucggcaacgccuccgccaacgcggagguggugaacaacugcguccccgugcucaagcaauuccgcgaaaaccugaaccaguacgcccccgacuacguaaaggggaccgccgucaacgagcugaucaagggcaucgaguucgacuuuagcggcgccgccuacgagaaagacgugaagaccaugcccugguacgggaagaucgacccguucaucaacgagcucaaggcgcugggccuguacgggaacaucaccuccgccacggagugggccagcgacgugggcaucuacuaccucuccaaguucggccuguacucgaccaaccggaaugacaucguacagucccuggagaaggccguggacauguacaaguacgggaagaucgccuucguggcgauggagcgcaucaccugggacuacgacgguaucgggagcaacggcaagaaggucgaccacgacaaauuccucgacgacgccgagaagcacuaccugcccaagaccuacacguucgacaacggcaccuucaucauccgggccggugacaagguguccgaggagaagaucaagcgccuguacugggccagccgagaggucaagagccaguuccaccgcguggugggcaacgacaaggcccucgagguggggaacgcggacgacguccugaccaugaagaucuucaacuccccugaggaguacaaguucaacaccaacaucaacggcguguccacggauaacgggggccuguacaucgagccccgggggaccuucuacaccuaugagcgcaccccgcagcaguccaucuucagccucgaggagcuguuucggcacgaguacacgcacuaccugcaggcccgcuacuuaguggacggccuguggggccaggggcccuucuacgagaagaaccggcugaccugguucgacgagggcaccgccgaguucuucgccgguuccacccgcacgagcggcguccucccccgaaaguccauccugggguaccuggccaaggacaagguggaccaccgcuacagccucaagaagacccugaacuccggcuacgacgacucggacuggauguucuacaacuacggcuucgcggucgcccacuaccuguacgagaaggacaugcccaccuucaucaagaugaacaaggccauccucaacaccgacgugaaguccuacgacgagaucaucaagaagcugagcgacgacgccaacaagaacacggaguaccagaaccacauccaggagcuggcggacaaauaccagggugccggcaucccucucguguccgacgacuaccugaaggaccacggguacaagaaggccagcgaggucuacuccgagauuagcaaggccgccucccugaccaacaccagcgugaccgcggagaagucccaguacuucaacacguucacccuccggggcaccuacaccggcgaaaccagcaagggggaguucaaggacugggacgagaugagcaagaagcuggacggcacgcuggaaucccuggccaagaacagcugguccggguacaagacccucaccgccuauuuuaccaacuaccgcgugacgagcgacaacaagguccaguacgacgugguguuccacggcguccugaccgacaacgccgacaucuccaacaacaaggcccccaucgcgaaggugaccgggcccagcaccggcgccgugggccggaacaucgaguucuccgggaaggacucuaaggacgaggacggcaagauagucuccuacgacugggacuucggggacggcgccacgucccgcgggaagaacuccguccacgccuacaagaaggccggcaccuacaacgugacccugaaggucaccgacgacaaaggcgcgacggccaccgagagcuucaccaucgagaucaagaacgaggacaccacgacccccaucaccaaggagauggagccgaacgacgacaucaaggaggccaacgggcccaucguggagggcgugaccgucaagggggaccucaacggcuccgacgacgcagacacguucuacuucgaugugaaggaggacggggacgugaccaucgagcugcccuacagcggcuccagcaacuucaccuggcuggucuacaaggagggcgacgaccagaaccacaucgcguccgggaucgacaagaacaacagcaaggugggcaccuucaagagcacgaaggggcgccacuacguguucaucuacaagcacgacuccgccagcaacaucuccuacagccucaacaucaagggccuggggaacgagaagcugaaggagaaggagaacaacgacuccagcgacaaggccaccgucauccccaacuucaacaccaccaugcagggcucccuccugggcgacgacagccgggacuacuacuccuucgaggugaaggaggagggggaggugaacaucgagcuggacaagaaggacgaguucggcgucacguggacccuccacccggaauccaacauaaacgaccgcaucaccuacggccagguggacgggaacaagguguccaacaaggucaagcugcggcccggcaaguacuaccugcucguguacaaguacagcggguccggaaacuacgagcugcgcgugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2315 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt11)
gggagaaagcuuaccaugaagugggugaccuucaucagccuccucuuccuguucuccagcgccuacuccaugaagaagaacauccugaagauccucauggacagcuacuccaaggagagcaagauccagaccguccgccgggugacguccgugagccugcuggccgucuaccucaccaugaacaccuccagccuggugcuggcgaagcccaucgagaacaccaacgacacguccaucaagaacguggagaagcuccgcaacgccccgaacgaggagaacagcaagaaggucgaggacuccaagaacgacaagguggagcacgugaagaacaucgaggaggccaaggucgagcaggucgcccccgaggucaagagcaaguccacccugcggagcgccucccgccggcgccggaagcgcaucgcgaacaccaacagcgagaaguacgacuucgaguaccugaacggccucuccuacaccgagcugacgaaccugaucaagaacaucaaguggaaccagaucaacgggcuguucaacuacagcaccggcagccagaaguucuucggggacaagaaccgggugcaggccaucaucaacgcccugcaggaguccggccgcaccuacaccgccaacgacaugaaggggaucgagacguucaccgaggugcugcgggcgggcuucuaccucggcuacuacaacgacgggcugagcuaccugaacgaccgcaacuuccaggacaagugcauccccgccaugaucgccauccagaagaaccccaacuucaagcucggcaccgccgugcaggacgaggugaucaccucccuggggaagcugaucggcaacgccagcgcgaacgccgagguggugaacaacugcgucccggugcucaagcaguuccgggagaaccugaaccaguacgcccccgacuacgugaaggggacggccgucaacgagcugaucaagggcaucgaguucgacuucuccggcgccgcguacgagaaggacgugaagaccaugcccugguacgggaagaucgaccccuucaucaacgagcucaaggcccugggccuguacgggaacaucaccagcgccaccgagugggccuccgacgugggcaucuacuaccucagcaaguucggccuguacuccacgaaccgcaacgacaucguccagagccuggagaaggccguggacauguacaaguacgggaagaucgcguucgucgccauggagcggaucaccugggacuacgacggcaucggguccaacggcaagaagguggaccacgacaaguuccucgacgacgccgagaagcacuaccugccgaagaccuacaccuucgacaacgggacguucaucauccgcgccggcgacaaggugagcgaggagaagaucaagcggcuguacugggccucccgcgaggucaagagccaguuccaccggguggugggcaacgacaaggcgcucgaggucgggaacgccgacgacgugcugaccaugaagaucuucaacucccccgaggaguacaaguucaacaccaacaucaacggcgugagcaccgacaacgggggccuguacaucgagccccgcgggacguucuacaccuacgagcggacgccccagcaguccaucuucagccucgaggagcuguuccgccacgaguacacccacuaccugcaggcccgcuaccucgucgacggccuguggggccaggggccguucuacgagaagaaccggcugaccugguucgacgagggcaccgccgaguucuucgcgggguccacccgcaccagcggcgugcucccccgcaagagcauccugggguaccuggccaaggacaagguggaccaccgguacucccucaagaagacgcugaacagcggcuacgacgacuccgacuggauguucuacaacuacggcuucgccgucgcccacuaccuguacgagaaggacaugcccaccuucaucaagaugaacaaggccauccugaacaccgacgucaagagcuacgacgagaucaucaagaagcucuccgacgacgcgaacaagaacaccgaguaccagaaccacauccaggagcuggccgacaaguaccagggggccggcaucccccuggugagcgacgacuaccucaaggaccacggguacaagaaggccuccgagguguacagcgagaucuccaaggccgcgagccugaccaacacguccgugaccgccgagaagucccaguacuucaacaccuucacccugcggggcacguacaccggcgagaccagcaagggggaguucaaggacugggacgagaugagcaagaagcucgacggcacccuggagucccuggccaagaacagcugguccggguacaagacgcucaccgccuacuucaccaacuaccgcgugaccagcgacaacaagguccaguacgacgugguguuccacggcguccugacggacaacgccgacaucagcaacaacaaggcgccgaucgccaaggugaccgggcccuccaccggcgccgugggccggaacaucgaguucagcgggaaggacuccaaggacgaggacggcaagaucgucagcuacgacugggacuucggggacggcgccaccucccgcgggaagaacagcgugcacgcguacaagaaggccggcacguacaacgugacccugaaggucaccgacgacaagggcgccaccgccacggaguccuucaccaucgagaucaagaacgaggacaccaccacgcccaucaccaaggagauggagcccaacgacgacaucaaggaggccaacgggccgaucguggagggcgugaccgucaagggggaccucaacggcagcgacgacgcggacaccuucuacuucgacgugaaggaggacggggacgugacgaucgagcugcccuacuccggcagcuccaacuucaccuggcuggucuacaaggagggcgacgaccagaaccacaucgccagcgggaucgacaagaacaacuccaaggugggcaccuucaagagcaccaaggggcggcacuacguguucaucuacaagcacgacuccgccagcaacaucuccuacagccucaacaucaagggccuggggaacgagaagcugaaggagaaggagaacaacgacuccagcgacaaggccacggucauccccaacuucaacaccaccaugcagggcagccuccugggcgacgacucccgcgacuacuacagcuucgaggugaaggaggagggggaggugaacaucgagcuggacaagaaggacgaguucggcgucaccuggacgcuccaccccgaguccaacaucaacgaccggaucaccuacggccagguggacgggaacaaggugagcaacaaggucaagcugcgcccgggcaaguacuaccugcucguguacaaguacuccgggagcggcaacuacgagcugcgggugaacaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2316 - RNA, 3322 nt, Artificial Sequence; identical to SEQ ID NO: 1488
  mRNA product Design1 comprising derived and/or modified sequence from Clostridium histolyticum__BAA34542.1__ColH (opt11)

SEQ ID NO: 2317 - RNA, 3283 nt, Artificial Sequence
  mRNA product Design1 comprising derived and/or modified sequence from Clostridium histolyticum__BAA34542.1__ColH (opt11)
gggagaaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugccggaccucuuccaguacagcuccgacgcgaaggaguucuacggcaacaagacccggaugagcuucaucauggacgagaucgggcgccgggcgccccaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgccaccggccuccuggccggcaacgagaccgccccgcccgagguggucaacaacuucacgcccauccugcaggacugcaucaagaacaucgaccgguacgcccucgacgaccucaagagcaaggcccuguucaacgugcucgcggccccgaccuacgacaucaccgaguaccugcgcgccaccaaggagaagcccgagaacacgcccugguacgggaagaucgacggcuucaucaacgagcugaagaagcucgcccuguacgggaagaucaacgacaacaacuccuggaucaucgacaacggcaucuaccacaucgcgccccuggggaagcuccacagcaacaacaagaucggcaucgagacccugaccgaggugaugaaggucuacccguaccuguccaugcagcaccuccagagcgccgaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggggccgagcuguucgccgggagcacccgcaccuccggcauccugccgcgcaagagcaucgucuccaacauccacaacacgacccggaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccucuccagcaacuacgcccugaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagucccaguacuucagcacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugcccaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2318 - RNA, 3217 nt, Artificial Sequence
  mRNA product Design1 comprising derived and/or modified sequence from Clostridium histolyticum__BAA34542.1__HsALB(1-18)_ColH(41-1021) (opt11)
gggagaaagcuuaccaugaagugggugaccuucaucagccugcuguuccuguucuccagcgccuacuccguccagaacgagagcaagcgcuacaccguguccuaccugaagacgcucaacuacuacgaccugguggaccugcucgucaagaccgagaucgagaaccugcccgaccuguuccaguacagcuccgacgccaaggaguucuacggcaacaagacccggaugagcuucaucauggacgagaucgggcgccgggcgccgcaguacaccgagaucgaccacaagggcauccccacgcucguggaggugguccgcgccggguucuaccugggcuuccacaacaaggagcugaacgagaucaacaagcgguccuucaaggagcgcgugauccccagcauccucgccauccagaagaaccccaacuucaagcuggggaccgaggugcaggacaagaucgucuccgccaccggccugcucgccggcaacgagaccgcgccgcccgagguggugaacaacuucacgcccauccugcaggacugcaucaagaacaucgaccgguacgcccuggacgaccucaagagcaaggcccuguucaacguccuggccgcgcccaccuacgacaucaccgaguaccuccgcgccaccaaggagaagccggagaacacgcccugguacgggaagaucgacggcuucaucaacgagcugaagaagcuggcccucuacgggaagaucaacgacaacaacuccuggaucaucgacaacggcaucuaccacaucgcgccccuggggaagcugcacagcaacaacaagaucggcaucgagacccucaccgaggugaugaagguguaccccuaccuguccaugcagcaccuccagagcgccgaccagaucaagcggcacuacgacuccaaggacgccgagggcaacaagaucccgcucgacaaguucaagaaggaggggaaggagaaguacugccccaagaccuacacguucgacgacggcaaggucaucaucaaggccggggcccgcguggaggaggagaaggugaagcggcuguacugggccagcaaggaggucaacucccaguucuuccgcguguacggcaucgacaagccccuggaggagggcaaccccgacgacauccucaccauggugaucuacaacagcccggaggaguacaagcugaacagcguccuguacggguacgacaccaacaacggcgggauguacaucgagcccgagggcaccuucuucacguacgagcgggaggcccaggaguccaccuacacccucgaggagcuguuccgccacgaguacacccacuaccugcaggggcgguacgcggugcccggccaguggggccgcacgaagcucuacgacaacgaccggcugaccugguacgaggagggcggggccgagcuguucgccgggagcacccgcaccuccggcauccucccccgcaagagcaucguguccaacauccacaacacgacccggaacaaccgguacaagcugagcgacaccguccacuccaaguacggggccagcuucgaguucuacaacuacgccugcauguucauggacuacauguacaacaaggacaugggcauccugaacaagcucaacgaccuggcgaagaacaacgacguggacggcuacgacaacuacauccgcgaccuguccagcaacuacgcccucaacgacaaguaccaggaccacaugcaggagcgcaucgacaacuacgagaaccugaccgucccguucguggccgacgacuaccuggugcggcacgccuacaagaaccccaacgagaucuacuccgagaucagcgaggucgccaagcugaaggacgcgaaguccgaggugaagaagucccaguacuucagcacguucacccuccgcgggagcuacaccggcggggccuccaagggcaagcuggaggaccagaaggccaugaacaaguucaucgacgacagccugaagaagcucgacaccuacuccuggagcggguacaagacgcugaccgccuacuucaccaacuacaagguggacagcuccaaccgggucaccuacgacgugguguuccacggcuaccugcccaacgagggcgacagcaagaacucccuccccuacgggaagaucaacggcaccuacaaggggacggagaaggagaagaucaaguucagcuccgagggcagcuucgacccggacggcaagaucgucuccuacgagugggacuucggggacggcaacaagagcaacgaggagaaccccgagcacuccuacgacaagguggggaccuacaccgugaagcugaaggucaccgacgacaagggcgagagcuccgugagcacgaccaccgcggagaucaaggaccuguccgagaacaagcuccccgugaucuacaugcacguccccaagagcggggcccugaaccagaaggugguguucuacggcaagggcaccuacgacccggacggguccaucgccggcuaccagugggacuucggggacggcagcgacuucuccagcgagcagaaccccagccacgucuacacgaagaagggggaguacaccgugacccugcgcgugauggacuccagcggccagauguccgagaagaccaugaagaucaagaucacggaccccgucuacccgaucggcaccgagaaggagcccaacaacagcaaggagaccgccuccgggcccaucgugcccggcaucccggugagcgggaccaucgagaacacguccgaccaggacuacuucuacuucgacgucaucacccccggcgaggugaagaucgacaucaacaagcucggguacggcggcgccaccuggguggucuacgacgagaacaacaacgcggugagcuacgccaccgacgacgggcagaaccuguccggcaaguucaaggccgacaagcccgggcgguacuacauccaccuguacauguucaacggcagcuacaugcccuaccgcaucaacaucgagggguccgugggccggugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2319 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt11)
gggagaaagcuuaccaugaagugggugaccuucaucagccucuuauuccuguuuuccagugccuacuccaugaagcgcaagugccugagcaagcggcucaugcuggccaucaccauggcgacgaucuucaccgucaacuccacccugcccaucuacgccgccguggacaagaacaacgccaccgccgcgcgccggcgccggaagcgcgugcagaacgagagcaagcgguacacggucuccuaccucaagacccugaacuacuacgaccugguggaccuccuggugaagaccgagaucgagaaccugccggaccucuuccaguacagcucagacgccaaggaguucuacggcaacaagacccgcaugagcuucaucauggacgagaucgggcggcgcgcgccccaguacacggagaucgaccacaagggcauucccacccuggucgagguggugcgggccggguucuaccugggcuuccacaacaaggagcucaaugagaucaacaagcgcuccuucaaggagcgagucaucccaagcauccuggccauccagaagaacccgaacuucaagcuggggaccgaggugcaggacaagaucguguccgccaccggccuccucgccggcaacgagacggccccgcccgaggucgugaauaacuucacccccauccugcaggacugcaucaagaacaucgaccgcuacgcccucgacgaccucaagagcaaggcgcuguucaacguccuggcagccccgacauacgacaucaccgaguaccuccgggccacuaaggagaagcccgagaacacccccugguacgggaagaucgacggcuucaucaacgagcugaagaaacucgcccuguacgggaagaucaacgacaacaacuccuggaucaucgacaacggcaucuaccacaucgcgccccuggggaagcuccacagcaacaacaagaucggcaucgagaccuugaccgaggucaugaagguguacccguaccuguccaugcagcaccuccaaagcgccgaccagaucaagcgccacuacgacuccaaggacgccgagggcaacaagaucccccuugacaaguucaagaaggaggggaaggagaaauacugccccaagacguacaccuucgacgacggcaaggugaucaucaaggccggggcccgggucgaggaggagaaggugaagcgguuauacugggcgucaaaagaggugaacagccaguucuuccgggucuacggcaucgacaagccccucgaggagggcaacccggacgacauccugaccauggugaucuacaacucccccgaggaguacaagcugaacagcgugcucuacggguacgacacaaacaacggcggaauguacaucgagcccgagggcacguucuucacguacgagcgcgaggcccaggaguccaccuacacccuggaggagcuguuccggcacgaguacacgcacuaccuccaggggagauacgccguccccggccaguggggccgcaccaagcuguacgacaacgaccggcugaccugguacgaggagggaggggccgagcuguucgccgggagcacccgcacguccggcauccugccgcgcaagagcaucguuuccaacauccauaacaccacccggaacaacagauacaagcugagcgacaccguccacuccaaguacggggcgagcuucgaguuuuacaacuacgccuguauguucauggacuacauguacaacaaggauaugggcauacucaacaagcugaacgaccuggccaagaauaacgacguggacggcuacgacaacuacauccgcgaccugucaagcaacuacgcccucaacgacaaguaccaggaccacaugcaggagcggaucgacaacuacgagaaccugacggugcccuucgucgcggacgacuaccuggugcgucacgccuacaagaaccccaacgagaucuacucugagaucagugagguggccaagcucaaggacgccaagucagaggucaagaagucccaguacuucagcaccuucacccugcgggggagcuauaccggcggggccuccaagggcaagcuggaggaccagaaggccaugaacaaguucaucgacgacagccucaagaagcuggacaccuacagcugguccggguacaagacgcugaccgcguacuucaccaacuacaagguggauagcuccaaccgcguaaccuacgacgucguguuccacggcuaccuccccaacgagggcgacagcaagaacucccugccguacgggaagaucaacggcacguacaaggggaccgagaaggagaaaaucaaguucagcuccgagggcuccuucgaccccgacggcaagaucguguccuacgagugggacuucggggacggcaacaagagcaacgaggagaaccccgaacacuccuacgacaaggucgggaccuacaccgugaagcugaaggugacggacgacaagggcgagagcuccgucucuaccaccaccgccgagaucaaggaccucuccgagaacaagcugcccgugaucuacaugcacgugcccaagucaggggcccugaaccaaaaggucguguuuuacggcaagggcacguacgaccccgacggguccauagccggcuaccagugggacuucggggacggcagcgacuucagcuccgagcagaaccccagccacguguacaccaagaagggggaguacaccgucacccucagggugauggacuccagcggccagauguccgagaagacgaugaagaucaagaucaccgauccgguguaccccaucggcaccgagaaggagccgaacaacagcaaggagaccgcguccgggcccaucgucccgggcauccccgugagcgggacgaucgagaacaccuccgaccaggacuacuucuacuucgacgugaucacccccggcgaggucaagaucgauaucaacaagcugggguacggcggcgccaccugggugguguacgacgagaacaacaacgccgucagcuacgcuacggacgacgggcagaaccuguccggcaaguucaaggccgacaagcccgggcgguacuacauccaccucuacauguucaacggcagcuacaugccguaccggaucaacaucgagggguccguaggccgaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2320 - RNA, 793 nt, Artificial Sequence
  mRNA product Design1 comprising derived and/or modified sequence from Homo sapiens__NP_001133.1__HsAMELX (opt11)
gggagaaagcuuaccaugggcaccuggauacuauucgccugccuccucggcgccgccuucgccaugccccuacccccccaccccggccaccccggcuacaucaacuucucauacgaaguccucaccccccucaaaugguaccaaucaauccgcccccccuaccccuccuacggcuacgaacccaugggaggcuggcuccaccaccaaaucauccccguccucucccaacaacacccccccacccacacccuccaaccccaccaccacauccccgucguccccgcccaacaacccgucaucccccaacaacccaugaugcccguccccggccaacacucaaugacccccauccaacaccaccaacccaaccuccccccccccgcccaacaacccuaccaaccccaacccguccaaccccaaccacaccaaccaaugcaaccccaaccccccguccaccccaugcaaccccuccccccccaacccccccuaccccccauguuccccaugcaaccccucccccccaugcuccccgaccucacccucgaagccuggcccuccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2321 - RNA, 352 nt, Artificial Sequence
  mRNA product Design1 comprising derived and/or modified sequence from Homo sapiens__NP_001133.1__HsAMELX-TRAP (opt11)
gggagaaagcuuaccaugccccuccccccccaccccggccaccccggcuacaucaacuucuccuacgaaguccucaccccccucaaaugguaccaauccauccgcccccccuaccccuccuacggcuacgaacccaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2322 - RNA, 385 nt, Artificial Sequence
  mRNA product Design1 comprising derived and/or modified sequence from Homo sapiens__NP_001133.1__HsAMELX-LRAP (opt11)
gggagaaagcuuaccaugccccuccccccccaccccggccaccccggcuacaucaacuucuccuacgaaguccucaccccccucaaaugguaccaauccauccgccccccccccaugcuccccgaccucacccucgaagccuggcccuccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2323 - RNA, 424 nt, Artificial Sequence
  mRNA product Design1 comprising derived and/or modified sequence from Homo sapiens__NP_001133.1__HLA-A2-SP_HsAMELX(17-60) (opt11)
gggagaaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccauccgcccccccuaccccuccuacggcuacgaacccaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2324 - RNA, 457 nt, Artificial Sequence
  mRNA product Design1 comprising derived and/or modified sequence from Homo sapiens__NP_001133.1__HLA-A2-SP_HsAMELX(17-47,168-191) (opt11)
gggagaaagcuuaccauggccgucauggccccccgcacccucguccuacuccucuccggcgcccucgcccucacccaaaccugggccaugccccuccccccccaccccggccaccccggcuacaucaacuucuccuacgaaguccucaccccccucaaaugguaccaauccauccgccccccccccaugcuccccgaccucacccucgaagccuggcccuccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2325 - RNA, 796 nt, Artificial Sequence
  mRNA product Design1 comprising derived and/or modified sequence from Homo sapiens__NP_001134.1__HsAMELY (opt11)
gggagaaagcuuaccaugggcaccuggauccucuucgccugccucgucggcgccgccuucgcaaugccccuccccccccaccccggccaccccggcuacaucaacuucuccuacgaaguccucaccccacucaaaugguaccaauccaugauccgcccacccuacucauccuacggcuacgaaccaaugggcggcuggcuccaccaccaaaucauccccgucguaucccaacaacacccccucacccacacccuccaaucccaccaccacauccccgucguccccgcacaacaaccccgcguccgccaacaagcccucaugcccguccccggccaacaauccaugacccccacccaacaccaccaacccaaccucccccuccccgcccaacaacccuuccaaccccaacccguccaaccccaaccccaccaacccaugcaaccccaacccccaguccaacccaugcaaccccuccucccccaacccccccucccccccauguucccacuccgaccccucccccccauccuacccgaccuccaccuugaagccuggcccgccaccgacaaaaccaaacaagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2326 - RNA, 355 nt, Artificial Sequence
  mRNA product Design1 comprising derived and/or modified sequence from Homo sapiens__NP_001134.1__HsAMELY-TRAP (opt11)
gggagaaagcuuaccaugccccuccccccccaccccggccaccccggcuacaucaacuucuccuacgaaguccucaccccccucaaaugguaccaauccaugauccgcccccccuacuccuccuacggcuacgaacccaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2327 - RNA, 388 nt, Artificial Sequence
  mRNA product Design1 comprising derived and/or modified sequence from Homo sapiens__NP_001134.1__HsAMELY-LRAP (opt11)
gggagaaagcuuaccaugccccuccccccccaccccggccaccccggcuacaucaacuucuccuacgaaguccucaccccccucaaaugguaccaauccaugauccgccccccccccauccuccccgaccuccaccucgaagccuggcccgccaccgacaaaaccaaacaagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2328 - RNA, 427 nt, Artificial Sequence
  mRNA product Design1 comprising derived and/or modified sequence from Homo sapiens__NP_001134.1__HLA-A2-SP_HsAMELY(17-61) (opt11)
gggagaaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccaugauccgcccccccuacuccuccuacggcuacgaacccaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2329 - RNA, 460 nt, Artificial Sequence
  mRNA product Design1 comprising derived and/or modified sequence from Homo sapiens__NP_001134.1__HLA-A2-SP_HsAMELY(17-48,169-192) (opt11)
gggagaaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccaugauccgccccccccccauccuccccgaccuccaccucgaagccuggcccgccaccgacaaaaccaaacaagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2330 - RNA, 787 nt, Artificial Sequence
  mRNA product Design1 comprising derived and/or modified sequence from Sus scrofa__NP_999071.1__SsAMELX-001-1 (opt11)
gggagaaagcuuaccaugggcaccuggauccucuucgccugucuccucggcgccgccuucuccaugccccuccccccccaccccggccaccccggcuacaucaacuucuccuacgaaguccucaccccccucaaaugguaccaaaacaugauccgacaccccuacaccuccuacggcuacgaacccaugggcggcuggcuccaccaccaaaucauccccgucgucucccaacaaaccccccaaucccacgcccuucaaccccaccaccacauccccaugguccccgcccaacaacccggcauaccccaacaacccaugaugccccucccuggccaacacuccaugacccccacccaacaccaccaacccaaccucccccuccccgcccaacaacccuuccaaccccaacccguccaaccccaaccccaccaaccccuccaaccccaaucccccaugcaccccauccaaccccuccucccccaaccaccccuaccccccauguucuccaugcaaucccuccuccccgaccucccccucgaagccuggcccgccaccgacaaaacaaaacgugaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2331 - RNA, 355 nt, Artificial Sequence
  mRNA product Design1 comprising derived and/or modified sequence from Sus scrofa__NP_999071.1__SsAMELX-TRAP (opt11)
gggagaaagcuuaccaugccccuccccccccaccccggccaccccggcuacaucaacuucuccuacgaaguccucaccccccucaaaugguaccaaaacaugauccgccaccccuacaccuccuacggcuacgaacccaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2332 - RNA, 388 nt, Artificial Sequence
  mRNA product Design1 comprising derived and/or modified sequence from Sus scrofa__NP_999071.1__SsAMELX-LRAP (opt11)
gggagaaagcuuaccaugccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2333 - RNA, 427 nt, Artificial Sequence
  mRNA product Design1 comprising derived and/or modified sequence from Sus scrofa__NP_999071.1__HLA-A2-SP_SsAMEL(17-61) (opt11)
gggagaaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaaaacaugauccgccaccccuacaccuccuacggcuacgaacccaugggcggcugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2334 - RNA, 460 nt, Artificial Sequence
  mRNA product Design1 comprising derived and/or modified sequence from Sus scrofa__NP_999071.1__HLA-A2-SP_SsAMEL(17-49,167-189) (opt11)
gggagaaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2335 - RNA, 751 nt, Artificial Sequence
  mRNA product Design1 comprising derived and/or modified sequence from Sus scrofa__P45561-2__SsAMELX-001-2 (opt11)
gggagaaagcuuaccaugggcaccuggauccucuucgccugccuccucggcgccgccuucuccaugccccuccccccccaccccggccaccccggauacaucaacuucuccuacauccgacaccccuacaccuccuacggcuacgaacccaugggcggcuggcuccaccaccaaaucauccccgucgucucccaacaaaccccccaaucccacgcccuccaaccacaccaccacauccccaugguccccgcccaacaacccggcaucccccaacaacccaugaugccccuccccggccaacacuccaugacccccacccaacaccaccaacccaaccucccccuucccgcccaacaacccuuccaaccccaacccguccaaccccaaccccaccaaccccuacaaccccaaucccccaugcaccccauccaaccccuccucccccaacccccccuaccccccauguucuccaugcaaucccuccuccccgaccucccccucgaagccuggcccgccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2336 - RNA, 787 nt, Artificial Sequence
  mRNA product Design1 comprising derived and/or modified sequence from Sus scrofa__NP_998965.1__SsAMELX-001-3 (opt11)
gggagaaagcuuaccaugggcaccuggaucuucuucgccugccuccucggcgccucccucgccaugccccucccaccccaccccggccaccccggcuacaucaacuucuccuacgaaguccucacaccccucaaaugguaccaaaacaugauccgccaccccuacaccuccuacggcuacgaacccaugggcggcuggcuccaccaccaaaucauccccgucgucucucaacaaacaccccaaucccacgcccuccaaccccaccaccacauccccaugguccccgcccaacaacccggcauaccccaacaacccaugaugccccuccccggccaacacuccaugacccccacccaacaccaccaacccaaccucccccuccccgcccaacaacccuuccaaccccaacccguccaaccccaaccccaccaaccccuccaaccccaaucccccaugcaccccauccaaccccuacucccccaaccaccccuaccacccauguucuccaugcaaucccuccuccccgaccucccccucgaagccuggcccgccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2337 - RNA, 436 nt, Artificial Sequence
  mRNA product Design1 comprising derived and/or modified sequence from Sus scrofa__K7GPB2__SsAMELX-002 (opt11)
gggagaaagcuuaccaugggcaccuggauccucuucgccugccuccucggcgccgccuucuccaugccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2338 - RNA, 829 nt, Artificial Sequence
  mRNA product Design1 comprising derived and/or modified sequence from Sus scrofa__K7GLD0__SsAMELX-003 (opt11)
gggagaaagcuuaccaugggcaccuggauccucuucgccugccuccucggagccgccuucuccaugccccuacccccccaccccggccaccccggcuacaucaacuucuccuacgaagaccuuuaccucgaagccauccgcaucgaccgcaccgccuucguccucaccccccuaaaaugguaccaaaacaugauccgccaccccuacaccuccuacggcuacgaacccaugggcggcuggcuccaccaccaaaucauccccgucgucucccaacaaaccccccaaucccacgcccuccaaccccaccaccacauccccaugguccccgcccaacaacccggcaucccccaacaacccaugaugccccuccccggccaacacuccaugacccccacccaacaccaccaacccaaccucccccuccccgcccaacaacccuuccaaccccaacccguacaaccccagccccaccaaccccuucaaccccaaucccccaugcaccccauccaaccccuccucccccaacccccccuaccccccauguucuccaugcaaucccuccuccccgaccucccccucgaagccuggcccgccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2339 - RNA, 715 nt, Artificial Sequence
  mRNA product Design1 comprising derived and/or modified sequence from Sus scrofa__K7GPE9__SsAMELX-004 (opt11)
gggagaaagcuuaccaugggaaccuggauccucuucgccugccuccucggcgcagccuucuccaugccccuccccccccaccccggccaccccggcuacaucaacuucuccuacgaaguccucaccccccuaaaaugguaccaaaacaugauccgccaccccacaccccaaucacacgcccuccaaccccaccaccacauccccaugguccccgcacaacaacccggcaucccccaacaacccaugaugccccuccccggccaacacuccaugacacccacccaacaccaccaacccaaccuaccccuccccgcccaacaacccuuccaaccccaacccguccaaccccaaccccaccaaccccuccaaccccaaucccccaugcaccccauccaaccccuccucccccaacccccccucccacccauguucuccaugcaaucccuccuccccgaccucccacucgaagccuggcccgccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2340 - RNA, 739 nt, Artificial Sequence
  mRNA product Design1 comprising derived and/or modified sequence from Sus scrofa__J9JIM4__SsAMELX-201 (opt11)
gggagaaagcuuaccaugccccuacccccacaccccggccaccccggcuacaucaacuucuccuacgaaguccucaccccacucaaaugguaccaaaacaugauccgccaccccuacaccuccuacggcuacgaacccaugggcggcuggcuccaccaccaaaucauccccgucgucucccaacaaaccccacaaucccacgcccuccaaccccaccaccacauccccaugguccccgcccaacaacccggcaucccccaacaacccaugaugccccuccccggccaacacuccaugacccccacccaacaccaccaacccaaccuaccccuccccgcccaacaacccuuccaaccccaaccaguccaaccccaaccccaccaaccccuccaaccccaaucccccaugcacccaauccaaccccuacucccccaaccuccccuaccacccauguucuccaugcaaucccuccuccccgaccucccccucgaagccuggcccgccaccgacaaaaccaaacgcgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2341 - RNA, 3178 nt, Artificial Sequence
  mRNA product Design1 comprising derived and/or modified sequence from Homo sapiens__NP_006120.1__HsBMP1 (opt11)
gggagaaagcuuaccaugccaggaguugcccgccuaccacuacuacuaggucuccucuuacucccgcgacccggccgcccacucgaccuagcagacuacacauacgaccucgcagaagaagacgacucagaaccacuaaacuacaaagaucccugcaaagccgcggcauuccucggagacauagcccuggacgaagaagaucuacgagcauuccagguccaacaagcaguagaccuccggcgacacacagcucgcaaaucguccaucaaagcggccgucccaggcaacacaaguaccccuuccugccaguccaccaacggucaaccccaacggggagccugcggacgcuggcguggcaggucacgaucccggcgagcagccaccagcagaccggaacgaguauggcccgacggggucaucccauucguaaucggugggaacuucacgggaucgcaacgagcaguauuccgacaggccaugcgccacugggaaaaacacacaugcgucaccuuccucgaacgcacagacgaagacagcuacauagucuucacauacagaccaugcggaugcugcaguuacgucggacggagaggcggcggcccgcaagcaauaucgauagggaaaaacugcgacaaauucggcauagucguccacgaacuagggcaugucguaggguucuggcacgagcacaccaggcccgaccgagaccgccacguaagcauaguccgcgaaaacauccaacccggacaggaauacaacuuccucaagauggaaccccaagaagucgagucgcugggggaaacauacgacuucgacuccauaaugcacuacgcccgaaacaccuucagccgagguaucuuccucgacacaaucguccccaaguacgaagucaacggcgucaaacccccaauaggccaacggacccgacucucaaaaggugacaucgcucaggcccgcaaacuguauaagugccccgccuguggggagacccuacaggacagcacgggcaacuucagcuccccugaauaccccaacggcuacagcgcacacaugcacugcgucuggcgcaucagugucaccccaggagagaaaaucauccucaacuucaccucacucgaucucuaccgaagcagacucuguugguacgacuacguggagguccgagacggguucuggcgcaaagcaccgcuccgcggccgcuucugcggcucuaaacuucccgaacccauugucagcaccgacucgagacucugggucgaguucaggaguuccagcaacuggguaggcaaaggauucuuugcagucuacgaagccauaugcggcggcgacgucaagaaagacuacggccacauccaguccccaaacuacccagacgacuaccgccccuccaaagucugcauauggaggauacaaguaucagaaggguuucacgucggacugacauuccaaaguuucgaaauagaacgucacgacucaugcgcguacgacuaccuggaaguacgcgacggccauuccgaaagcagcacacuaauaggccgguacuguggcuacgaaaagcccgacgacauaaaaucaacaucaagcagacuguggcuaaaguucgucucggacggaagcauaaacaaagcaggauucgcagugaacuucuuuaaggaagucgacgaauguucgcgcccaaacaggggaggcugcgaacaaagaugccuuaacacacuggggucauauaagugcagcugcgaccccggauacgagcuugcaccagacaagcgaagaugugaggccgccugcggaggcuuccucacaaaacugaacggauccaucacaucacccggauggccaaaagaguaucccccgaauaaaaacugcauauggcagcuaguagcgccaacccaauaccggaucagccuccaguucgacuucuucgaaaccgaaggcaacgacgugugcaaauacgacuucgucgagguacgcagcggucuuaccgcggacucaaaacugcacggcaaauucugcggcagcgaaaaaccagaaguaaucaccagccaauacaacaacaugagagucgaauuuaaaucagacaacaccguauccaagaaaggcuucaaagcccacuucuuuuccgauaaagacgaaugcaguaaagauaacgggggcugucagcaagacugcguuaacacauucggaagcuacgaaugucaaugccgcaguggguucgugcugcacgacaacaaacacgacugcaaagaagcaggaugcgaccauaaagucaccagcacaagcggaacgaucacuagccccaacuggccggacaaauacccauccaagaaagaaugcacaugggccaucuccagcacccccggccaccgcgucaaauuaacauucauggagauggacaucgaaucacaacccgaaugcgccuacgaccaccuggagguauucgacggccgagacgccaaagcaccagugcucggccgcuucugcggcuccaagaaaccagaaccagugcuagccaccggcagucgaauguuccuccgcuucuacagugacaacaguguacaacgaaaaggauuccaagcaagccacgcaacagaaugcgguggccaaguccgggccgacgucaaaacaaaagaccuauacucacaugcucaauucggugacaacaacuacccgggcgguguagacugcgaaugggucaucgucgcagaagagggauacggggucgaacucguguuccaaacauucgaagucgaggaagagacagauuguggcuacgacuacauggaacucuucgacggguacgacagcaccgcccccagacuaggccgcuacuguggaucagguccacccgaagaagucuacagcgccggugacucaguacucgugaaauuccacagcgacgacacaauuacaaagaaaggcuuccaccuaagauacacguccaccaaauuccaggacacccuccacagccgcaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2342 - RNA, 1408 nt, Artificial Sequence
  mRNA product Design1 comprising derived and/or modified sequence from Homo sapiens__NP_001191.1__HsBMP2 (opt11)
gggagaaagcuuaccauggucgccggcacccguugccuccuugcccuccuccuaccccaaguccuacuaggcggagcagccggccucguccccgaacucggccgccgcaaauucgccgccgccucauccggacgccccuccucacaacccagcgacgaaguacucucagaauucgaacuucgucuacucuccauguucggccucaaacaacgacccacucccucccgcgacgcagucguccccccuuacaugcuagaccuuuaccgccgccacuccggccaacccggaucacccgcccccgaccaucgccucgaaagagccgccucccgagccaauaccguccgcucauuccaccacgaagaaucacucgaagaacuacccgaaaccagcggaaaaacaacacgcagauucuucuucaaccucuccagcauccccaccgaagaauucaucaccuccgccgaacuacaaguauucagagaacaaaugcaggacgcccucggcaacaacuccagcuuccaccaccgcaucaacauauacgaaauaaucaaacccgccacagcuaacuccaaguuccccgucacacgccuacucgacacccgccuagucaaccaaaaugccucccgcugggaauccuucgacgucacccccgccgucaugcgauggaccgcacaaggccacgccaaucacggcuucgucguagaaguugcacaccuagaagaaaaacaaggcgucuccaaacgccacguccgcaucuccagaucccuacaccaagacgaacacucauggucccaaauccgcccccuccuagucaccuucggacaugacggcaaaggacacccgcuccacaaacgcgaaaaacgccaagccaaacacaaacaacgcaaacgccucaaaucauccugcaaacgccacccacucuacguagacuucuccgacguaggauggaacgacuggauagucgcacccccaggcuaccacgcauucuacugccacggagaaugcccauucccacuugccgaccaccucaacuccaccaaccacgcuaucguacaaacacucgucaacuccgucaacucaaaaaucccaaaagcaugcugcguccccacagaacucucagccaucuccaugcucuaccucgacgaaaacgaaaaggucguccuaaaaaacuaccaagacauggucgucgaaggcugcggcugccgcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2343 - RNA, 1444 nt, Artificial Sequence
  mRNA product Design1 comprising derived and/or modified sequence from Homo sapiens__NP_001193.2__HsBMP4 (opt11)
gggagaaagcuuaccaugauaccgggcaaccgcaugcucauggucguucuccugugccaaguccuacucggcggcgcaagccacgccucacucauccccgaaacugggaaaaaaaaagucgccgaaauccaaggccacgccggcggaagacgcuccggccaaucacacgaacuccuccgcgacuucgaagccacccuacuacaaauguucggccuccgccgccgcccacaacccucaaagagcgccgucauccccgacuacaugcgcgaccuauaccgacuccaauccggcgaagaagaagaagaacaaauccacuccaccggacucgaauaccccgaacgccccgccucccgagcaaacaccguacguucuuuccaccacgaagaacaccucgaaaauauccccggcaccuccgaaaacuccgcauuccgcuuccuauucaaccucuccuccauccccgaaaacgaaguaaucucauccgcagaacuccgccuauuccgcgaacaagucgaccaaggccccgacugggaaagaggcuuccaccgaauaaacauuuacgaagucaugaaacccccagccgaagucguacccggccaccucaucacacgacuucucgacacacgccuaguccaccauaacguaacucgcugggaaaccuucgacguaagccccgccguccuccgauggacccgugaaaaacagcccaacuacggccucgcaauugaagucacccaccuccaccaaacacgcacacaccaaggccaacauguccgcauaucccgaucacucccacaaggcuccggcaacugggcccaacuccguccacuccucguuaccuucggccaugacggacgcggucacgcccucaccagacgccgcagggccaaacgaucccccaaacaucacucccagcgcgcucguaaaaaaaacaaaaacugccgccgccauucccuauacguagacuucuccgacgucggcuggaacgacuggauagucgcaccccccggauaccaagccuucuacugccacggcgacugccccuucccacucgcagaccaccuaaacucaaccaaucacgccaucguacaaacccucguaaacucagucaacuccuccauucccaaagccugcugcguacccaccgaacuauccgccaucuccaugcucuaccuagacgaauacgacaaagucguccucaaaaacuaccaagaaauggucgucgaaggcugcggcugccgauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2344 - RNA, 1759 nt, Artificial Sequence
  mRNA product Design1 comprising derived and/or modified sequence from Homo sapiens__NP_001709.1__HsBMP6 (opt11)
gggagaaagcuuaccaugcccgggcuaggccgacgagcacaauggcuaugcuggugguggggccuacuaugcucaugcugcggaccaccuccccuacgcccaccccugcccgcagccgcugccgcagcugccggcggccaacuacuaggcgacggcggcucacccggccgaacagaacaacccccucccucuccccaauccucauccggauuccuauaccgcagacucaaaacccaagaaaaacgcgaaaugcaaaaagaaauccuaucaguacucggccugccacauagacccagaccccuccacggacuccaacaaccccaaccucccgcccugcgucaacaagaagaacaacaacaacaacagcaacuaccccgcggcgaacccccacccggccgccuaaaaucagcaccccuauuuaugcucgaccuuuacaacgcccucucugccgacaaugaugaagacggcgccuccgaaggugaacgccaacaauccuggccccacgaagccgccucaucaucacaacgacgacaacccccacccggcgccgcccacccacucaaccgaaaaucccuucucgcccccggaucugguuccgggggcgcuuccccacucaccuccgcacaagacagcgccuuccuaaacgacgccgacaugguuaugucauucguaaaccuagucgaauacgacaaagaauuuucacccagacaaagacaccauaaagaguucaaauucaaccucucccaaaucccagaaggcgaagucguaacagccgccgaguuccgaaucuacaaagacugcgucaugggauccuucaaaaaccaaaccuuccuaauaagcaucuaccaaguacuacaagaacaccaacaccgugacuccgaccucuuucuucuagacacccgaguagucugggccucagaagaagguuggcuugaguucgacaucaccgccaccagcaaccuauggguagucacaccccaacacaacaugggacugcaacuaucagucguaacccgcgacggcguacacguucacccccgagcagccggacucguaggucgcgacggacccuacgacaaacaacccuucauggucgccuucuuuaaagucuccgaaguacacguccgaacaacacgauccgcaucaucccgccgccgccagcaaucccggaaccgaucaacacaaucccaagacgucgcccgcgucagcucggcuucggacuacaacuccagcgaacuaaaaacagcaugccgcaaacacgaacuauacgucuccuuucaagaccucggauggcaagacuggaucaucgcacccaaaggauacgcagcaaacuacugcgacggagaaugcuccuucccccuaaaugcacacaugaacgcaaccaaccacgccaucguccaaacccucguccaccuaaugaaccccgaauauguacccaaacccugcugcgccccaaccaaacuaaacgcaaucucaguacucuacuucgacgacaacuccaacguaauccucaagaaauaccgcaacaugguuguccgugccugcggaugccacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2345 - RNA, 1513 nt, Artificial Sequence
  mRNA product Design1 comprising derived and/or modified sequence from Homo sapiens__NP_001710.1__HsBMP7 (opt11)
gggagaaagcuuaccaugcacguccgaucacuacgcgccgcagccccacacuccuucguagcacucugggcaccccuauucuuacuccgcuccgcacuagccgacuucucccucgacaacgaaguccacucgagcuucauccaccgccgccuacggucccaagaaagacgcgaaaugcaacgcgaaauccucucaauucuaggacucccccaccgcccccgcccccaccuccaaggcaaacacaacucugcccccauguucaugcucgaccucuacaacgccauggcaguagaagaaggaggcggacccggcggccaaggcuucucauaccccuacaaagccguuuucucaacccaaggcccgccccucgcaucccuccaagacucacacuuccuaaccgacgccgacaugguaaugucauucgucaaccucguagaacaugacaaagaauucuuccacccccgcuaucaccaccgcgaauuccgauucgaccucucgaaaauacccgaaggcgaagccgugaccgcagccgaauuccgcauauacaaagacuacauccgcgaacgcuucgacaacgaaacauuccgcaucuccgucuaccaagugcuccaagaacaccucggccgcgaaagcgaccucuuccuacuugacucccgcacacuuugggccucugaagaagguuggcucguauucgacauaacagccaccucaaaccacuggguagucaacccccgucacaaccuaggacuccagcuaucaguagaaacacucgacggccagagcaucaaccccaaacuugcgggacucaucggccgccacggaccacaaaacaagcagcccuucauggucgccuucuuuaaagccaccgaaguacauuucagauccauacgcuccaccggguccaaacaacgaucacaaaaccgauccaaaaccccaaaaaaccaagaagcucuacgaauggcaaacguagcugaaaacagcuccucagaccaacgccaagccugcaaaaaacacgaacucuacgucuccuuccgagaccucggcuggcaagacuggaucaucgccccagaaggcuacgcagcauacuacugcgaaggcgaaugcgccuucccccuuaacucuuacaugaacgccaccaaccacgcaaucguccagacccucguacacuucaucaaccccgaaacuguccccaaacccugcugcgcccccacccaauuaaacgcaaucuccguccucuacuucgacgacuccucgaacgucauacucaaaaaauaccgaaacauggucguccgcgccugcggcugccauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2346 - RNA, 517 nt, Artificial Sequence
  mRNA product Design1 comprising derived and/or modified sequence from Homo sapiens__NP_006264.2__HsCCL7 (opt11)
gggagaaagcuuaccaugaaagccuccgccgcccuccucugccuccuccucaccgccgccgccuucuccccccaaggccuagcccaacccgucggcaucaacaccuccaccaccugcugcuaccgauucaucaacaaaaaaauccccaaacaacgccucgaauccuaccgccgcaccaccuccucacacugcccccgcgaagccgucaucuucaaaaccaaacucgacaaagaaaucugcgccgaccccacccaaaaauggguccaagacuucaugaaacaccucgacaaaaaaacccaaacccccaaacucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2347 - RNA, 3841 nt, Artificial Sequence
  mRNA product Design1 comprising derived and/or modified sequence from Homo sapiens__NP_001954.2__HsEGF (opt11)
gggagaaagcuuaccaugcugcucacgcugaucaucuuauuaccggucgucaguaaauuuagcuuuguaucacugagcgcaccccaacacuggucaugcccagagggcacuuuggcagggaacggcaauucgacgugcguaggaccagccccauuccugaucuucagccacggaaauagcaucuuccgaaucgacacagaaggaacgaacuaugagcaacucguagucgacgcagggguaucgguuaucauggacuuccauuacaacgagaaaagaauauacugggucgaccuagaacgacagcuccugcaaaggguauuccugaacggcucgcggcaggaacggguaugcaacauagagaaaaacgucagcggcauggccauaaacuggaucaacgaagaagugaucugguccaaccaacaggaaggcaucauaaccgucacugacaugaaaggaaacaacagccacauccuccuaucagcgcuaaaguaccccgccaaugucgcggucgacccaguagaacgguucauuuucugguccuccgaaguagcugggagccuuuaccgcgcagaccuagacggcgucggaguaaaagcacuacuugaaacauccgagaaaauaacagcaguaucccuugacguccuagacaagcgccucuucuggauacaauacaaucgcgaagggucuaacagccucaucugcaguugugacuaugacggcgggagcguacacaucucaaaacacccaacacaacauaaucuauucgcgaugagccucuucggugacagaauauucuacucaaccuggaagaugaaaacaauauggauagccaacaaacacacaggcaaagacaugguccgcaucaaccuccacagcuccuucguaccccucggcgaacuaaaaguagugcacccccuagcccagcccaaagccgaagaugauacgugggaacccgaacaaaagcugugcaaacugcgcaaagggaacugcagcaguaccguuugcggucaagacuuacagucucaccucugcaugugcgcugagggguacgcccuuucgagagacagaaaauacugcgaggacgucaacgaaugcgccuuuuggaaccacggcugcacacuuggcugcaaaaauacaccgggaagcuacuacugcacaugucccguaggauucguccuucuacccgauggaaagcgcugccaccaacuggucucguguccucgcaacgucucggaaugcagccaugacugcguacuaaccuccgaagguccacuaugcuucugcccagaggguucaguucuagagcgggacggcaagacaugcaguggaugcucauccccagacaacggcggaugcucccaacuaugcgucccacugagcccggucucaugggaaugcgacugcuucccuggguacgaccuccagcuugaugaaaaaucaugcgcugccuccgggccccagcccuuccuacucuucgccaacucgcaagacauaagacauaugcacuucgacggcacagauuacgggacccugcugucccaacagaugggcaugguauacgcacucgaccacgacccaguggaaaauaaaaucuauuucgcccacacagcccuuaaguggaucgaacgcgccaacauggacggcagccaaagagaacggcucauagaagaggggguggacgugccagagggccucgcugucgacuggauagggcgccgguucuacuggacagaccggggcaaaagccucauaggcagaucagaccucaacgggaaaaggagcaagaucauaacgaaagagaauaucucgcaaccccgcggaaucgccguccacccaauggcaaaaagacuauucuggacagauacgggaauaaacccccggaucgagagcuccucccuacaagggcucgggcgguuaguaaucgccuccagcgaccuaauauggcccagcgggauuaccaucgacuuccuaacagacaaacucuacuggugcgacgcaaaacaauccgucaucgaaauggccaaucuagacgguagcaaacgacgccgacucacacaaaacgacguaggccaucccuuugcggucgccgucuucgaggacuacgucugguucucugauugggccaugcccucagucaugcgagucaacaagcgcacgggaaaggaucgagugaggcuccagggcucgauguugaaaccaagcagccuaguagucguccacccacuggcaaaaccaggcgcagacccaugccuauaccagaacgggggcugugagcacaucuguaaaaagagacuaggaaccgcauggugcucaugcagggaaggguucaugaaagcguccgacggcaaaaccugccuugccuuagacggacaccaacuccuagcaggaggcgaaguugaccuuaaaaaccaaguaacgccguuagauauccucagcaaaacaaggguaagcgaggauaacaucaccgagucacagcacaugcucguggcagaaauuauggugucagaccaagacgacugcgcacccguaggcugcucuauguacgcaagaugcauauccgaaggcgaagacgccacaugccagugccugaagggcuuugccggggacgguaaacugugcuccgacauagaugagugcgaaaugggaguacccgucuguccgcccgcaagcuccaaaugcauaaacacagaaggcggauacgugugccggugcucagaaggauaccaaggcgacggaauccacugccuggacaucgacgaaugccaguuaggugaacauucgugcggggaaaacgccuccugcacuaacaccgaaggaggcuacacaugcaugugcgccggacgucugagcgaacccgggcuaauaugccccgacuccacaccacccccacacuugcgcgaggacgaccaccauuacagcguacggaacagcgacagcgaaugcccccuaucacacgacggcuacugcuuacacgacggcgucugcauguacaucgaagcccuagacaaauacgcgugcaacugcgugguagguuacauaggugagcguugccaauaccgagaccuuaaauggugggaacuacgccacgccggacacggccaacagcagaaggucaucgucgucgcaguaugcgucguaguccucgucaugcuucuacuccuaucacuauggggcgcacacuacuacagaacucaaaaauuauuaagcaagaaccccaaaaauccguacgaggaauccagcagagauguccgcagccggagaccggcggacacggaggacggcauguccucgugcccgcaacccugguucgucgucaucaaagaacaccaagaccugaagaacggcggccaacccguagcaggagaagacggacaagccgccgacggaagcaugcaaccgaccucguggcgacaagaaccccagcuaugcggcaugggcacugagcagggcugcuggauuccaguaaguagugacaaagguagcugcccacaggucauggagcgauccuuccauaugccuucuuacggaacacaaacacuagaaggcgguguagaaaagccgcauucucuccuguccgcaaacccgcucuggcaacaacgagcacuagauccaccccaccaaauggaacucacccaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2348 - RNA, 727 nt, Artificial Sequence
  mRNA product Design1 comprising derived and/or modified sequence from Homo sapiens__NP_001423.1__HsEREG (opt11)
gggagaaagcuuaccaugaccgccggccgccgcauggaaaugcucugcgccggccgcguccccgcacuccuccucugccucggcuuccaccuccuucaagccguccucuccaccaccgucauccccuccugcauccccggcgaauccuccgacaacugcaccgcccuaguccaaaccgaagacaacccacgcgucgcccaagucuccaucacaaaaugcuccuccgacaugaacggcuacugccuccacggccaaugcaucuaccucgucgacaugucccaaaacuacugccgcugcgaagucggcuacaccggcguccgcugcgaacacuucuuccucaccguccaccaaccccucuccaaagaauacgucgcccucaccgucauccucaucauccucuuccucaucaccgucgucggcuccaccuacuacuucugccgcugguacagaaaccgcaaauccaaagaacccaaaaaagaauacgaacgcgucaccuccggcgaccccgaacucccccaagucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2349 - RNA, 685 nt, Artificial Sequence
  mRNA product Design1 comprising derived and/or modified sequence from Homo sapiens__NP_000791.1__HsFGF1 (opt11)
gggagaaagcuuaccauggccgaaggcgaaaucaccaccuucaccgcccucaccgaaaaauucaaccucccccccggcaacuacaaaaaacccaaacuccucuacugcuccaacggcggccacuuccuccgcauccuccccgacggcaccgucgacggcacccgcgaccgcucagaccaacacauccaacuccaacucuccgccgaauccgucggcgaaguauacauaaaauccaccgaaaccggccaauaccucgccauggacaccgacggccuccucuacggcucccaaacccccaacgaagaaugccucuuccucgaacgccucgaagaaaaccacuacaacaccuacaucuccaaaaaacacgccgaaaaaaacugguucguaggccucaaaaaaaacggcuccugcaaaagaggcccccgcacccacuacggccaaaaagccauccucuuccucccacuccccgucucaucagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2350 - RNA, 1084 nt, Artificial Sequence
  mRNA product Design1 comprising derived and/or modified sequence from Homo sapiens__NP_001997.5__HsFGF2 (opt11)
gggagaaagcuuaccaugguggggguagggggaggggacguggaggacguaacgccgaggccgggagggugucagauaagcgggagaggggcgagagggugcaacggaauaccgggagcggcggcgugggaggcggcgcugccgaggaggaggccgaggaggcacccgagcguaaacccaagaagcagagcagcagggagcccgaggacgagggggagaaggacggaggagaggccgagugggagcaggcugggggaucgggggagggggagagcacugccgggagggcgacuagggggaagagggagggggagggcgccggagagggugggagggagggggagggggagggggacggcggcgccgagagcggcgccggcggcgagggggagcaggccgggaccggcggggacgauggcagcggggagcauaaccacguugccggcgcugccggaagauggagggaguggggcguucccaccggggcacuucaaggauccgaagagacuguauuguaagaauggaggguucuuucuaaggauacauccggaugggagaguggauggggugagggaaaagagugacccgcacauaaagcugcaguugcaggcggaggagagagggguaguaagcauaaagggggugugcgcaaauagguaucuggcgaugaaggaggaugggaggcuauuggcgagcaagugugugacggacgagugcuuuuucuuugaaaggcuagagagcaauaacuacaacacguacaggagcagaaaguauacgagcugguauguggcgcugaagagaacgggacaguacaaguuagggagcaagacagggccagggcagaaggcaauauuguuccugccaaugagugcaaagagcuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2351 - RNA, 802 nt, Artificial Sequence
  mRNA product Design1 comprising derived and/or modified sequence from Homo sapiens__NP_002000.1__HsFGF7 (opt11)
gggagaaagcuuaccaugcacaaauggauccucaccuggauccuccccacccuccucuaccgcuccugcuuccacaucaucugccucgucggcaccaucucccucgccugcaacgacaugacccccgaacaaauggccacaaacgucaacugcuccucccccgaacgccacacccgcuccuacgacuacauggaaggcggcgacauccgcguccgccgacucuucugccgcacccaaugguaccuacgcaucgacaaacgcggcaaaguaaaaggcacccaagaaaugaaaaacaacuacaacaucauggaaauccgcacagucgccgucggcauagucgcaaucaaaggcgucgaauccgaauucuaccucgccaugaacaaagaaggcaaacucuacgccaaaaaagaaugcaacgaagacugcaacuucaaagaacucauccucgaaaaccacuacaacaccuacgccuccgccaaauggacccacaacggcggcgaaauguucgucgcccucaaccaaaaaggcauccccguccgcggcaaaaaaaccaaaaaagaacaaaaaaccgcccacuuccuccccauggccaucaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2352 - RNA, 844 nt, Artificial Sequence
  mRNA product Design1 comprising derived and/or modified sequence from Homo sapiens__NP_001936.1__HsHBEGF (opt11)
gggagaaagcuuaccaugaaacuccuccccuccguaguccucaaacuauuccucgcagccguccuauccgcccucgucaccggcgaaucacucgaacgccuccgccgcggccucgccgcaggcacaagcaaccccgacccccccaccgucuccaccgaccaacuccucccccuaggcggcggccgagaccgcaaaguccgcgaccuccaagaagcagaccucgaccuccuccgcgucacccucuccuccaaaccccaagcccuagcaacccccaacaaagaagaacacggcaaacgaaaaaaaaaaggcaaaggacuaggcaaaaaacgcgaccccugccuccgcaaauacaaagacuucugcauccacggcgaaugcaaauacgucaaagaacuacgcgcccccuccugcauaugccaccccggcuaccacggcgaacgaugccacggccuaucccuccccguagaaaaccgacuauacaccuacgaccacaccaccauccucgccgucgucgccgucguccucucauccgucugccuacucguaaucguaggacuccucauguuccgcuaccaccgccgaggcggcuacgacgucgaaaacgaagaaaaagucaaacucggcaugaccaacucccacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2353 - RNA, 2404 nt, Artificial Sequence
  mRNA product Design1 comprising derived and/or modified sequence from Homo sapiens__NP_000592.3__HsHGF (opt11)
gggagaaagcuuaccaugugggucacuaaacuacuccccgcccuccuacugcaacacguucuccuccaccuauuacugcuccccauugcaaucccauacgccgaaggccagcgaaaacgccgcaacacgauccacgaauuuaagaaaagcgcaaaaacaacccuaaucaaaauagacccugcacuaaaaauaaaaaccaagaaagucaacacagcagaccaaugcgcuaacagaugcacccggaacaaaggccugccguucacaugcaaggcauucgucuucgacaaggcccgcaaacaaugccugugguucccauucaacucaaugagcucaggcgucaagaaagaguucggacacgaguucgaccucuacgaaaacaaagacuacauccgcaacuguaucaucggaaaaggaagauccuacaaaggcacaguaucaaucaccaaguccggcaucaaaugccaacccuggagcagcaugaucccccacgaacacuccuuccuccccagcucguaccgcggcaaagaccuccaagaaaacuacugccggaacccccgaggagaagaaggcggucccuggugcuucaccuccaaccccgaaguccgcuacgaagucugcgacaucccccaaugcagcgaaguagaaugcaugaccugcaacggcgaauccuacagaggccuaauggaucacaccgaauccggcaagauaugccaacgcugggaccaucaaaccccacaccgccacaaguuccuacccgaacgcuaccccgacaaaggauucgacgacaacuacugccgcaacccugacgggcaaccacgccccuggugcuacacccuagacccacacacacgaugggaauacugcgccaucaaaaccugcgccgauaacacaaugaacgacacugacgucccacuagaaaccaccgaaugcauacaaggacaaggcgaagguuacagaggaaccguaaacacuauauggaacggcauaccuugccaacgcugggacucccaauacccacacgaacacgacaugacucccgaaaacuucaaaugcaaagaccuccgcgaaaacuacugccgcaaucccgauggguccgaaagucccuggugcuucaccacagacccaaacauccgcgugggauacugcucccaaauucccaacugcgacaugucucacggucaagacugcuaccgaggcaacggcaagaacuacaugggaaaccugucacagaccagauccggucuaaccugcuccaugugggacaaaaacauggaagaccuccacaggcacauauucugggaacccgacgccuccaagcucaaugaaaacuacugcaggaaccccgacgacgacgcccacggccccugguguuacacaggaaacccccucauuccuugggacuacugcccaauaucacgcugcgaaggugacacuacacccacaauagucaaccucgaccaccccgucaucucuugcgccaaaacaaaacaacucaggguagucaacggaauccccaccaggacaaacauaggcuggauggucucccuacgguaccgcaacaaacacaucugcggaggcucacugaucaaagaauccuggguccucaccgcacgccaaugcuuccccagcagagaccucaaagacuacgaagccugguuagguauucacgacguccacggcagaggggacgaaaaaugcaagcaaguccucaacguaagccagcucgucuacggacccgaaggaucggaccucguacucaugaaacuggcccgccccgcaguacucgacgacuucgucucaacgauugaccugccaaacuacggaugcacgaucccagaaaagacgucauguagcgucuacgguuggggcuacacgggccucaucaacuacgacggccuccuccgagucgcacaccuuuauaucaugggcaacgaaaaaugcagccagcaccaccgaggcaaagucacacuuaacgaauccgaaaucugugcaggagccgagaaaauaggcucaggacccugcgaaggcgacuacggcggaccccuggucugcgaacaacacaaaaugcgcaugguccuuggcgucaucguacccggacgaggcugcgccauccccaaccgccccggcauauucgucagaguugcauacuaugcaaaauggauccauaaaaucauacuaacauacaaagucccccagucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2354 - RNA, 2143 nt, Artificial Sequence
  mRNA product Design1 comprising derived and/or modified sequence from Homo sapiens__NP_005336.3 __HsHSPA1A (opt11)
gggagaaagcuuaccauggcaaaagcagcagcaauaggcaucgaccuaggaaccaccuacucaugcgucggagucuuccagcacggcaaaguagaaauaaucgcuaacgaccaaggaaacagaaccacgcccucguacgucgccuucaccgacaccgaacgacugauaggggacgcagcaaagaaccaggucgcacucaacccacaaaauacagucuucgacgcaaaaagacucauaggcagaaaauucggcgaccccguagugcaaagcgacaugaaacacuggccauuccaagugauaaacgacggggacaaaccaaaaguccaagucucauacaaaggcgaaacaaaggcauucuacccagaagaaaucuccagcauggucuuaaccaaaaugaaagaaauagccgaagcauaccucgguuacccaguaacgaacgcagucauuacaguacccgcauacuucaacgacagccaacggcaagccacgaaagacgcgggagucauagcagggcucaacguauuaagaauaaucaacgaaccaacagcagcagccaucgcauacggccuggaucgcacaggcaagggcgaaagaaacguacugaucuuugaccuaggcgggggcacguucgacguaagcauccugaccauagacgacgggauuuucgaggucaaagcaacagcaggggacacacaccugggcggggaagacuucgacaacagacucgugaaccacuucguagaagaguucaaacgcaaacacaagaaagacaucucgcagaacaaaagagcagugagaagacuacggaccgcgugcgagcgcgcaaaacgcacccuaagcucaagcacgcaggcgagccuggaaauagacagccucuucgaaggaaucgacuucuacacaucuauaacaagagcgagauucgaagaacugugcuccgaccucuuccgcuccacgcuggagccagucgaaaaagcgcuccgggaugcgaaacuggacaaagcacaaauccaugaccucguacuggucggaggcucgacccgcauuccaaaagugcaaaaacuccuccaggacuucuucaacggacgagaccucaacaaaucaaucaaccccgacgaagcagucgcguacggggccgcuguccaagccgcaauccugaugggggacaaaagcgagaaugugcaagaccuccuccuccucgacguggccccacucucgcuuggacucgagaccgcgggaggcguaaugacagcacucauaaaaagaaauucaacaaucccaacaaagcagacacagaucuucacaacguauagcgacaaucaaccgggcguacucauacaaguauacgagggcgaacgcgcaaugacgaaggacaacaaccuucuaggcagauucgagcucucaggcauaccaccagccccacgcgggguaccgcaaauagaagugacauucgacaucgacgcaaacggaaucuuaaacguaacagcgaccgauaaaucaaccggaaaggcgaacaaaaucacaaucacaaacgacaaaggacgccuuucaaaagaagagaucgagagaaugguacaggaggcagaaaaguacaaagcagaggacgagguccaacgcgaaagaguauccgccaaaaacgcccuggaaucauacgcauucaacaugaaguccgccgucgaagacgaaggucuaaagggaaagauauccgaagccgacaaaaagaaaguacuagauaaaugccaagaagucaucagcuggcucgacgcaaacaccuuggccgaaaaagacgaauuugaacacaaaagaaaagaacuugaacaaguaugcaaucccauaaucucaggccuguaccaaggcgcaggcgggccagggcccgggggcuuuggggcacaaggccccaaaggaggaagcggaagcgggccgacaauagaggaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2355 - RNA, 2143 nt, Artificial Sequence
  mRNA product Design1 comprising derived and/or modified sequence from Homo sapiens__NP_005337.2 __HsHSPA1B (opt11)
gggagaaagcuuaccauggcgaaagcagcagcaaucggaaucgaccucgguaccacauacagcugcguaggcguauuccaacacgggaaaguagaaaucauagcaaacgaccaagggaaccggacaacccccuccuacgucgccuucaccgacacagaacgacuuaucggcgacgcagccaaaaaccaggucgccuuaaacccccaaaacaccgucuucgacgcaaaaagacucaucggaagaaaauucggggaccccgugguacaaagcgacaugaaacacuggcccuuccaaguaaucaacgacggagauaagcccaagguccaaguaucguacaaaggcgagaccaaagccuucuacccagaagaaauaucaagcaugguguuaaccaagaugaaggaaaucgccgaagccuaccucggcuacccagugacaaacgccguaauaaccgugcccgcguacuucaaugacucccaacgccaagccacgaaagacgccggcgucauagccggacuaaacguacuacgcauaauaaaugaaccgacagcagccgccaucgcauacggacucgaccgcacaggcaaaggcgaaagaaacguauugauauucgacuuaggcggaggcaccuucgacgucucgauacuaaccauagacgacggaauauucgaggucaaggccaccgccggagacacacaccuaggcggcgaagacuucgauaaucgucuagugaaccacuucguagaagaguucaagcgcaaacacaagaaagacaucucccaaaacaaacgugcagugcgaaggcuaagaaccgcaugcgaacgcgcaaaaagaacccucagcuccagcacacaagcgagccuagaaauagacagucucuucgaaggcaucgauuucuacaccucgauaacuagagcgcgcuucgaagaauuaugcagcgacuuauuccgaucgacauuagaaccuguagaaaaagcgcuccgggacgcgaaacuagacaaagcccaaauccacgacuugguccugguagggggcucuacaaggauaccgaaagugcaaaagcuauuacaagacuucuucaacggacgcgaucucaauaaauccaucaaccccgacgaggcaguagcauacggcgccgcgguccaggcagcgauacucaugggagacaaaucagaaaacgugcaagaccuccugcuccuugacguagcaccacucucgcucggacuagaaacggcgggaggggucaugaccgcacucaucaagagaaacaguaccaucccaaccaaacaaacccaaaucuucaccacauacucagacaaccaaccgggagugcuaauccaaguauacgaaggcgaacgcgcgaugaccaaagacaauaaccugcuaggaagauucgaacuaucaggcauacccccggcuccacgaggcgucccccaaaucgaaguaaccuucgacauagacgccaacggaauccucaacgugacagcgaccgacaaaagcaccgggaaagcaaacaaaaucacaaucacaaacgacaaaggacgauuaagcaaagaagagaucgagcgaaugguccaagaagccgaaaaguacaaagccgaagacgagguccaacgcgaacgaguaagcgccaaaaacgcauuagaauccuacgcguucaauaugaaaagcgcaguagaagacgaaggacugaaagggaaaauaagcgaagcagacaaaaagaaaguacucgacaaaugccaagaaguaaucuccuggcuagacgcaaauacccucgccgaaaaagacgaguucgaacacaaaagaaaagaacuggaacaagugugcaacccaauuaucucaggacuauaccagggggcaggcgggccaggacccggaggauucggcgcgcaaggaccaaaaggaggcagcggaagcggaccaacaaucgaggaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2356 - RNA, 2143 nt, Artificial Sequence
  mRNA product Design1 comprising derived and/or modified sequence from Homo sapiens__NP_005518.3 __HsHSPA1L (opt11)
gggagaaagcuuaccauggcgacagcaaagggcauagcaauaggcaucgaccucggcaccacauacuccugcguaggcgucuuccaacacggcaaaguagaaaucaucgcaaacgaccaaggaaacaggacaacacccucauacgucgcauuuaccgacaccgaaagacuuaucggagacgcggccaaaaaccaggucgcaaugaacccccaaaauaccgucuucgacgcaaagcgacucauaggacgcaaauucaaugaccccgugguacaggcagacaugaaacuauggccguuccaaguuauaaacgaaggcggaaagccgaaaguccucguauccuacaaaggcgaaaacaaagccuucuaccccgaggaaaucucgagcaugguccuaaccaaacucaaagaaacagccgaagcauuccucgggcacccagucaccaacgcggucauaaccguaccagcauacuucaacgacucgcaaagacaggcaaccaaagacgccggagucaucgcaggacugaacguccuccgaaucaucaacgaaccaaccgccgcagccaucgccuacggacuagacaaaggcgggcaaggcgaacggcacguacuuaucuucgaccucgggggcggaaccuucgacgucuccauccugaccaucgacgaugggauauucgaagucaaagccacggccggagacacacaccucggaggcgaagacuucgacaaccgccuaguaagucacuucgucgaagaguucaaacgaaaacacaaaaaggacaucagccagaacaaacgagcaguacgccgccucaggacagcaugcgaacgcgccaaaaggacacuaagcuccuccacgcaagcaaaccucgaaauagacagccuauacgaaggaauagacuucuacacaagcaucacaagggccagauucgaagaacucugcgcagaccuauuccggggcacacucgaaccagucgaaaaagcgcugcgagacgccaagauggacaaagccaaaauccaugacauaguccucgucggaggcuccacccgaauccccaaaguacaacgacuucuacaggauuacuucaacggaagagaucucaauaaaucaaucaaccccgacgaggcggucgcauacggcgccgccgugcaggccgcaauacucaugggggacaaaagcgagaaaguacaagaccuguuacuacuggauguggcaccccuaagccucgggcuggaaaccgccggaggggucaugaccgcccucaucaaacgaaacuccacgauccccacaaaacaaacccaaauauucaccaccuacuccgacaaccagccaggaguacuaauccaaguauacgaaggagaacgcgccaugacaaaagacaacaaccuacuaggccgguucgaucuaacaggcauaccaccggcgccccgagggguaccccaaaucgaaguaacauucgacaucgacgccaacggcauacugaacgugaccgcaacggacaaaucgaccgggaaagugaacaaaauaacaaucacaaacgacaagggccgcuuaagcaaggaagaaaucgagcgcaugguccuagacgcagaaaaauacaaagccgaagacgaaguacaacgagagaaaaucgccgcgaagaacgcgcuggaaagcuacgcauucaacaugaaaagcguaguaucagacgagggacuaaaaggcaaaauaagcgaaagcgacaaaaacaaaauacucgacaaaugcaacgaacuacuaagcuggcuagaagucaaucaacucgccgaaaaagaugaguucgaccacaaacgcaaggaacucgaacaaaugugcaacccaauaaucaccaaacuuuaccaaggaggcugcacaggcccagcaugcggaacaggcuacguaccaggccgaccugccaccggccccaccauagaagaaguagacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2357 - RNA, 2137 nt, Artificial Sequence
  mRNA product Design1 comprising derived and/or modified sequence from Homo sapiens__NP_068814.2 __HsHSPA2 (opt11)
gggagaaagcuuaccaugagugcgcgcggacccgcaaucggaauagaccucggcaccaccuacucaugcgugggcguauuccagcacggaaaagucgaaauaaucgcaaacgaccaagggaacagaaccacaccauccuauguggccuuuacugacaccgaacgccuaaucggagacgcugccaagaaccagguagcaaugaaccccacaaacacaaucuucgacgcaaagaggcuaaucggacgcaaguucgaagacgcaacaguccaaagcgacaugaagcacuggcccuuccgcguaguauccgaaggaggcaaacccaagguccaagucgaauacaaaggcgagacaaagaccuuuuucccagaagagaucucaagcaugguacucaccaaaaugaaagaaauagcggaggcauaucuuggaggaaagguccacagcgcagugauaacaguccccgcauacuuuaacgacagccaaagacaagcaacaaaagacgcaggaaccauaacaggacuuaacguccuccgaauaaucaaugaaccaacagcagcagcaaucgcauacggccuagacaagaaaggcugcgccggaggcgagaaaaacguccuaauauucgaccuaggcgggggaacguucgacgucucaauacucaccauagaagacggcaucuucgaggucaaaagcacggccggagacacacaccucggcggggaagacuucgacaaccgcauggugagccaucucgccgaagaguucaaaagaaagcacaagaaagauauaggccccaacaaacgggcagugagaaggcucaggaccgcaugcgaacgggcgaaaagaacccucagcucaagcacacaagcaaguauugaaaucgacucccuauacgaagggguagacuucuacaccucaaucacacgggcccgcuuugaggaacuaaacgccgaucuguuccgcggaacacuagaaccagucgaaaaagcacuccgagacgcaaaauuagacaaaggccaaauucaagaaauaguccuggucggagguuccacccgcaucccaaaaauccaaaaacuacuacaagacuucuucaacgggaaagaacucaacaaaucaauuaaccccgaugaagcagucgccuacggagcagcaguacaagcagcgauacucaucggggacaaaagcgagaacguccaagaccuacuacugcuagacgugaccccacucucacucgggauagagacagcaggcggaguaaugaccccacugauaaaacgaaacacaaccauacccacaaaacagacccagaccuucacaaccuacagcgacaaccagucauccguacucguccagguguacgagggagaacgagcaaugacgaaagacaacaaccuauugggcaaguucgaccuaacgggcauaccgcccgcgccccgcgguguaccacaaaucgaagucacuuuugacauagacgccaacggaauccuaaacgugaccgcggccgacaaaagcacagggaaggaaaacaagaucacaauaacaaacgacaaagggagacugagcaaagacgacauugaccgaaugguccaagaagcagaacgcuacaaaucugaagaugaggcaaacagagaccgagucgcugcaaagaacgcacuggaaucuuacaccuacaacaucaagcagaccgucgaagacgaaaaacugcgaggaaaaauaagcgaacaagacaaaaacaaaauacuggacaaaugucaagaagucauaaacuggcucgaccgaaaccaaauggccgaaaaagacgaauacgaacacaaacaaaaagaacucgaacgaguaugcaaccccauaaucucaaaauuauaccaaggaggcccaggaggcgggagcggcggaggaggcuccggagcgagcggaggccccaccaucgaagaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2358 - RNA, 2740 nt, Artificial Sequence
  mRNA product Design1 comprising derived and/or modified sequence from Homo sapiens__NP_002145.3 __HsHSPA4 (opt11)
gggagaaagcuuaccaugucggucguaggaaucgaucugggcuuucaaucaugcuacguugcaguggcgagagcaggaggaaucgaaaccauagccaacgaauacagcgauagguguacgccggcaugcaucagcuucggccccaaaaacagaucaauaggagcagccgccaaaucacaagucaucuccaacgcaaagaacaccguacaaggcuucaagcgauuccauggcagagccuuuucggacccguucgucgaagcugaaaaauccaacuuagcguacgacauaguucaacucccaacaggauuaaccggcaucaaagucaccuacauggaagaggagcgaaacuuuaccaccgaacagguaaccgcgaugcuccuaagcaagcuaaaggaaaccgcagaaagcguccucaaaaagcccgucguagauugcguggucuccgucccaugcuucuacacggacgcagaacgucgcagcguaauggacgccacacaaauagccggacucaacugccuacggcugaugaacgaaacgaccgcagucgcacuggccuacgggauauauaagcaagaccuaccagcgcuggaagaaaaaccacguaacguggucuucgucgacaugggacacuccgccuaccaagucuccgugugcgcguucaaccgcggcaaacucaaaguccucgcaacagcguucgauaccacauugggcggacgcaaguucgaugaaguacucguaaaccacuucugcgaggaguucggcaaaaaguacaaacucgacaucaaaucgaaaauacgagcacuacuccgccuuagccaagaaugugaaaaacuaaagaaacugaugucagcaaacgccagcgaccuaccacuaucaauagaaugcuucaugaacgacguagacguaagcggaacgaugaaucgcggaaaauuccuggaaaugugcaacgaccuccucgcccgaguugagccgccacuacggagcgugcucgaacaaaccaagcucaagaaagaagacauauacgccguagaaauagucgggggcgcaacccgcauccccgccgugaaagagaaaaucucaaaauucuucgggaaagaacucagcaccacacucaacgccgacgaagcggugacccgaggcugcgcgcuccaaugcgcaauccuaagccccgccuucaaaguacgagaguucuccauaaccgacguaguccccuaucccauaucccuuagguggaauagccccgcagaagaaggcagcagcgacugcgaaguauucagcaaaaaccacgccgcacccuucucaaaaguacugaccuucuaccgaaaagaaccauucacacucgaggcauacuacagcuccccacaggaccucccauacccagacccggccaucgcccaauucagcguacaaaaagucacaccacaaagcgacgguagcucgagcaaagucaagguaaaaguccgggucaacguucacggcauauucucaguaagcagcgcaagccucguagaaguacacaaauccgaggaaaacgaagaacccauggaaaccgaccaaaacgccaaagaagaagagaaaaugcaaguagaucaagaggaaccacacgucgaggaacaacagcaacagacccccgccgaaaacaaagcagaaagcgaagaaauggaaaccagccaagccggcuccaaagauaagaaaauggaccaaccaccacaagccaaaaaggccaaagucaaaacauccacagucgaucuccccauagaaaaccaacuacuauggcaaaucgaccgcgagaugcucaacuuauacauagagaaugaaggcaaaaugauaaugcaagacaaacucgaaaaagagagaaacgacgccaaaaacgcagucgaagaauacgucuacgaaaugcgagacaaacuaagcggcgaauacgagaaauucguaucggaagacgacagaaacagcuucacccuaaagcuggaggacaccgaaaacuggcuauacgaagacggagaagaccaacccaaacaaguauacguagacaaacucgcagaacucaaaaaccuaggccaacccaucaaaauacgauuccaagaauccgaggaacgccccaaauuauucgaagaacucggcaagcaaauccaacaguacaugaaaauaauaucgagcuucaaaaacaaagaagaccaauacgaucaccuggacgcagcagacaugacuaaaguagaaaaaucaacaaacgaagcaauggaauggaugaacaacaaacucaaccuucaaaacaagcaaagccuuaccauggacccaguagucaaaagcaaggaaaucgaagccaagaucaaagagcucacaucaaccuguuccccuaucauaucaaaacccaaaccaaaaguagaaccacccaaggaagaacagaaaaacgccgaacaaaacggccccgucgacggacaaggcgacaaccccggcccccaagccgccgaacaagggaccgacaccgcaguaccaagcgacagcgauaagaaacuucccgaaauggacaucgacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2359 - RNA, 2737 nt, Artificial Sequence
  mRNA product Design1 comprising derived and/or modified sequence from Homo sapiens__NP_055093.2 __HsHSPA4L (opt11)
gggagaaagcuuaccaugucagucgucggcaucgaucucggguuccugaacugcuacauagcagucgcccggaguggagggaucgagacaauagcaaacgaauacucggaccgcugcacacccgcaugcauaagccucggcuccagaacgagagccaucgguaacgccgcuaagagccaaaucguaaccaacguacgcaacacaauccacggcuuuaagaaacuccacggcagaucguuugacgacccuauaguccagacagagcgcauacgacugcccuacgaacuacagaaaaugccaaacgggagcgcgggcgucaaaguccgauaccuagaagaggagcgcccauucgcaauugaacaaguaacuggaaugcugcuagcaaaauuaaaagaaacgagcgaaaacgcccuaaagaaacccguagccgauugcguuaucucaauaccgagcuuuuucacagacgcagagcggcgcucagucauggccgcagcccaagucgccggccucaacugccuccgccucaugaacgaaacaacugccguugcccuggccuacggcaucuacaaacaagaccuaccgccccuggacgagaaaccgcgaaacgucgucuuuaucgacaugggacacuccgcauaccaaguucuaguaugcgccuucaacaaaggcaagcucaaaguacuggcaaccacauucgaccccuaccucgguggacgaaacuucgaugaagcgcucgucgacuacuucugcgacgaguucaaaacgaaauacaaaaucaacgucaaggagaacucccgggcccugcuaagacucuaccaagagugcgaaaaacuaaagaaacuuaugucggcaaacgccucagaccugccccucaacauagaauguuucaugaaugaccucgacguaagcuccaaaaugaaccgcgcacaauucgagcaacuaugcgccagccugcuagccaggguagaaccuccacuaaaagcagucauggagcaggcuaaccuacaacgcgaggacauaagcagcaucgagaucgugggaggcgccacacgcauacccgcagucaaagaacaaaucaccaaauuuuuccuaaaagacaucucaaccacccucaacgccgacgaagcaguagcgcgcggcugcgcccuccaaugcgcgauacucagcccagccuucaagguacgcgaguucaguaucaccgaccucguccccuacucaauaacacuaagauggaaaaccucguucgaagacggcuccggagaaugcgaaguauucugcaagaaucacccggcaccguucucgaagguaaucaccuuccacaagaaagaacccuucgaacuugaagcauucuacacaaaucuucacgagguaccauacccggacgcacgcauaggcucauucaccauccaaaacgucuucccccaauccgacggcgacucaagcaaagugaaagugaaaguccgcguaaauauccacggaauauucuccguagcaagcgcaucaguaaucgagaaacaaaaccucgaaggcgaccacagcgacgcaccaauggagaccgaaaccagcuucaagaacgagaacaaggacaauauggacaaaaugcaaguagaccaggaagaaggacaccagaaaugccacgcagaacacacccccgaggaagaaaucgaccacacaggcgccaaaacaaaauccgccguaagcgacaaacaggaucgccuaaaccagacgcucaaaaaggggaaagugaaauccauagaccuacccauccaguccucacuuugccgccagcuaggccaggaccuucugaacucauacaucgaaaacgaggggaaaaugaucaugcaagacaaacucgaaaaggaaaggaaugacgccaaaaacgcagucgaagaauacguauacgacuuccgcgaccgacugggcacaguauacgaaaaauucauuacacccgaagaccucaguaagcuaagcgcggucuuggaggacaccgagaacuggcucuacgaagacggcgaggaccagcccaaacaaguauacguggacaaacuacaagaacucaaaaaguacggacaaccuauccaaaugaaguacauggaacacgaagaacgcccaaaagcucuaaacgaccuaggcaagaagauacagcucguaaugaaggucaucgaagccuaccgcaacaaagacgaaagauacgaccaccuagacccaaccgaaauggaaaaaguagaaaaaugcauaagcgaugcaaugagcuggcucaacucuaagaugaaugcacaaaacaaacucucccuuacccaagacccagucguaaaagucucagaaauugucgcgaaaagcaaagagcuagacaacuucugcaaucccaucaucuacaagcccaaacccaaagcagaaguacccgaagacaaacccaaagccaacuccgaacacaacggcccgauggacggccaaagcggaaccgaaacaaaguccgacaguaccaaagacagcucgcagcacaccaaguccuccggcgaaauggaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2360 - RNA, 2182 nt, Artificial Sequence
  mRNA product Design1 comprising derived and/or modified sequence from Homo sapiens__NP_005338.1__HsHSPA5 (opt11)
gggagaaagcuuaccaugaaacuaagccuggucgcagcaaugcugcuacuacuaagcgcagcaagggcagaggaagaagacaagaaagaggacgucggcacaguagucggaauagaccuggggacgaccuacagcuguguaggggucuucaagaacggcagaguugaaaucaucgcaaacgaccaaggcaaccgaauaacaccgagcuacguagcguucacacccgaaggcgaaagacucaucggggacgcagccaaaaaccaacuaacaagcaacccggaaaacacaguguucgacgccaaaagacuaaucggcagaaccuggaacgaccccuccguccaacaagacauaaaauuccucccauucaaagugguagaaaagaaaacgaaacccuacauacaagucgacauagggggcgggcagacaaaaacauucgcgccagaagaaaucagcgcaaugguccuaaccaaaaugaaagaaacggcagaagcguaccugggaaagaaagucacccacgccgucgucacgguccccgccuacuucaacgacgcgcaacgacaagcaaccaaagacgcaggcacgaucgcgggacugaacguaaugaggauaaucaacgaaccaacagcagccgccaucgcauacggacuggacaagcgcgaaggagagaaaaacauacuggucuucgaccugggcggaggaacauucgacgucucgcuacugacaauagacaacggcguauucgaggucguggcuacgaacggagacacacaccuaggaggggaagacuucgaccaacgagucauggaacacuucauaaaacuauacaagaagaaaaccggaaaagacguaagaaaagacaacagagccguacaaaaacugaggcgcgaaguagaaaaagcgaaacgggcccugagcucgcaacaccaagcgagaauagaaauagaguccuucuacgaaggagaagacuucagcgaaacacuaacgcgcgccaaauucgaagaacucaacauggaccucuuccgcucaacuaugaagcccguccaaaaagugcucgaagacagcgaccugaaaaagagcgauaucgacgaaauaguacugguaggcggaagcacacggaucccaaaaauacagcaacucgugaaagaguucuucaacggaaaagaaccaucgcgagggaucaacccagaugaagcggucgcauacggugcagcgguccaggccgggguacuaagcggagaccaagacacaggagaucugguacuccuugacgugugcccacuaacccucgggauagagaccguaggcggcguuaugacaaaacugaucccccgcaacaccguaguacccacgaagaaaagccaaaucuucagcacggcaagcgacaaccaaccgaccguaaccauaaaaguguaugagggggaacgaccccucacgaaagacaaccaccuacucggcacauucgaccucacaggaauaccaccagccccgcgcggaguaccacaaaucgaaguaacguucgaaaucgacgugaacggaauccuacgcgucaccgccgaggacaaagggaccggcaacaagaacaaaaucaccaucacgaacgaccaaaaccgccucacaccggaggaaaucgaacguauggucaacgacgcggaaaaguucgcggaagaggacaagaaacucaaagaacgcauagacacgcgaaacgaacuggaaucauacgcauacucacugaaaaaccaaauaggagacaaggaaaagcuaggaggcaagcuaucgagcgaggacaaagaaacaauggaaaaggcagucgaggagaaaauagaauggcuagaaucccaccaagacgcagacauagaagacuucaaagcgaaaaagaaagaguuagaagaaaucguucaaccaaucaucagcaaacuauacgguagcgcaggcccaccgccuacaggcgaggaagauaccgcagaaaaagacgagcuguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2361 - RNA, 2149 nt, Artificial Sequence
  mRNA product Design1 comprising derived and/or modified sequence from Homo sapiens__NP_002146.2__HsHSPA6 (opt11)
gggagaaagcuuaccaugcaagccccacgagagcuagcaguaggaauagaccucggaacuacauacucaugcguaggcguauuccaacaaggacgcguagaaauacucgcaaacgaccaaggcaaccgcaccacgccaagcuacgucgccuuuaccgacaccgagagacucguaggcgacgcagccaaaucgcaggccgcccucaauccccacaacaccgucuucgacgcgaaaagacuaaucggccgaaaauucgccgauaccacaguccaaagcgacaugaaacacuggcccuuucgcguagugucagaaggaggaaaaccaaaagucagggucugcuaccgaggagaagacaaaaccuucuacccagaagagauaucgaguaugguacuauccaaaaugaaggaaaccgcagaagccuaccuaggacaaccaguaaagcacgccgucauaacaguaccagcguacuucaacgacagccaaagacaagccaccaaggacgccggggccauagccggacuaaacguccuccgcauaaucaacgaaccgaccgcugccgcgaucgcauacggccucgaccgcaggggagcuggcgaaagaaacguccucaucuucgaccucggagggggaacauucgacgucucaguacuaaguauagacgccggcguauuugaaguaaaagccacagcaggcgacacccaccuaggaggagaagacuucgacaaccgacucgugaaccacuucauggaagaguuccgacgcaaacacggcaaagaccucuccggcaacaaacgggccuugagacgacucagaacagccugcgaaagagcaaaaagaacacucagcucaagcacacaagcgacauuagaaauagacucccuauucgagggcguagacuucuauaccucgaucacacgcgcaagauucgaggaacugugcucagaccucuucagaucaacccucgaaccggucgagaaagcucuaagagacgccaaacuagacaaagcacaaauccacgacgucgucuuaguaggcggaagcacccgaauaccaaaagugcaaaaacuccuacaagacuucuucaacggaaaggagcucaacaagucaauaaaccccgacgaagccgucgcauacggggccgcaguacaggccgcagugcucaugggcgauaaaugcgagaaaguccaagaccuucuacuacucgacguagccccacuuucccuagggcucgaaaccgcgggcgggguaaugaccacccucauccaacgaaacgcaacaauaccaacuaaacaaacccagaccuucacaacauacucagacaaucaaccgggaguauucauacaagucuacgaaggcgaacgagccaugacaaaagacaacaaccuucucggcagguuugaacucagcggcauacccccagccccacgcggcgucccacaaauagaagucaccuucgauauagacgccaacggcauacucagcguaacggcaaccgaccgcagcaccggaaaagcgaacaagauaaccaucacaaacgacaaagggcgccuaagcaaagaagaggucgagcgcaugguccaugaagcagaacaguauaaagcagaggacgaagcccaacgagacagaguagcagcgaaaaacagucucgaggcacacguguuccacgucaaaggcucacuacaagaagagagccuacgagacaaaauccccgaagaagacaggcggaaaaugcaagauaaaugccgcgaaguacucgcuuggcucgagcacaaccaacuggccgaaaaggaggaauacgaacaccaaaaacgagaacucgagcagauaugccgacccauauucucccgccucuacggcggccccggcguccccggaggaagcagcugcggcacgcaagccagacaaggagaccccucaaccggacccauaaucgaagaaguggacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2362 - RNA, 1321 nt, Artificial Sequence
  mRNA product Design1 comprising derived and/or modified sequence from Homo sapiens__P48741__HsHSPA7 (opt11)
gggagaaagcuuaccaugcaagccccccgcgaacuagccguaggcaucgaccucggcacaaccuacagcugugucggcguauuccaacaaggcagaguagaaauccuagccaacgaccaaggcaacagaacgaccccaucauacgucgcguucaccgacacagaaaggcuaguaggagacgcagcaaaaucccaagcagcccuaaacccgcacaacacuguauucgacgccaaacgccuaaucggacgaaaauucgcagacacaaccguccaaucagacaugaaacacuggccauuccaagucgucuccgaagguggaaaacccaaaguacgaguaugcuaccgaggggaagacaaaacauucuacccagaagaaauaagcucaaugguacuaagcaaaaugaaagaaaccgcggaagccuaccuaggccaaccaguaaaacacgccguaaucacggucccgaccuacuucagcaacucccagagacaggccaccaaagacgcaggagcaaucgcaggccuaaaaguacucccaaucauaaacgaagccacagccgcagcaauagccuacggccuggaccgaagaggagccggcaaacgaaacguacucauauucgaccuaggaggaggaacauucgacguauccguacucucgaucgacgccggggucuucgaaguaaaagcuaccgccggcgacacccaccuaggaggcgaagacuucgacaaccgccuagucaaccacuucauggaagaauuccgcagaaaacacggcaaagaccuaagcggaaacaaacgagcccucagacgacuccgaacagccugcgaacgagccaaacgcaccccaucaagcagcacccaggccacacuagaaaucgacucccuauucgaaggcguagacuucuacaaaagcaucaccagagccagauucgaagaacucugcagcgaccuauuccgaagcacccuagaacccguggaaaaagcccuccgcgacgccaaacuagacaaagcacaaauccacgacuucguacuaggcggcgggcuccacagccacccacaaggcgcagaagucgccgcaggccuacuccaacgacaaggcgcagaacaagaacaccagccauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2363 - RNA, 2158 nt, Artificial Sequence
  mRNA product Design1 comprising derived and/or modified sequence from Homo sapiens__NP_006588.1 __HsHSPA8 (opt11)
gggagaaagcuuaccaugucaaaaggacccgcagugggaaucgaccuaggcaccaccuacucaugcguaggcgucuuccaacacggaaaagucgagauaaucgccaacgaccaaggaaacaggacgacaccaucauauguagccuucaccgacaccgagcgccuaauaggagacgccgccaaaaaccaggucgcaaugaacccaacgaacaccguauucgacgccaaacgacuaaucggccgccgauucgacgaugcagucguccagagcgacaugaaacacuggcccuucaugguaguaaacgacgccggccgaccaaagguacaagucgaauacaaaggcgaaaccaaauccuucuaccccgaagagguguccagcaugguccucaccaaaaugaaagaaauagcagaagcguaccuggggaaaacagucaccaacgcaguagucaccguccccgcauacuucaacgacagccagagacaagcaacaaaagacgcaggcaccaucgccgggcuaaacguccuacgcauaaucaacgaacccacagcagcugcaaucgcauacggucucgacaagaaaguuggugccgaacgcaacguccuaaucuucgaccucgggggcggcaccuucgacguaucaauccucacaauagaagacggaauauucgaagucaaaagcaccgcaggcgacacccaccuaggcggcgaggacuucgacaacagaaugguaaaccacuucaucgcagaguucaaacggaaacacaagaaagacaucuccgaaaacaaacgcgcaguacgacgccuacggacagcaugcgaacgcgccaaacgcacccucuccuccuccacccaagcaagcauagaaaucgacagccuauacgaaggaauagauuucuacacauccaucacaagggcgcgcuucgaagaacuaaacgcagaccucuuccgagguacccucgacccagucgaaaaagcauuaagagacgcaaaacuagacaaaagccaaauccacgacauaguccuggugggcggaucaacccguaucccuaaaauccaaaaacuacuacaggacuucuucaacggaaaagaacuaaacaaguccaucaacccagacgaagcuguggcauacggcgcggccguacaagccgccauccuaagcggcgacaaaucggaaaacgugcaggaccugcuacuccuagacgucacaccccucucacuaggcauagaaaccgcgggcggcguaaugaccguccuaauaaaacgaaacacaaccauaccaaccaaacaaacgcaaaccuucacaacauacagcgacaaccaaccagggguacucauccaaguauacgaaggcgaacgcgcaaugaccaaagacaacaaccuccuaggcaaauucgaacuuacaggaaucccacccgcaccccgagggguaccccaaauagaaguaacauuugacauagacgccaacggcauccuaaaugucagcgccgucgacaaaagcaccggaaaagaaaacaaaauaacgauaaccaacgacaaaggccgacugagcaaagaagacaucgagcgaaugguacaagaagccgaaaaauacaaagcagaggaugaaaaacagcgcgacaaaguaucaagcaaaaacagucuggaaagcuacgccuucaacaugaaagcaacaguggaagacgaaaaacuccaaggcaagaucaaugacgaagacaagcagaaaauccucgacaaaugcaacgaaaucaucaacuggcucgacaagaaccaaacagcagaaaaggaagaguucgaacaccaacagaaagaacucgaaaaagucugcaaccccauaaucacaaaacuguaccaauccgcaggcggaaugcccggcggcaugcccggaggauucccaggcggcggggcaccacccaguggcggagccagcucaggaccgacaaucgaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2364 - RNA, 2257 nt, Artificial Sequence
  mRNA product Design1 comprising derived and/or modified sequence from Homo sapiens__NP_004125.3 __HsHSPA9 (opt11)
gggagaaagcuuaccaugauaagcgccucaagagcagcagccgccagacugguaggagccgcagcaucaaggggcccgacagcagccagacaccaagacucauggaacggccuaagccaugaagcauuccgccucguaagccgacgcgacuacgcgagcgaagcaauaaaaggagccguggucggcauagaccuaggaaccacgaacucgugcguggccguaauggagggaaaacaagcaaaaguacucgaaaacgccgaaggggcaagaacaacgcccucaguaguagcguucacugcggacggcgaaaggcuaguaggcaugccagcaaaacgacaagcggugacaaacccaaacaacacguucuacgcaacaaaacgacucauaggacgacgauacgacgacccggaaguacaaaaagacaucaaaaacgucccguucaaaauagugcgcgccaguaacggagacgccugggucgaagcccacggcaaacucuacagcccaucccagaucggcgccuucguccuaaugaagaugaaagagaccgccgaaaacuaccucggacacacagcuaaaaacgcagucaucacugugccagcguauuucaacgacagccaaaggcaagccacgaaagacgccgggcaaauaaguggacuaaacguccuaagggucaucaacgaaccgacugcagcggcccuggcauacggccuagacaagagcgaagacaaaguaauagccguauacgaccuaggaggcgggacauucgacauaagcauccuagaaauacagaaaggaguauucgagguaaaaagcacgaauggggacacguuccuggguggcgaagacuucgaccaagcacugcuacgccacaucgugaaggaguucaaacgagaaacaggggucgaccucacaaaagacaacauggcgcuccaacgaguccgcgaagcagcggaaaaagcaaaaugcgaacuaagcagcagcguacaaaccgacauaaaccuacccuaccuaacaauggacaguagcgggccaaaacaucucaacaugaaauuaacaagagcucaauucgaaggcaucguaacggaccuaauacgacgaaccaucgccccgugccaaaaagccaugcaagacgcagaaguaagcaagagcgacauaggagaaguaauacugguaggcggcaugacaagaaugccgaaaguacaacaaaccguacaagaccuauucggacgagcaccaagcaaagccgucaacccggaugaagcaguggccauuggcgcagcaauccagggaggcgugcuagcgggcgauguaacagacguacuccuacuagacguaaccccgcuaagccuaggaauagaaacccuaggcggaguauucacaaagcugauaaacagaaacacaacaaucccaaccaagaaaagccaaguauucagcaccgcggcagacgggcaaacccaaguggagaucaaagucugucaaggagaacgagagauggccggcgauaacaaacugcucggccaauucacccugaucggcauaccacccgcgccgagaggaguaccccaaaucgaggucacguucgauaucgacgccaacggcauaguccauguaagcgccaaagacaaaggaaccggacgcgaacaacaaauagucauccaaucaagcggaggccuaagcaaagacgacaucgagaacauggucaaaaacgcggaaaaauacgcagaggaagaccgaagaaagaaagaaagagucgaagcaguaaacauggccgaaggaauaauacacgacaccgaaaccaaaauggaagaguucaaagaccaacuaccagcugacgaaugcaacaaacucaaagaagaaauaaguaaaaugcgagagcuacuagcgcgcaaagacagcgaaacgggagaaaauauacgccaggcagcgagcagccugcaacaagcuagccuaaaacuguucgaaauggccuacaagaaaauggcauccgaaagggaaggaagcggaagcagcggcaccggcgaacagaaagaagaccaaaaagaagagaaacaguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2365 - RNA, 2245 nt, Artificial Sequence
  mRNA product Design1 comprising derived and/or modified sequence from Homo sapiens__NP_079291.2__HsHSPA12A (opt11)
gggagaaagcuuaccauggcagauaaagaagcaggcggauccgacgggccacgagaaaccgccccaacauccgcauacagcucgccagcccgaucacuaggagacaccgguauaacgccccuuucccccucccacaucgucaacgacaccgacucaaacguauccgaacaacaauccuucuuaguugucguggccgucgacuucggaacaacaucauccggcuaugccuauucauucaccaaagaaccggagugcauccacgucaugcgucgcugggaaggaggagaccccgggguuucaaaccagaaaacccccaccaccauccuucucacccccgaacggaaauuccacuccuucggcuacgccgcccgggacuucuaccacgaucuagacccgaacgaagcaaagcaauggcucuaccuagaaaaauucaaaaugaaacuucacaccaccggcgaccucacaauggauacagaccuuacagccgcaaacggcaagaaagucaaagcgcucgaaaucuucgccuacgcacuccaauacuucaaagaacaagcccucaaagagcuauccgaccaagccggcucagaguucgaaaacucagacguccgcugggucauaacaguaccugcgauauggaaacaacccgccaaacaguuuaugagacaagcagccuaccaggcuggacuggcauccccugaaaacucagaacaacucauaaucgcgcuagaacccgaagcugcaagcauauacugccgaaaacuccgccuccaccagaugaucgaacugagcuccaaagcagccguaaacggauacagcggcuccgacacugucggcgcaggauucacccaagcuaaagaacacauccgacgaaaccgccagucacgcacuuuccuagucgaaaacgucauaggagaaaucuggagcgaacuagaagaaggagacaaauacgucguggucgauucaggcggcggcaccgucgaccuaacaguccaccaaaucaggcuaccagagggccaccucaaagagcuauacaaagcaaccggcggccccuacggaucccucgguguagacuaugaguucgagaaacugcucuacaaaauauuuggcgaggacuuuaucgagcaauucaaaaucaaacgccccgccgccugggucgacuugaugaucgccuucgaaagccgaaaacgcgccgccgcccccgacagaacaaacccacuaaacaucaccuuacccuucucguucaucgacuacuacaagaaauuucgcggccacuccgucgagcacgcccuacgaaaaagcaacgucgacuucgucaaauggucaucgcaaggaaugcuccguaugucccccgacgccaugaaugcccuauucaaacccacaauagacuccaucaucgaacaccuccgcgaccucuuucaaaagccagaaguaucaaccgucaaauuucucuuccuagucggcggcuucgcagaagcaccccuacuccaacaagccguucaagccgcuuucggcgaccaaugcagaaucauaaucccacaagacguaggacucaccauucucaaaggcgccguacuuuucggccucgacccagccgucauuaaagugcgaagauccccucugacauacggcgucggaguccuaaaccgcuacgucgaaggaaaacacccacccgaaaaacuucuagucaaagacggcacccgauggugcaccgacguauucgauaaauucauaucagcagaccaaagcgucgcccucggcgagcuagucaaaagauccuacacacccgccaaaccaagccaacucgucaucguuaucaacauauacuccagcgaacacgacaacguaucguucauaaccgaccccgggguaaagaaaugcggcacccuccgccucgaccuaacaggcaccucaggcaccgccgucccagcacgcagagaaauacaaacccucaugcaguucggugacaccgaaaucaaagccaccgccaucgacauagcaaccaguaaaucggucaaaguaggcauagacuuucuaaacuacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2366 - RNA, 2278 nt, Artificial Sequence
  mRNA product Design1 comprising derived and/or modified sequence from Homo sapiens__NP_443202.3 __HsHSPA12B (opt11)
gggagaaagcuuaccaugcuagccgucccagaaaugggcuuacaaggacuuuacaucggaagcuccccagaacgaucacccguacccagcccacccggaucaccccgcacccaggaaucaugcggaaucgcgccccugacacccagccaaagcccaaaacccgaaguacgggccccgcaacaagccuccuucagcguagucguggccauagacuucggaacgaccagcaguggcuacgcauucucauucgcaagcgauccagaggccauacacaugaugcgaaaaugggaaggcggcgacccaggaguagcacaccagaaaaccccaacaugccuacuccuaacccccgaaggcgccuuccacucauucggcuacacugcaagagauuacuaccacgaccucgacccggaagaagcccgcgacuggcucuacuucgagaaauucaagaugaaaauccacagcgccacagaccuaacacugaaaacccaacucgaggcggugaacggcaagacaaugccagcacucgaaguauucgcacacgcccuccgauucuuccgcgaacacgcacuacaagaacuacgcgaacaaagccccagucugcccgagaaggacaccguccgguggguguuaaccguacccgcaaucuggaaacaaccagcaaaacaauucaugcgcgaagccgccuacuuagccggacuuguaagcagagagaacgcagaacaacuccucauagcccuggaacccgaagccgccuccguauacugccgaaaacuacgacuacaccaacuacuagaccugucgggccgcgcccccggcggcggccgccuaggcgaaagacgaagcauagacuccuccuuccgccaagcccgagaacaacuaagaagauccagacacucacgaaccuuccuaguagaauccggagucggagaacuaugggccgaaaugcaagccggcgaccgcuacguagucgccgacugcggagggggcacugucgaccuuaccguacaccaacuagaacaaccacauggcacccuaaaagaacuauacaaagccucgggaggucccuacggggcugucggcguagaccucgcauucgagcaacuccuaugccgcaucuucggagaagacuucaucgcaacauucaaacgccaaaggcccgccgcaugggucgaccucacuaucgccuucgaagcacgaaaacgaacagcaggaccccaucgcgcaggcgcccucaacaucucacuacccuuuuccuucauagacuuuuacagaaaacaaagagggcacaacguagagacagcacucagacgauccagcgugaacuucguaaaauggucaucccaagggaugcugcgaaugucaugcgaagcaaugaacgagcuauuccaaccaacaguaucaggcauaauccaacacaucgaagcacugcucgcccgaccagaaguacaaggcguaaagcuccucuuccuagucggcggauucgccgaaagcgcaguccuccaacaugccguccaagccgcccugggcgcacgcggacuacgagucgucguaccacacgacgucggacucacgauacucaaaggagccguacuauucggacaagccccaggaguaguccgcguccgccguucgccgcucaccuacggcgucggcguccucaacagauucguaccaggacgccaucccccagaaaaacugcugguccgcgacggccgcagaugguguacagacgucuucgaacgcuucguagcagccgagcaauccgucgcgcuaggagaggaaguccgccguucauacugucccgccagacccggccaacgaagaguacucaucaaccuauacugcugcgcagcagaagacgcacgcuucauaacugacccaggcguccggaaaugcggcgcccucucacuagaacucgaacccgccgacugcggacaggacaccgcaggagccccacccggacgacgcgaaauucgggccgccaugcaauucggcgacaccgaaaucaaggugacagccguggacgucagcacgaaccgcagcguuagagcaagcauagacuuccucucaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2367 - RNA, 1633 nt, Artificial Sequence
  mRNA product Design1 comprising derived and/or modified sequence from Homo sapiens__NP_008879.3__HsHSPA13 (opt11)
gggagaaagcuuaccauggcccgcgaaaugaccauccucggcucagccguccuuacccuacuacuagcgggauaccuagcccaacaauaccuuccacuacccacccccaaagucauagguauagaccucggaaccaccuacugcuccgucggcgucuucuuucccggaaccggaaaagucaaagucaucccagacgaaaacggacacaucucuauccccucgauggucagcuucacagacaacgacguauacgucggcuacgaauccgucgagcuagccgacagcaacccacaaaacacaaucuacgacgccaaacgcuucaucggcaaaaucuucaccgccgaagaacucgaagccgaaaucggacgcuaccccuucaaaguacucaacaaaaacggcauggucgaguucucaguaaccagcaacgaaaccauaaccguaucccccgaauacgucggcucacgcuuacuacuaaaacucaaagagauggcagaggcuuaccucggcaugccggucgccaacgcugucauaagcguccccgcggaguucgaccucaaacaacgcaacuccaccauugaagcagcgaaccuggcaggacuaaaaauccuccggguaauaaacgaacccacagcagcagccauggccuacggacuccauaaagccgacgucuuucacguucuagucaucgacuuaggcggaggcacccucgacgucucccuccucaacaaacagggcggaauguuccuaacacgcgccaugucaggcaacaacaaacucggcggccaggacuucaaccaacgccuacuucaauaccucuacaaacagaucuaccagaccuauggauucguacccucucggaaagaagaaauccaccgccuccgccaagccguagaaaugguuaaacucaaccucacccuacaccagucagcgcaacuauccguccuccucacggucgaagaacaagaccgcaaagaaccccacucaucagacaccgaacuccccaaagacaaacucuccucagccgacgaccaccgcgugaacucaggcuucggccgcggccuauccgacaagaaauccggcgaaucucaaguacucuucgagacagaaauaagccgcaaacucuucgacacccuaaacgaagaccucuuccagaaaauacucguacccauccaacaaguccuaaaagaaggccaccuugagaaaaccgaaaucgacgaagucguucucgucggcggcuccacccgcaucccccguauucgacaagucauacaagaauuuuucggaaaagaucccaacacuagcgucgaccccgaccuugcaguagucacagggguagccauccaagccggaauagacggcggauccuggccccuucaagucuccgcacucgaaauccccaacaaacaccuucagaaaaccaacuucaacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2368 - RNA, 1747 nt, Artificial Sequence
  mRNA product Design1 comprising derived and/or modified sequence from Homo sapiens__NP_057383.2__HsHSPA14 (opt11)
gggagaaagcuuaccauggccgccaucggaguccaccucggcugcacauccgccugcguggccgucuacaaagacggacgcgcaggcguagucgccaacgacgccggagaccgcgucacccccgccguagucgccuacagcgaaaacgaggaaauagucggacucgccgccaaacaaucccgaauacgcaacauauccaacacaguaaugaaagucaaacaaauccucggacgaagcagcagcgacccacaagcccaaaaauacaucgccgaauccaaaugccuugucaucgagaaaaacggaaaacuacgauacgaaaucgacacaggggaagaaaccaaguucgucaacccagaggacgucgcacgccucaucuucagcaaaaugaaggagaccgcacauagcguacuaggguccgacgccaacgacgucguaauaaccgucccauuugacuucggcgaaaaacaaaagaacgcacuaggcgaagccgcccgcgccgcuggcuucaacguccugcgacuaauacacgaaccaucagcagcacuacuagccuacggcaucggacaagacucaccaacaggcaaaucaaacauacucguauucaaacucggaggcacuagccuaucacuauccguaauggaggugaacagcggcaucuaccgcguacucaguaccaacacagaugacaacauaggcggcgcccacuucacagaaacccuagcgcaauaccuagcgucggaauuucaacgcagcuucaaacacgacgucagaggaaacgcccgcgcgaugaugaaacuaaccaacagcgcggaagucgcaaaacacucccucucaacccucggcuccgccaacugcuuccucgacucacucuacgaaggccaggacuucgacugcaacgucucaagagcccgcuucgaacuccugugcuccccacuauuuaacaaauguaucgaagcaauacgcggacuccuagaccaaaacggcuucacagccgacgacaucaacaaagucguccucugcggcggcagcucgcgcauccccaaacuccaacaacuaaucaaagaccucuucccagccgucgaacuacucaacucgaucccacccgaugaaguuauucccauuggagccgccaucgaagccggcauccuaaucggcaaagaaaaccuacugguagaagacucacuaaugaucgaaugcucagcccgcgacauccucgucaaaggagucgacgaaagcggagccucccgauucaccguacuauucccuuccggaacgccgcucccagcccgccgacaacacacccuccaagcccccggcuccaucuccuccgucugccucgaacucuacgaaagugauggcaaaaacucagccaaagaagaaaccaaauucgcgcaaguaguacuacaagaccucgacaagaaagaaaacggacuacgcgacauccuagccguacucaccaugaaacgcgacggaucacuccacguaaccugcacagaccaagaaacaggcaaaugcgaagcuaucuccauagaaaucgccucaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2369 - RNA, 2794 nt, Artificial Sequence
  mRNA product Design1 comprising derived and/or modified sequence from Homo sapiens__NP_006635.2 __HsHSPH1 (opt11)
gggagaaagcuuaccauguccgugguaggacucgacgucgggagccaaagcugcuacauagcgguagccagggcaggcgggauagagacgaucgccaacgaguucuccgaucgcugcacacccagcgucaucagcuuugguucuaaaaacaggacuauaggaguggccgccaaaaaccaacaaauaacccaugcaaacaacaccgucagcaacuucaaacgauuccacggacgugccuucaacgaccccuuuauacaaaaagaaaaagaaaaccuauccuacgaccuagucccccucaagaauggaggcgugggcaucaaaguuauguauaugggagaagaacaccuguucucaguagaacagauaaccgccaugcuacuaacaaaacugaaggaaaccgcagagaacagucugaagaaaccugucaccgacugcguaaucuccguacccuccuucuucaccgacgcagaacggagauccguacuagacgcagcccaaauaguaggccuaaacugccuccgccugaugaacgauaugacggccguagcacucaacuaugggauuuacaaacaagaccucccaagccucgacgaaaaaccccgcauaguagucuucgucgacaugggacacucagcauuccagguaagcgcaugcgccuucaacaaaggaaaacucaaaguccuaggcacggcuuucgaccccuuccuaggcgggaaaaauuucgacgagaaacucgucgaacacuucugcgccgaguucaaaaccaaauacaaacucgacgcaaagagcaaaauccgagcccuccuacgccuauaccaggaaugcgaaaagcuaaagaaacugauguccuccaacuccaccgaccuaccccuaaacaucgaauguuucaugaacgacaaggacgucagcggaaagaugaacagaucccaguucgaggagcucugcgccgagcuacuccaaaagauagaagucccccucuacagccuucucgaacagacccaccucaaaguagaagacguuucagccgucgaaaucgucggcggagcaacacgcauccccgcggucaaagaacgcaucgccaaauucuucgggaaggacauauccaccacccuaaacgcagacgaagcaguggcacgcgggugugcccuccagugcgccauccuaagccccgcauucaaaguacgagaguucucaguaaccgaugccgucccguucccaauaagccugauauggaaccacgacagcgaggacaccgaagguguccacgaagucuucagucgaaaccacgcggccccauucucaaaaguauuaacguuccuccgacgcggacccuucgaacucgaagcauucuacagcgacccgcaaggcguaccguacccugaggcaaagauuggcagguucguaguccagaacgucuccgcacagaaagauggcgagaaaagccgcguaaaggucaaaguccgagucaacacacacggaaucuucaccauuuccaccgccucaaugguagaaaaaguccccacagaagaaaacgagaugagcucugaagccgacauggagugccucaaccaacgcccacccgaaaaccccgacaccgacaagaacguccaacaagacaacagcgaagcaggaacccagccccaaguccaaaccgacgcacaacagaccagccagagcccacccucccccgagcucacaucagaagaaaauaagaucccagacgcagacaaggccaacgaaaagaaagucgaccagcccccggaggccaagaaacccaaaaucaaaguggucaacguagaacuccccaucgaagcaaaccuggucuggcagcuagguaaagacuuacuaaacauguacaucgaaaccgaaggcaaaaugauaaugcaagauaaacucgaaaaagaacgcaacgacgccaaaaacgcagucgaagaauacguauacgaguuccgggacaaacuaugcggcccauacgaaaaauucaucugugaacaagaccaccaaaacuuucuacgucuauuaaccgaaaccgaagacuggcucuacgaagaaggcgaagaccaagcaaaacaggcuuacgucgauaaacuggaagaacuaaugaaaaucggaacgccggucaaagugcgguuccaagaagcagaagaacgucccaaaauguucgaggaacucggacaaagacuccaacacuacgcgaaaaucgccgccgacuuccgcaacaaagacgagaaguacaaccacaucgacgaaucagaaaugaagaaaguagaaaagucggucaacgaaguaauggaauggaugaacaacguaaugaacgcccaagccaaaaagucccucgaccaagacccagucguccgagcacaagaaaucaaaaccaaaauuaaggaacugaacaauaccugcgagcccgucguaacgcaaccgaaaccaaaaauagaaucccccaaacucgaacgaacccccaacgggccgaacaucgacaagaaagaagaagaccucgaggacaaaaacaacuucggagcagaaccaccacaccaaaacggcgaaugcuacccaaacgagaaaaacagcgucaacauggaccucgauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2370 - RNA, 3217 nt, Artificial Sequence
  mRNA product Design1 comprising derived and/or modified sequence from Homo sapiens__NP_006380.1 __HsHYOU1 (opt11)
gggagaaagcuuaccauggcagacaaggucaggcggcaacgaccacggaggcgcguauguugggcgcuagucgcaguccuacuugcggaccuacuggcacuaagcgacacgcuggcaguuauguccguagaccucggaagcgaaucgaugaaagucgcgaucgucaaacccggcgucccaauggaaauaguccuaaacaaggaaagccgcaggaagaccccggugauagugacacucaaagagaacgaacgcuucuucggagacucggccgcgagcauggccauaaagaaccccaaagcaacgcuaagauacuuccaacaccuccucgggaaacaagcagacaacccacacguggcacucuaccaggcaagguucccagaacacgagcugacauucgacccgcaacgccaaacgguacacuuccaaauaucaucacaacugcaauuuucacccgaagaaguccuaggaauggugcucaacuacuccagaucauuagccgaagauuucgccgaacaaccaauaaaagacgcagucauaacaguacccgucuucuucaaccaggcagaacgccgagcaguccuacaagccgcgaggauggcaggccuuaaaguccuccaacugaucaacgacaacaccgcaacagcacugagcuauggcgucuucagacggaaggacauaaacaccaccgcacagaauauaauguuuuacgacaugggaagcggauccacagugugcaccauaguaaccuaccaaauggugaaaacgaaggaggccggcaugcaaccucagcuccaaauccgagggguaggauucgaccggacacucggcgggcuagaaauggaacuacggcuaagagaaagauuagcgggacuguucaacgaacagcgaaaaggacaacgagcgaaagacgucagggaaaacccccgcgcgauggcaaagcuccuucgagaggcaaaccgccugaaaacagugcugucagcgaacgcggaccacauggcucaaauagaaggacucauggacgacgucgacuucaaagcaaagguaacacgagucgaauuugaagaacuaugcgcggaucuauucgaaagagugcccggacccguacagcaagcacugcaguccgccgaaaugucccuagaugaaauagaacaaguuauccuagucggcggcgccaccagaguaccacgagugcaggaaguacuacucaaagccguaggcaaggaggaacuagggaaaaacauaaacgccgacgaagcagcagcgaugggggcaguuuaccaagccgccgcacucagcaaggcauucaaagucaaacccuucgucguacgagacgccgucguauacccgauacugguagaguucacacgcgaaguggaggaggaaccaggaauacauagccugaaacacaacaagcgaguucucuucagccgaaugggccccuacccccaaagaaaagugaucaccuucaaccgguacagccacgacuucaacuuccacauaaacuacggcgaccucggauucuuggggcccgaagaccucaggguauucgggagccaaaaccugacaacagucaaacucaaaggcguaggcgacagcuucaaaaaguacccagauuacgaaaguaaaggcauaaaagcacacuucaaucuugacgaaagcggagugcucucgcucgaccgcguggagagcgucuuugaaacccuaguagaggacagcgccgaagaagaaagcacgcuaacaaagcugggaaacaccauauccucacuauucggagggggaacgacaccagacgcaaaagagaacggaaccgacaccguccaagaagaggaagagagcccagcugaaggguccaaagacgagccaggagaacaaguugaacuuaaagaagaagcggaggccccuguugaggacggaagccaaccgcccccacccgaacccaaaggcgacgccacaccagaaggcgaaaaggcaaccgagaaggaaaacggagacaaauccgaagcccaaaaaccaagcgaaaaagcagaggccggcccagaaggggucgcgcccgcaccggaaggggagaagaagcaaaaacccgcacgaaaacgcagaaugguggaagaaaucggaguagagcuagucguacuagaccuaccagaucugccggaagacaaacuagcacaaucaguucagaaacuucaagacuugacccuacgggaccuggaaaaacaagaaagagaaaaagcagccaacagucucgaagccuucaucuucgagacacaagacaaacuguaccaacccgaguaccaggaaguaagcacagaagaacagagagaagaaaucaguggaaaacugagcgcugcgucaacauggcuagaagacgaagggguaggugcaacaaccgucaugcuuaaagaaaagcucgccgaacugcgcaaacucugccaagggcuauucuuccgaguagaagagaggaagaaauggccagaaaggcuauccgcacuagacaaccuacugaaccacucgagcauguuccuaaagggagcaagacucauaccagagauggaccaaauauucaccgagguggaaaugacaacacucgaaaagguaauaaacgaaacgugggccuggaaaaacgccacacuagcagagcaagccaaacugccagcaacagagaaaccaguacugcuaucaaaggacaucgaagcaaaaaugauggcacuggacagagaggugcaauaccuccucaacaaagcaaaauucacaaaacccagaccacgaccaaaagauaagaacggaacacgcgcagagccaccccuaaaugcuucggcgagcgaucaaggggagaaaguaauacccccagccgggcaaaccgaggacgccgagccgaucuccgaacccgaaaaggucgaaacaggcucagaacccggggauacagaaccacuugaacucggcggacccggagccgagccagaacagaaggaacaaaguacagggcaaaaacgcccccugaaaaacgacgaacuauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2371 - RNA, 2416 nt, Artificial Sequence
  mRNA product Design1 comprising derived and/or modified sequence from Homo sapiens__NP_005339.3 __HsHSP90AA1 (opt11)
gggagaaagcuuaccaugccagaagaaacccaaacacaagaucaaccaauggaagaagaagaaguggaaaccuucgcguuccaggcggaaauagcccaacuaaugucccucaucaucaacaccuucuacagcaacaaggaaaucuuccugcgagaacuuaucagcaacagcagcgacgcccucgauaagaucagauacgaaagccuaacugacccaagcaaacuagauagcgggaaagaacuccacaucaaccuaauacccaacaaacaagaccggacccucacaauaguagacaccggaaucggaaugacaaaggcggaccuuauaaacaaucugggaaccaucgcgaaaagcgggacaaaggcauucauggaagcgcuccaggcaggggcagacauaucaaugaucggccaauucggagucggcuucuacucagcguaccuaguagccgagaaaguaaccgucauaaccaaacacaacgacgaugagcaguacgcgugggagagcagcgcgggaggaucguucacagugagaaccgacacaggggaaccgaugggacgcggaacgaaaguaauacuacaccucaaagaagaccagaccgaauaccucgaagaaaggcgaauaaaagaaauagugaagaaacacucccaguucaucggauacccgauaacacuauucguggagaaagagcgcgacaaagaggucagcgacgacgaagcagaagaaaaagaagacaaagaagaggaaaaggaaaaagaagaaaaagaaagcgaagacaaaccagagaucgaagacgugggaagcgacgaagaagaagaaaagaaagauggagacaagaagaaaaagaagaaaaucaaagagaaauacauagaccaagaagaacuaaacaaaacgaaaccaaucuggacccggaacccagacgacauaaccaaugaagaauacggcgaguucuacaaaucacucacaaacgacugggaagaccaccucgccguaaaacacuucucgguagagggacaacuagaguuccgagcgcuccuguucgugccaaggcgagccccauuugaccuguucgagaauagaaagaagaaaaacaacauaaaacucuacguccgccgggucuucaucauggacaacugugaagaacuaauuccggaauaccugaacuucauccgcggcguaguggacagcgaagaccugccgcucaacaucucgagagaaauguuacaacaaagcaaaauccucaaaguaauaaggaagaaccucgugaagaaaugccuggaauuauucacagaacuagccgaagacaaagaaaacuacaagaaauucuacgagcaauucagcaaaaacauaaaacugggcauccacgaagacagccaaaaccgcaagaaacuauccgagcuccuacgcuacuacaccuccgcauccggggaugagauggugucacuaaaagacuacugcaccagaaugaaagaaaaccaaaaacacaucuacuacaucacgggcgaaacaaaagaccaaguagcgaacucagccuucgucgagcgccuacgaaaacacgggcuagaagucauauacaugaucgaaccaauagacgaauacugcguccaacaacucaaagaguucgaaggaaaaacccucgucagcguuaccaaagaaggcuuggagcuccccgaagacgaagaagagaaaaagaaacaagaagaaaagaaaaccaaauucgaaaaccugugcaaaaucaugaaggacauacuggaaaagaaaguagagaaggucguaguaucaaacaggcucgugaccagccccugcugcauagucacaucuaccuacggauggacggccaacauggaaagaauaaugaaggcccaagcacuccgcgacaacucgacaaugggcuacauggcggccaagaaacaccucgagaucaaccccgaccacuccaucaucgaaacgcucaggcagaaagccgaagcagacaaaaacgauaaauccgugaaggaccucguaauacuccuauaugaaacggcccuucuaagcagcggguucagccucgaagacccgcaaacgcacgcgaacaggaucuaccgaaugaucaaacucggccuugggaucgacgaagacgacccaacagcagacgacacgagcgcggccguaacggaagaaaugccaccacuagaaggcgacgacgacacgagcaggauggaggaaguggacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2372 - RNA, 556 nt, Artificial Sequence
  mRNA product Design1 comprising derived and/or modified sequence from Homo sapiens__NG_005218__HsHSP90AA3P (opt11)
gggagaaagcuuaccauggacagcucaaaacuggacucgggcaagggccugcacauaaaccuggucccgaacaagcaaaaccaaacacucacgaucguggacacgcgcauaggcaugaccaagaccgaccucauaaacaaccucgggaccgugaccaagagcgggaccaaggccuucauggaggcccugcaagcggacgcggacauaagcaugaucggacacuucggcgugggcuucuacucggccuaccucguggccaagaaagugaccgugaucucaaaacacaacaacgacgagcaauacaccugggaaucgagcgcgggcgggagcuucaccgugcgcacggacgaguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2373 - RNA, 2392 nt, Artificial Sequence
  mRNA product Design1 comprising derived and/or modified sequence from Homo sapiens__NP_031381.2__HsHSP90AB1 (opt11)
gggagaaagcuuaccaugcccgaagaagugcaccacggggaagaggaagucgaaaccuucgccuuccaggccgagauagcccaacucaugagcuuaaucauaaacaccuucuacuccaacaaagaaaucuuccucagagaguugauaucaaacgcaagcgacgcccuggacaagauaagauacgaaagccuaacagacccaucaaaacuggacucaggaaaggaguuaaaaauagacaucaucccaaacccacaagaacgcacgcucacccucguggacaccggaauaggaaugacaaaagccgaccucauaaacaaucucggcacgauagccaagagcgggacaaaagccuucauggaggcccuacaagcaggagccgacauaagcaugaucggacaauucggcguaggcuucuacagcgcauaccucgucgccgaaaaggugguaguaaucacaaaacacaacgacgacgaacaauacgccugggaaagcagcgccggcgggagcuucacagucagagcagaccacggcgaaccuauaggacgcgggacuaaaguaauccuccaccuaaaggaagaccaaaccgaauacuuagaagagcgcagggucaaggaagucgucaaaaaacacagccaguucaucggcuaccccauaacccucuaccuggaaaaagagagggaaaaggaaauaagugacgacgaggccgaggaagaaaaaggagaaaaagaagaagaagacaaagacgacgaagaaaagcccaagaucgaagacguaggaagcgacgaagaagacgacucaggaaaggacaagaaaaaaaaaacgaaaaaaaucaaagagaaauacaucgaccaagaagagcugaacaaaacaaaaccaaucuggaccaggaaccccgaugacaucacacaagaagaauacggggaauucuacaaaucgcuaacaaacgacugggaggaccaccucgcgguaaagcacuucagcguggaaggacaacucgaauucagagcacuacuauucaucccaaggagagcgccauucgaccuguucgaaaacaagaaaaaaaaaaacaacauaaagcuauacguccgacgagucuucauaauggacucaugcgacgaacugaucccagaauaccuaaacuucauccggggcguaguagacuccgaagaccucccacucaacaucagccgagaaaugcuacaacagagcaagauacugaaagugaucagaaaaaacaucguaaaaaagugccuagaacuauucagcgaauuagcagaggauaaagaaaacuacaagaaauucuacgaagccuucagcaagaaccuaaaacugggcauacacgaagacagcaccaaucgaaggcgccuaagcgaacuacuaagauaccacacaagucagagcggcgacgagaugacgagccuauccgaauacguuagccggaugaaagaaacgcaaaagucaauauacuacaucaccggagagagcaaggaacaaguagcgaacucggcauucgucgaacgcgugcgaaagcgcggauucgaagucguauacaugacggagcccaucgacgaguacuguguacaacagcucaaagaauucgacggcaaaagccuagucucaguaaccaaagaaggacuagaauugcccgaagacgaagaagagaagaaaaaaauggaagaaucaaaagccaaauucgagaacuugugcaagcugaugaaagagauccuagacaaaaagguagaaaaggucacgaucucaaaccggcuggugagcucgcccugcugcaucgucacgagcacauacggcuggacagcaaacauggaacgaauaaugaaagcacaagcccucagagacaacucaaccaugggguacaugauggccaagaaacaccucgaaauaaaccccgaccacccuauaguagaaacgcucaggcaaaaggccgaagcagacaaaaacgacaaagccguaaaagaccucgugguccugcucuucgaaacagcccuacucucaagcggauuuucacuggaggacccacaaacccacagcaacagaaucuaccgaaugauuaagcucggacuggguauugacgaggacgaaguagccgcggaagagcccaacgcggcaguccccgacgaaaucccgccccuggaaggggacgaggacgcaucaagaauggaagaggucgacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2374 - RNA, 2629 nt, Artificial Sequence
  mRNA product Design1 comprising derived and/or modified sequence from Homo sapiens__NP_003290.1__HsHSP90B1 (opt11)
gggagaaagcuuaccaugagagcccuaugggugcucgggcucugcugcguacuacucacguucggaucaguccgagcagacgacgaggucgacgucgacggaacggucgaagaagaccuaggaaaaagccgcgaaggcagccggacagacgacgaggucguccagcgagaggaagaggcaauacaacucgacggucuaaacgccagccagauacgcgagcuccgggagaaaagugaaaaauucgccuuccaagcagaggucaacagaaugaugaaacucauaauuaacucccuauacaaaaacaaagaaauauuccugcgggaacuaaucuccaacgccagcgacgccuuagacaaaauacgacucaucagccugacagacgaaaacgccuugagcgggaacgaggaacuaaccgugaaaauaaaaugcgacaaagagaagaaccugcuacacguaacggauacgggaguaggcaugacacgagaagaacucgucaaaaaccucggaaccauagccaagagcggcacaagcgaguuccucaacaaaaugacagaagcccaggaggacggccaaucaacgagugagcuuauaggccaauucgggguaggguucuacagcgcguuccuaguagcggacaaaguaauagucacaagcaaacacaauaacgauacacagcacauaugggaaucagacagcaacgaauuuagcgugaucgcggacccgcggggaaacacgcuuggcagaggaaccaccaucacucuaguacucaaggaagaggcuucagacuaucuagaacuggacacaaucaaaaaccucguaaagaaauacagccaauucauaaacuucccgauauacgucuggagcucgaaaacagaaacaguagaggagccgauggaggaggaagaggcagccaaagaagaaaaagaagaaucggacgacgaagcggcagucgaagaagaagaggaagagaaaaagcccaaaaccaagaaaguagagaaaaccguaugggacugggaacucaugaacgacauaaaacccauauggcagcgcccgagcaaagaagucgaggaagacgaauacaaagccuucuacaagagcuucagcaaagaaagcgacgacccgauggccuauauacacuucacagccgaaggagaggugacguucaaaagcauccucuucgucccgacgagcgcccccaggggacucuucgacgaauacgggaguaagaaaagcgacuacaucaaacuauacguccgacggguguucauaaccgacgacuuccacgacaugaugcccaaguaccugaacuucgucaaaggagugguagauucagaugaccugccacucaacguaagcagagagacgcuccaacagcacaaacugcucaagguaauacgcaagaagcuagucaggaaaacgcucgacaugaucaaaaagauugcggacgauaaguacaacgacacguucuggaaggaguucggaacgaacauaaaacuaggcguaaucgaagaccacagcaaccgaacaagacucgcaaaacuccucagauuccagagcagccaucaccccacagacauaacaagccuggaccaauauguggaacgaaugaaagaaaaacaggacaaaaucuacuucauggcgggauccagccgcaaagaggcagaaagcagccccuucguagaacgacuccuaaagaaaggcuacgaagucaucuacuugaccgaaccaguagacgaauacugcauccaggcccuucccgaguucgacggcaagagauuccaaaacgucgcgaaggaaggcguaaaauucgacgaaagcgagaagacgaaagaaucgagggaagcagucgagaaagaguucgaaccacugcucaacuggaugaaagacaaagcgcuaaaagacaagauagaaaaagcgguaguaucgcaacggcugaccgaaagcccaugcgcccuagucgcgagccaauacggcuggagcgggaacauggaaagaauuaugaaagcgcaagccuaccagacaggaaaggacaucagcaccaacuacuacgccagccaaaagaagacguucgaaaucaacccaagacacccgcuaauaagagacaugcuacgaaggaucaaggaagacgaggacgacaagaccgugcucgaccucgcggucgugcuauucgaaacggccacgcuuagaagcggauaccugcuacccgacacgaaagccuacggcgaccgaaucgaacgcaugcuaaggcucagucuaaacauagaccccgacgcgaaaguggaagaggaaccagaggaggaaccagaagaaacggcagaggacaccaccgaggacacagaacaggacgaggacgaggagauggacgucggaacggacgaagaggaagaaaccgcaaaggaaucgaccgcagaaaaggacgagcuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2375 - RNA, 2332 nt, Artificial Sequence
  mRNA product Design1 comprising derived and/or modified sequence from Homo sapiens__NP_057376.2__HsTRAP1 (opt11)
gggagaaagcuuaccauggcccgcgaauuacgagcccuacuacuauggggucgccgacuccgcccacuacuccgagcccccgcacucgccgcagucccuggaggaaaacccauacucugcccccgaagaacaacagcucaacucggcccccgucgcaacccagccuggucgcuccaggccggccgacucuucuccacacaaaccgccgaagacaaagaagaaccccuccacagcauaaucagcagcaccgaguccguacaaggaagcaccuccaaacacgaguuccaggccgaaaccaagaaacuucucgacaucguagcccgaagucuauacuccgaaaaagaagucuucauccgagaacuuaucucuaacgcauccgacgcacucgaaaaacuacgacacaaacucguaucagacggucaagcacuacccgaaauggaaauacaucuacaaaccaacgcagaaaaagguaccauaacaauucaagacacgggaauaggaaugacgcaggaggaacucgucucaaaccuaggcacuauagcccgaagcggcagcaaagccuuccucgacgcccuccaaaaccaagccgaagccuccuccaaaaucaucggucaguucggcguaggcuucuauuccgccuucaugguagcagaccgagucgaaguauauucucgcucagcagcccccggcucccuaggcuaccaauggcuauccgacggcagcggcguguucgaaauagcagaagccucgggcguccguacaggcaccaaaaucaucauacaccuaaaaagcgacugcaaagaauuuagcucagaagcccgcguccgagacgucgucaccaaauauucaaauuucgucucauuuccacucuaucuaaacggcagacgcaugaacacgcuccaagccaucuggaugauggacccaaaagacguccgcgaauggcagcaugaagaguucuaccgcuacguagcacaagcgcacgacaaaccacgcuacacccuccacuacaaaacggacgccccacuaaacauccgcuccaucuucuacguaccggacaugaaacccagcauguucgacguaucccgcgaacucggcucaucgguagcacucuacucuaggaaaguccucauacaaacaaaagccaccgacauccuaccaaaauggcuucgauucaucagaggcgucgucgacagugaagacaucccccucaaccucucacgagaacuccuacaagaauccgccuuaauccgaaaacuccgcgacguacuucaacagcgucucauaaaauucuucaucgaucaauccaagaaagaugcagaaaaauacgccaaauucuucgaagacuacggccucuucaugcgggaaggcaucguaacagcaaccgagcaagaggucaaagaggacauagcaaaacuccucagauacgaguccagcgcccuucccucgggccaacuaacuagccuaagcgaauacgccucacguaugagagcaggcacccgcaacaucuacuaccucugcgccccaaaccgacaccucgcagaacacucacccuacuacgaggccaugaaaaagaaagacaccgaaguccuguucugcuuugaacaauucgacgaacugacccuacuacaccucagagaguucgacaaaaagaaacucaucagcgucgagacggacaucgucguagaccacuacaaagaagaaaaauucgaggaccgcagcccagccgcagaaugccuaucggaaaaagaaaccgaagaacucauggccuggaugcggaacguccuaggcuccagaguaaccaacguaaaagucacacucagacuagacacccaccccgccauggucaccguacuagaaaugggagcugcccgacacuuccuacgaaugcaacaacuagcaaaaacacaggaggaacgcgcccaacuccuucaaccaacccucgaaauaaacccccgacacgcccuaauaaagaaacuaaaucaacugagggccuccgagcccggacucgcccaacuucuagucgaccagaucuacgaaaacgccaugaucgcggcaggccuaguagacgacccccgcgccauggugggacgacuaaaugaacuacuugucaaagcacuagagcgacauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2376 - RNA, 679 nt, Artificial Sequence
  mRNA product Design1 comprising derived and/or modified sequence from Homo sapiens__NP_000609.1__HsIGF1 (opt11)
gggagaaagcuuaccaugggcaaaaucuccucccuccccacccaacucuucaaaugcugcuucugcgacuuccuaaaagucaaaaugcacaccauguccuccucccaccucuucuaccuagcccucugccuccuuaccuucaccuccuccgccaccgccggccccgaaacccucugcggcgccgaacucgucgacgcccuccaauuugucugcggcgaccgcggauucuacuucaacaaacccaccggcuacggcuccuccucccgccgcgcaccccaaaccggcaucgucgacgaaugcugcuuccgcuccugcgaccuccgccgccucgaaauguacugcgcaccccucaaacccgccaaauccgcccgcuccguccgcgcccaacgccacaccgacaugcccaaaacccaaaaagaaguccaccucaaaaacgccucccgcggcuccgccggcaacaaaaacuaccgcauguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2377 - RNA, 760 nt, Artificial Sequence
  mRNA product Design1 comprising derived and/or modified sequence from Homo sapiens__NP_000603.1__HsIGF2 (opt11)
gggagaaagcuuaccaugggcauccccaugggcaaauccaugcucguccuccuaaccuuccucgccuucgccuccugcugcaucgccgccuaccgacccuccgaaacacucugcggcggcgaacucgucgacacccuccaauucgucugcggcgaccgcggcuucuacuucucccgccccgccucccgcgucucacgccgcucccgcggcaucgucgaagaaugcugcuuccgcucuugcgaccucgcccuccucgaaaccuacugcgccacccccgcaaaauccgaacgcgacgucuccaccccccccacaguacuccccgacaacuucccccguuaccccgucggcaaauucuuccaauacgacaccuggaaacaauccacccaacgccuccgccgcggacuacccgcccuacuccgcgcccgccgcggccacguccuagcaaaagaacucgaagccuuccgagaagccaaacgccaccgcccccucaucgcccuccccacccaagaccccgcccacggaggcgccccccccgaaauggccuccaaccgcaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2378 - RNA, 856 nt, Artificial Sequence
  mRNA product Design1 comprising derived and/or modified sequence from Homo sapiens__NP_000591.1__HsIL6 (opt11)
gggagaaagcuuaccaugaacuccuucuccaccuccgccuucggccccgucgccuucucccucggccuccuacucguacuccccgccgccuucccagcccccguccccccaggcgaagacuccaaagacgucgccgccccccaccgccaaccucucaccucauccgaacgcaucgacaaacaaauacgcuacauccucgacggcaucuccgcccuccgcaaagaaaccugcaacaaaucaaacaugugcgaauccucaaaagaagcccucgccgaaaacaaccuaaaccuccccaaaauggccgaaaaagacggcugcuuccaauccggcuucaacgaagaaacaugccucgucaaaauaaucaccggacuccucgaauucgaagucuaccucgaauaccuacaaaaccgcuucgaaucauccgaagaacaagcccgcgccguccaaaugucaaccaaaguccucauccaauuccuccaaaaaaaagccaaaaaccucgacgccaucacaacccccgaccccaccaccaacgccucccuacucaccaaacuccaagcccaaaaccaauggcuccaagacaugaccacccaccucauccuccgcuccuucaaagaauuccuccaauccucccuccgcgcccuccgacaaauguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2379 - RNA, 1498 nt, Artificial Sequence
  mRNA product Design1 comprising derived and/or modified sequence from Homo sapiens__NP_002183.1__HsINHBA (opt11)
gggagaaagcuuaccaugccacuccuguggcuccgcggauuccuccuagcaagcugcuggauaauaguacgaagcuccccaacaccaggcagcgagggccacagcgccgcacccgacugcccauccugcgcacucgccgcccucccaaaagacgucccgaacagccaacccgaaauggucgaagcggucaagaaacacauacucaacaugcuacaccuaaagaaacgcccagacguaacacagccaguccccaaagccgcacuacuaaacgcgauccgaaaacuacacguaggcaaagugggagaaaauggcuacgucgaaaucgaagacgacauaggcagacgagcagaaaugaacgaacuaauggaacaaacaagugaaauaaucacauucgccgagagcggcacagcccggaaaacccuacacuucgaaaucucaaaagaaggauccgaccucagcgucguagaacgagccgaaguguggcuauuccucaaaguccccaaagccaacagaaccagaaccaaagucacaaucagacucuuccaacagcaaaaacacccgcaaggaagccucgacacaggcgaagaagcagaggaagucggacucaaaggugaacgcagcgaacuccuccuguccgaaaaagucgucgacgcccgaaaaagcacauggcacguauucccaguaagcagcuccauccaacgccugcuagaccaagggaaaucaagccuggacguccgcauagcaugcgaacaaugccaagaaagcggcgcaagccuaguacuacuagggaaaaagaaaaagaaagaggaagaaggagaaggaaagaagaaaggaggcggagaagguggagcaggcgccgacgaagaaaaagaacaaagccaccggccauuccucaugcuacaagccagacaaagcgaagaccacccacaccgacgacgccgacgaggccucgaaugcgacggaaaagucaauauaugcugcaagaaacaauucuucgucagcuucaaagacauaggguggaacgacuggaucauagccccaagcggcuaccacgccaacuacugcgaaggagaaugcccaagccacaucgccggaacauccgggagcagccugagcuuccacagcacgguaauaaaccacuaccgcaugcgcggccacagcccauucgccaaccucaaaagcugcugcguacccaccaaacuacgcccaauguccaugcucuacuacgacgacgggcagaacaucauaaagaaagacauacagaacaugaucgucgaagagugcggcugcuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2380 - RNA, 1441 nt, Artificial Sequence
  mRNA product Design1 comprising derived and/or modified sequence from Homo sapiens__NP_002184.2__HsINHBB (opt11)
gggagaaagcuuaccauggacggccuaccaggacgagcccucggcgccgcaugccuccuucuccucgccgccggaugguuaggccccgaagcauggggcucacccaccccaccacccaccccagccgcacccccacccccacccccaccaggauccccaggaggcagccaagacacaugcaccucgugcggaggcuucagacgcccugaagaacuaggccgagucgacggcgacuuccucgaagccgugaaacgccauauacucucccgacuccaaaugcgcggccgacccaacauaacccacgccguacccaaagcagcuaugguaaccgcccuccgcaaacuccaugccggcaaaguccgagaagacggccgagucgaaaucccccaccucgacggacacgccucccccggcgccgacggccaagaacgaguaucagaaaucaucuccuucgcugaaaccgacggccuggcauccucccgaguccgccucuacuucuuuauauccaacgaagguaaccaaaaccucuucgucguccaagccucacuauggcucuaccuaaaacuacuccccuacguacucgaaaaaggcagccgccgcaaaguccgcguaaaagucuauuuccaagaacaaggccacggcgaccgcuggaacaugguagaaaaacgugucgaccucaaaagaucaggcuggcacaccuucccccuaaccgaagcuauccaagcacucuucgaacgaggagaacgaagacucaaccucgacguacaaugcgacucuugccaagaacucgcgguagucccaguauucgucgaccccggcgaagaaucccacagacccuuuguaguaguacaagcgcgacucggcgacucucgacaccgaauccgcaaacgcggccuagaaugcgacggacgcacaaaccucugcugccgccaacaauucuucauagacuuccgccuaaucggcuggaacgacuggaucauagcccccaccggcuacuacggcaauuacugcgaaggcucaugccccgcauaccucgccggcguccccggcucagcauccucuuuccacaccgccgucguaaaccaauacaggaugcgcggacuuaacccaggaacagucaauuccugcugcauacccaccaaacucagcaccauguccaugcucuacuucgacgacgaauacaacaucgucaaacgcgacguccccaacaugaucgucgaagaaugcggaugcgcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2381 - RNA, 3676 nt, Artificial Sequence
  mRNA product Design1 comprising derived and/or modified sequence from Homo sapiens__NP_000623.2__HsITGAM (opt11)
gggagaaagcuuaccauggcccuccguguuuuacugcucacagcacucacacugugucacggauucaaccuagacaccgaaaaugcaaugaccuuccaagaaaacgcacgcggcuucggacaaucgguaguccaacuacaagguucgcgcguagucgucggcgccccucaagagauagucgcugcaaaccaacgaggcucacucuaccaaugcgacuacucaaccgggucaugcgaaccaaucagacuccaagucccagucgaagcagucaacaugagccugggucucagccucgccgccacaaccucacccccacaacucuuagcaugcggaccaaccguccaucagaccugcucggaaaacaccuacguaaaaggccuaugcuuucucuuuggguccaaccuacgacagcagccccaaaaauuccccgaagcccuccgaggauguccgcaagaagacagcgacauagccuuucucauugacggcuccggauccauaauaccacacgacuuccgccggaugaaggaauuugucucaacaguuauggaacaacucaagaaauccaaaacacucuucucccugaugcaauacagcgaggaguucagaauccacuucaccuucaaagaguuccagaacaaccccaacccccgcucacugguaaaaccaauaacucaacuccucggcaggacacacacggccacgggcaucaggaaggucgugcgcgaacucuucaacauaacaaauggugcacgcaaaaacgccuucaaaauccuuguggucauaaccgacggcgaaaaauucggggacccauuaggauacgaagacguaauccccgaagcggacagagagggaguaauccgauacgucaucggcguuggggacgccuuccguagcgaaaaaucccgccaggaacucaacacaauugccuccaaaccgccccgagaccacgucuuccaagucaacaacuucgaagcccucaaaaccauccaaaaccaacuccgagagaaaauauucgccauagaaggaacccaaaccggcagcuccagcuccuucgaacaugaaaugucccaagaaggcuucagcgccgcgaucaccuccaacggcccucuacucucuaccgucggaucauacgacugggcuggcggcgucuuccuuuacaccuccaaggaaaaaucgacauucaucaacaugaccagagucgauucugacaugaacgacgcauaucucggcuacgccgcugcuaucauucuacgcaacagagugcaaucucuaguauuaggagccccucguuaccaacacaucggccuaguggcaauguuccgucaaaacaccgggaugugggaaagcaacgcgaacgucaagggcacccaaaucggcgcauacuucggagcuucucucugcucuguggacgucgacucaaacggaagcacugaucucguucuuaucggagcaccccacuacuaugagcagacucgaggaggccaaguaucagucuguccacucccccguggccgagcccgcuggcaaugcgacgcgguucuauauggcgaacaaggucaacccuggggcagguucggugccgcgcucaccguccuuggagacgucaacggcgacaaacucaccgacguagcaaucggcgcaccuggcgaggaagacaaccgcggcgcaguguaccucuuccacggcaccuccggcagcggcaucucacccucccacucacaacgcauagccggcucuaaacugucccccagacugcaauacuucgggcaaagccuauccgguggacaagaccucacgauggacggccuaguagaucugacgguuggcgcgcaagggcauguacuucuacuacgaucccaaccaguacuacgugucaaggcaaucauggaguucaauccacgggaagucgcacgaaacgucuucgaaugcaacgaccaaguugucaagggcaaagaagccggcgaagucagagugugucugcacguacaaaagagcacacgugaucgacugcgagaaggacaaauccaguccguggucaccuacgaccuagcccuagacuccggaagaccccacagccgugccgucuucaacgaaaccaaaaauucaacccgccggcaaacccaggugcuaggccuuacccaaacuugcgagacgcucaaacuacaacugcccaacuguaucgaagacccagucucaccaaucguacuacgccuuaauuuuucccuagucggcacaccccucucagcauucggaaaccuccgacccguccucgccgaagacgcccaacgacuuuucaccgcccuauuccccuucgaaaagaacugcggcaacgacaacauaugucaagacgaccucagcaucaccuucucuuucaugucgcucgacugccuagugguaggcggaccccgagaauuuaacgucacagucaccguaagaaacgacggagaggauuccuacagaacgcaaguuacauucuucuucccgcucgaccucucguaccgcaaagucucgacccuucaaaaccaacgaucucaacgaucuuggaggcucgcaugugaaucagccucgucaacagaaguaaguggcgcccucaaaucgaccuccuguuccauaaaccacccaaucuuccccgagaacagcgaagucacauucaacauaacauucgacguugacucuaaagcaucacucggcaacaaacucuuacugaaagccaacgucaccagcgaaaacaacaugccaagaacaaacaaaacagaguuccaacucgaacucccagucaaguaugccguauacauggucgucaccagccacggaguauccacaaaauaccucaacuuuaccgccagcgaaaacacguccagaguaaugcaacaccaauaccagguauccaaccuuggucaacgcagucuacccaucucccuaguguuccucguucccgucagacuaaaccagacaguaauaugggaccguccacaaguaacauucucugaaaaccucuccuccacaugucacacuaaagaacgacucccuagccauuccgacuuucuugcagagcuucgcaaagccccuguugugaacugcucaaucgcgguaugccagcgcauacagugcgacauaccauucuuugggauacaggaagaguucaacgcgacucucaaagguaaccucagcuucgacugguauaucaagaccucacauaaccaccuccuaauaguauccacagccgaaauccucuucaacgacagcgucuucacauugcugcccggccaaggagcuuucguacgaucgcagacagaaacuaaaguagaaccuuucgaagucccgaacccgcucccgcuaaucgucggauccuccguuggcgggcuacuccuucuugcccucaucacagcagcacuguauaagcucggcuucuucaagcgccaauacaaagauaugauguccgaaggcggcccgcccggggccgaaccccaguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2382 - RNA, 1621 nt, Artificial Sequence
  mRNA product Design1 comprising derived and/or modified sequence from Homo sapiens__NP_002415.1__HsMMP8 (opt11)
gggagaaagcuuaccauguucucccucaaaaccuuaccguuccuccuacuacuacacguccaaaucuccaaagccuucccugucuccagcaaagagaaaaacacuaaaaccguacaggacuaccucgaaaaauucuaccaacuacccucaaaccaguaccaguccacccgcaaaaacggcacaaacgugaucgucgaaaagcuaaaagaaaugcaacgcuucuucggccuaaacgucacaggcaaacccaacgaagaaacccucgacaugaugaagaaaccccgaugcggcguccccgacuccggcggcuucaugcucacacccgguaaccccaaaugggaacgaaccaaccuaaccuaccgcauacgaaacuacacaccccaacucucagaagccgaagucgaacgagcuaucaaagacgcauuugaacucugguccgucgcaucaccccucaucuucacccgcaucucucaaggcgaagccgacauaaauaucgccuucuaucaaagagaccacggcgacaacucccccuucgacggcccgaacgguauccucgcacacgccuuccaaccaggccaaggaaucggcggcgaugcccacuucgacgcagaagaaaccuggacaaacaccucagccaacuacaaccucuuccucgucgccgcgcacgaguucggacauucccucggccuagcccacuccuccgaccccggugcacucauguacccaaacuacgccuuccgcgaaaccagcaacuacucacucccccaagacgacauagacggcauccaagccauauacggacuaucauccaaccccauccagccaaccggacccucaacccccaaacccugcgauccaucccucaccuucgacgccaucaccacccuacguggagagauccucuucuucaaagaucgauauuucuggcgccgacacccccaacugcaacggguugaaaugaacuucaucagccucuucuggccuucacuacccaccggaauccaagccgccuaugaagacuuugaccgcgaccucaucuuccucuucaaaggaaaccaauacugggcccucucggguuacgacauccuucaaggcuacccuaaagacauaucaaacuacggauucccaucguccguccaagccaucgaugccgcaguuuucuaccgcuccaaaaccuacuucuucgucaacgaccaauucuggcgcuaugacaaccaacgccaauucauggaaccaggauaccccaaauccaucuccggcgccuuccccggcaucgaaagcaaagucgacgcagucuuccaacaagaacacuucuuccacguuuucucaggcccucgcuacuacgccuucgaccuaaucgcccaacgagucacccgagucgcccgaggaaacaaauggcuuaacugccgcuacggauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2383 - RNA, 2341 nt, Artificial Sequence
  mRNA product Design1 comprising derived and/or modified sequence from Homo sapiens__NP_004985.2__HsMMP9 (opt11)
gggagaaagcuuaccaugucccucuggcaaccucucguauuaguacuccuaguccuuggaugcugcuuugccgcuccucgacaacgccaauccacacucguccuuuucccaggggaucuaagaaccaaccuuaccgaccggcaacuagcagaggaauaccuauaccgcuauggauacacaagagucgccgaaaugagaggagaaucgaaaagccucggaccagcccuccuacuacuacaaaaacaacucucccugcccgaaacuggcgaacucgacucugccacucuaaaagcaaugaggaccccacgaugcggcguccccgaccuaggcagauuccaaaccuucgaaggcgaucuaaaauggcaccaccacaacauaaccuacuggauccaaaacuacucagaagaccucccccgagccguaauagacgaugccuucgcaagagcuuucgcccucuggucggcagucacuccccucaccuuuaccagaguauacucccgagacgccgacauagucauccaauucggcgucgccgaacacggcgacggcuaccccuucgacggaaaagauggacuccucgcucacgcguucccaccaggcccagguauccaaggcgaugcucacuucgacgacgacgaacuauggucucucggaaaaggggucgucguccccacccgauucggaaacgcagacggcgccgcuugccacuuccccuucaucuucgaaggacguuccuacagcgccugcacgaccgacggaagauccgauggacuaccauggugcucaacgaccgccaacuacgacacagacgacagauucggauucugucccucagaacgucucuacacacaagacggcaacgccgauggcaaacccugccaauuccccuucauauuccaaggccaauccuacuccgccugcacaaccgacggacgcucugacggcuaccgauggugcgcuacaacagcaaacuaugaucgagacaaguuauuuggauucugccccacccgcgccgauuccaccguaaugggugggaacuccgcaggagaacucugcgucuuccccuucaccuuccucggaaaagaguacagcacaugcaccuccgaaggccgaggcgacggccgccuauggugcgccaccaccuccaacuuugacucagacaagaaaugggguuucugccccgaccaagguuacagccucuuccucgucgccgcacaugaauuuggacacgcauuaggccuagaccacucgucaguccccgaagcccucauguaccccauguacagauucacugaaggcccaccccuccacaaagacgacgucaacggaauccgccaucucuacggcccccgaccagaaccugaaccacgcccacccacaaccaccacaccccaacccaccgccccacccacugucugccccaccggcccacccaccguccaucccagcgagagacccaccgcgggcccaaccggcccacccuccgcaggccccacuggacccccaaccgcaggacccuccaccgcuacuaccguuccacuauccccagucgacgacgcuugcaacgucaacaucuucgacgccauagcugagauaggaaaccagcucuaccuauucaaagacggaaaauacuggcgauucuccgagggacgcggcucccgcccccaaggaccauuucuaauagcagacaaguggcccgcacucccacgcaaacuugacuccguuuucgaggaaagacucuccaagaaacuauucuucuuuuccggccgacaagucuggguuuacacaggcgccuccguacucgguccucgccgccuugacaaacuagggcucggcgcagacgucgcccagguaacaggagcucuccgaagcggaaggggcaaaauguuacucuucuccggccgucgacucuggcgauucgacguaaaagcccaaaugguagaucccagaagcgccagcgaagucgaccgcauguucccaggagucccccuugauacccacgacgucuuccaauaccgcgaaaaagccuacuuuugccaagaccgcuucuacuggcgcgucucuagcagaucagaacuuaaccaaguagaccaaguaggcuacgucaccuacgacauccuacagugcccagaagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2384 - RNA, 1633 nt, Artificial Sequence
  mRNA product Design1 comprising derived and/or modified sequence from Homo sapiens__NP_002418.1__HsMMP13 (opt11)
gggagaaagcuuaccaugcaccccggcguacucgcagccuuccuauuccuauccuggacccacugccgcgcauuaccccuccccucaggaggcgaugaagacgaccuuuccgaagaagaccugcaauucgccgaacgcuaccuccgauccuacuaccaccccaccaaccucgccggcauacucaaagaaaacgcagccucauccaugacagaacgccuccgcgaaaugcaauccuucuuuggccucgaagucaccggaaaacuugacgacaacacgcuagacgucaugaaaaaacccagaugcggaguccccgacgucggcgaauacaacgucuuccccagaacccuaaaauggucaaaaaugaaccucaccuacagaauagucaacuacaccccugacaugacccacuccgaaguagaaaaagccuucaaaaaagccuucaaagucuggucugacguuaccccccucaacuucacccgacuccacgacggcaucgccgacauaaugaucuccuucggaaucaaagaacacggcgacuucuaccccuucgacggaccaucaggccuacucgcccacgccuucccaccaggacccaacuacggaggcgacgcccacuucgaugacgacgaaaccuggaccuccuccuccaaaggcuacaaccucuuccuaguagccgcacacgaauucggccacucacuaggacuagaccacuccaaagaccccggcgcucuuauguuccccaucuacaccuacacugggaaaucccacuucaugcuccccgacgacgacguacaaggcauccaaagccucuacggcccgggcgacgaagaucccaaccccaaacaccccaaaacaccagacaaaugcgaccccucacuaucacuagacgcaaucaccucccuccguggcgaaacuaugaucuucaaagaccgauucuucuggcgcuuacacccccaacaagucgacgccgaacucuuccuuaccaaaucauucuggcccgaacuccccaaccgcaucgacgccgccuacgaacaccccagccaugaccucaucuuuaucuuccgcgggagaaaauucugggcacuaaacggauacgacauacucgaaggcuacccaaaaaaaaucuccgaacuaggccucccaaaggaagucaaaaagaucuccgcagcaguacacuucgaagacaccggcaaaacccuccuauucucagguaaccaaguauggcgcuacgacgacaccaaccacaucauggacaaagacuacccccgccucaucgaagaagacuuccccggcauaggcgacaaagucgacgccgucuaugaaaaaaacggcuacauauacuucuuuaacggccccauccaauuugaauacuccauaugguccaaccgcaucguacgcguuaugccagccaacuccauccucuggugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2385 - RNA, 1285 nt, Artificial Sequence
  mRNA product Design1 comprising derived and/or modified sequence from Homo sapiens__NP_001286.1__HsCCR1 (opt11)
gggagaaagcuuaccauggaaaccccgaacaccaccgaagauuacgacaccacaaccgaguucgacuacggcgacgccacccccugccaaaaagucaacgaacgcgccuucggcgcccaacuccucccaccccuuuacucccucgucuucgucaucggccucgucggcaauauccucguaguccucguccucguccaauacaaacgacucaaaaacaugaccuccaucuaccuacucaaccuugccaucuccgaccuccucuuccucuucacccuccccuucuggauagacuacaaacucaaagacgacugggucuucggcgacgccaugugcaaaauccucucgggcuucuacuacacaggacucuacuccgaaaucuucuucaucauccuccuaacuaucgaccgcuaccuagccaucguccacgccgucuucgcacuacgcgcccgcaccguaaccuucggcgucaucaccucaaucaucaucugggcccucgccauccucgccuccaugcccggccucuacuucucaaaaacccaaugggaguucacacaccacacaugcucacuccacuucccccacgaaucccuacgcgaauggaaacucuuccaagcccucaaacucaaccuauucggccuaguccucccacuacucgucaugaucaucugcuacacaggcaucaucaaaauacuccuccgccgccccaacgaaaagaaauccaaagcaguccgccucaucuuugucauaaugauaaucuucuuccuauucuggacccccuacaaccucaccauccucaucucaguauuccaagacuuccucuucacccaugaaugcgaacaaucacgccacuuagaccucgccguccaagucaccgaggucauugccuacacccacugcugcgucaacccaguaaucuacgccuucgucggcgaacgcuuccgcaaauaccuccgucaacuauuccaccgacgcgucgccguacaccucgucaaauggcuccccuuccuaucugucgaccgacuagaacgcgucuccuccacaagcccaagcaccggcgaacacgaacucuccgccggcuucuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2386 - RNA, 853 nt, Artificial Sequence
  mRNA product Design1 comprising derived and/or modified sequence from Homo sapiens__NP_002598.4__HsPDGFA (opt11)
gggagaaagcuuaccaugcgcacacucgccugccuccuacuccucggcugcggcuaccucgcacacguccucgccgaagaagccgaaaucccccgagaagucaucgaacgacucgcccgcucccaaauccacuccauccgcgaccuccaacgccuccucgaaaucgacuccgucggcuccgaagacucccucgacaccucacuccgcgcccacggaguccacgccaccaaacacguacccgaaaaacgaccccuccccauccgccgaaaacgcuccauagaagaagccguccccgccgucugcaaaacccgcaccgucaucuacgaaaucccccgcucccaagucgaccccacauccgccaacuuccucaucuggccccccugcguagaagucaaacgcugcaccggcugcugcaacacauccuccguaaaaugccaacccucccgcguacaccaccgcuccgucaaagucgccaaagucgaauacguccgcaaaaaacccaaacuaaaagaaguccagguccgccucgaagaacaccucgaaugcgccugcgccaccaccucccucaacccagacuaccgcgaagaagacaccggccgcccccgcgaauccggcaaaaaacgcaaacgcaaacgccugaaacccaccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2387 - RNA, 943 nt, Artificial Sequence
  mRNA product Design1 comprising derived and/or modified sequence from Homo sapiens__NP_002599.1__HsPDGFB (opt11)
gggagaaagcuuaccaugaaccgaugcugggcccucuuccucagccucugcugcuaccuacgacuuguaucagccgaaggcgacccaaucccagaagaacuauacgaaaugcuguccgaccacuccauccgcuccuucgacgaccuccaacgccuccuccacggugaccccggcgaagaagacggcgccgaacuagaccuuaauaugacccgcucccacuccggcggagaacucgaaucacucgcccgcggacgccgcucccuaggcucccucaccaucgccgaaccagccaugaucgccgaaugcaaaacacgcaccgaaguauucgaaaucucacgccgacucaucgaccgcaccaacgccaacuuccuugucuggcccccaugcgucgaaguccaacgcugcuccggcugcugcaacaaccgcaacguacaaugccgacccacacaaguacaacuccgcccaguccaaguacgcaaaaucgaaaucguccgcaaaaaaccaaucuucaaaaaagccacagucacccucgaagaccaccucgccugcaaaugcgaaaccguagccgccgcacgccccgucacccgcucacccggcggaucacaagaacaacgugcaaaaaccccccaaacccgcgucacaauccgcaccguccgcguccgccgcccccccaaaggaaaacaccgcaaauucaaacacacacacgacaaaaccgcccucaaagaaacccuaggcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2388 - RNA, 1255 nt, Artificial Sequence
  mRNA product Design1 comprising derived and/or modified sequence from Homo sapiens__NP_057289.1__HsPDGFC (opt11)
gggagaaagcuuaccaugagccucuucggccuccuccuccucaccuccgcccuggccggccagcgccaaggcacccaggccgaauccaaccucuccuccaaauuccaauucuccuccaacaaagaacaaaacggcguccaagacccccaacacgaacgaaucaucaccgucucaacaaacggcucaauacacucaccacgcuucccccacaccuacccaagaaacaccguccucgucuggcgccuagucgccgucgaagaaaacguauggauccaacucaccuucgacgaacgcuucggccucgaagacccagaagacgacaucugcaaauacgacuucguagaagucgaagaaccuagcgacggcaccauacucggacguuggugcggcuccggcaccguccccggcaaacaaaucuccaaaggcaaccaaauccgaauacgcuucguauccgacgaauacuucccauccgaacccggcuucugcauccacuacaacaucgucaugccccaauucaccgaagccgucucccccuccguacuaccccccuccgcccucccccucgaucuucucaacaacgccaucacggccuucuccacccucgaagaccuaauacgcuaccuggaacccgaaagauggcaacucgaucucgaagaucuauaccgccccacauggcaacuccucggcaaagccuucgucuucggcagaaaaucccgggucguagaccucaaccuccucaccgaagaaguacgccuauacuccugcacaccacgcaacuucuccguauccauccgagaagaacucaaacgcaccgacacuaucuucuggcccggcugccuccucgucaaaagaugcggcggaaacugcgccugcugucuccacaacugcaacgaaugccaaugcguccccuccaaaguaaccaaaaaauaccacgaaguccuacaacuucgcccaaaaaccggcguaagaggccuccacaaaucccucaccgacgucgcacuagaacaccacgaagaaugcgacugcgucugccgcggcuccaccggaggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2389 - RNA, 1312 nt, Artificial Sequence
  mRNA product Design1 comprising derived and/or modified sequence from Homo sapiens__NP_149126.1__HsPDGFD (opt11)
gggagaaagcuuaccaugcaccgccuaaucuucgucuacacccuaaucugcgccaacuucugcuccugccgagacaccuccgccaccccacaauccgccuccauaaaagcacuccggaaugccaacuuacgccgggacgaccuauaccgucgagacgaaacaauccaaguaaaaggaaacggcuacgugcaaucgccccgauucccaaacuccuacccacgcaaccuccuccucaccuggcgacuacacucccaagaaaacacucgcauccaacucgucuucgacaaccaguucggccuggaagaagccgaaaacgacaucugccgcuacgacuucgucgaagucgaagacauaucagaaaccuccaccaucauacgcggccgcuggugcggccacaaagagguacccccccgcaucaaaucccgcacaaaccaaaucaaaauaaccuucaaaucagacgacuacuucguagcuaaacccggauucaaaaucuacuacucccuccuagaagacuuccaacccgccgcagcauccgagaccaacugggaauccguaaccuccuccauauccggcguauccuacaacagccccuccgucacagaccccacccuuauagccgacgcccucgacaaaaaaaucgccgaauucgacaccgucgaagaucuccuaaaauacuucaaccccgaaucauggcaagaagaccucgaaaacauguaccuagacaccccacgauaccgcggacgcucauaccacgaccgaaaauccaaagucgaccucgaccgacucaacgacgacgccaaacgcuacagcugcacaccacgcaacuacuccgucaacauccgcgaagagcuaaaacucgccaacguagucuucuucccccgcugccuucucguccaaagaugcggcggcaacugcggcuguggaaccguaaacuggcgcagcugcaccugcaacucaggcaaaaccgucaaaaaauaccacgaaguccuccaauucgaaccaggccacaucaaacgccgcggccgagccaaaacaauggcccucgucgacauccagcucgaccaccacgaacgcugcgacugcauaugcuccagccgccccccucgcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2390 - RNA, 895 nt, Artificial Sequence
  mRNA product Design1 comprising derived and/or modified sequence from Homo sapiens__NP_003946.3__HsSOCS3 (opt11)
gggagaaagcuuaccauggucacccacuccaaauucccugccgcaggcaugucccgaccccucgacaccucccuccgacucaaaaccuucuccucaaaguccgaauaccaacucgucgucaacgccguccguaaacuccaagaauccggcuucuacugguccgccgucaccgguggugaagcaaaccuccuccucuccgcagaacccgccggcaccuuccucauccgcgacuccucagaccaacgccacuucuucacccucucagucaaaacccaauccggcaccaaaaaccuccgcauccaaugcgaaggcggcuccuucucccuccaauccgacccacgcuccacacaaccugucccacgcuucgacugcguccucaaacucguccaccacuacaugccaccccccggcgcccccuccuucccauccccccccaccgaacccuccucagaaguccccgaacaacccucagcccaaccccuccccggcucccccccccgccgcgcauacuacaucuacuccggcggcgaaaaaaucccacucguacucucccgcccccucuccuccaacgucgccacccuacaacaccucugccgcaaaaccgucaacggccaccucgacuccuacgaaaaagucacccaacuacccggccccauccgcgaauuccucgaccaauacgaugcaccccuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2391 - RNA, 700 nt, Artificial Sequence
  mRNA product Design1 comprising derived and/or modified sequence from Homo sapiens__NP_003227.1__HsTGFA (opt11)
gggagaaagcuuaccaugguccccuccgccggccaacucgcccuauucgcccucggaaucguccucgcagccugccaagcccucgaaaacuccaccuccccccucuccgccgacccccccgucgccgccgccgucgucucccacuucaacgacugccccgacucccacacccaauucugcuuccacggcaccugccgcuuccucguccaagaagacaaacccgccugcgucugccacuccggcuacgucggcgcccgcugcgaacacgccgaccuccucgccgucgucgccgccucccaaaaaaaacaagccaucaccgcccucgucgucgucuccaucgucgcccucgccguccucaucaucaccugcguccuaauccacugcugccaaguccgcaaacacugcgaauggugccgcgcccucaucugccgccacgaaaaacccuccgcccuccucaaaggccgcaccgccugcugccacuccgaaacagucguuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2392 - RNA, 1390 nt, Artificial Sequence
  mRNA product Design1 comprising derived and/or modified sequence from Homo sapiens__NP_000651.3__HsTGFB1 (opt11)
gggagaaagcuuaccaugccucccucuggccuucgacugcucccccuccuccucccccuccuauggcuccuaguccuaacacccggccgcccagccgcaggccucuccacaugcaaaacaauagacauggaacucgucaaacgaaaacgcaucgaagcaauccgcggccaaauacucucuaaacuucgccucgccucaccacccucccaaggcgaagucccaccaggaccccuccccgaagccguauuagcucucuacaacuccacacgcgaccgcgucgcaggcgagagcgccgaacccgaacccgaaccugaagcugacuacuacgccaaagaaguaacacgcguccucaugguugaaacccacaacgaaaucuaugacaaauucaaacaauccacccacucaaucuacauguucuuuaacacaucagaacuccgcgaagccguccccgaaccaguccuccuuucccgugccgaacuccgccuacugcgccucaaacuaaaaguagaacaacacguugaacucuaccaaaaauacucaaacaauuccuggcgauaccucuccaaccgccuccucgcccccuccgacagccccgaauggcucucuuuugacgucacaggcgucguacgccaauggcucucaagaggcggcgaaaucgaaggcuuccgccucucagcccauugcucuugcgacucucgcgacaacacccuccaagucgacaucaacggcuucaccaccggccgacgcggcgaccucgccaccauccacggcaugaaccguccuuuccuacuucuaauggccacaccccucgaacgcgcccaacaccuccaaucaucacgccacagacgcgcccucgacaccaacuacugcuucuccuccaccgaaaagaacugcugcguacgccaacucuacaucgacuuccguaaagaccucggcuggaaauggauccacgaacccaaaggcuaccacgccaacuucugucuuggcccaugccccuacaucuggucccuagacacucaauacuccaaaguccuagcccuuuacaaccaacacaaccccggcgcaucagccgcccccugcugcguaccccaagcccucgaaccacuccccauagucuacuacguaggccgaaaacccaaagucgagcaacuauccaacaugaucguccggucgugcaaaugcuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2393 - RNA, 1462 nt, Artificial Sequence
  mRNA product Design1 comprising derived and/or modified sequence from Homo sapiens__NP_003229.1__HsTGFB2 (opt11)
gggagaaagcuuaccaugcacuacugcguccucuccgccuuccucauauuacaccucgucaccguugcccuaucccucucgacuugcuccacccucgacauggaccaauucaugcgcaaaagaaucgaagcaauccgaggccaaauccucucaaaacucaaacuuacaucccccccugaagacuauccagaacccgaggaaguccccccugaagucauauccauauacaacagcacccgcgaccuacuccaagaaaaagccucgcgacgagccgcagccugcgaacgcgaacgcagcgacgaagaauacuacgccaaggaagucuacaaaaucgacaugccgcccuucuucccaucagagaaugcuaucccccccaccuucuaccgaccauacuuccgcaucguccgcuucgacgucuccgcaauggaaaaaaacgccuccaaccucgucaaagccgaauuccgcgucuuccgccugcaaaaccccaaagcccgcguucccgaacaacgcaucgaacucuaccaaauacucaaauccaaagaccucaccucucccacccaacguuacaucgacucuaaaguagucaaaacacgcgccgaaggcgaauggcucuccuucgacguaaccgacgccguacacgaauggcuccaccacaaagacagaaaccucggauucaaaaucucccuacacugccccugcugcacuuucguccccuccaacaacuacauaauucccaacaaauccgaagagcuugaagcccgcuucgccggcaucgacggaaccucgaccuacacuucaggcgaccagaaaaccauuaaauccacccgcaaaaaaaacucgggcaaaacaccccaccuccuacucaugcuccucccauccuaccggcuagaaucccaacaaaccaaccgacgcaaaaaacgagcccucgacgcagccuacugcuuccguaacguccaagacaauugcugccuacgcccacucuacaucgauuucaaacgugaccucggauggaaauggauccaugaacccaaaggcuacaacgccaacuucugcgcaggcgcaugccccuaccucuggagcuccgacacccaacacucccgcguccuaagccuuuacaacaccaucaaccccgaagccucagccucccccugcugcgucucccaagaccucgaaccacuaacaauccucuacuacaucggcaaaacccccaaaauagaacaacucuccaacaugaucgucaaauccugcaaaugcuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2394 - RNA, 1456 nt, Artificial Sequence
  mRNA product Design1 comprising derived and/or modified sequence from Homo sapiens__NP_003230.1__HsTGFB3 (opt11)
gggagaaagcuuaccaugaaaaugcaccuccaacgagcccuagucguccucgcacuacucaacuucgcaaccgucucccuaagccuuuccacaugcaccacccuggacuucggccacaucaaaaagaaacgugucgaagccauucgaggccaaauacucagcaaacuccgccucacaucacccccagaacccacaguuaugacccacguccccuaccagguccuagcccuauacaacagcacccgcgaacuccucgaagaaaugcacggcgaacgcgaagaaggcugcacccaagaaaauacagaguccgaauauuaugcaaaagaaauccacaaauucgacaugauccagggccucgccgaacacaacgagcucgccgucugucccaaaggcaucaccuccaaaguauucagauucaacgugucauccgucgagaaaaaccgcaccaaccucuuccgcgccgaguuccguguccuccgcgucccaaaccccuccagcaaacgaaacgaacaacgaauagaacuauuccagauccuccgccccgacgaacacaucgccaaacaacgcuacauugggggcaaaaaccuccccacccgcggaacagccgaauggcuauccuucgacgucaccgacaccguccgcgaauggcuacuaagaagagaauccaaccucggccucgaaaucuccauacacugccccugccacaccuuccaacccaacggagacauacucgaaaacauccacgaaguaauggaaaucaaguucaaaggagucgacaacgaagacgaccacggccgcggcgaccuaggccgccucaaaaagcagaaagaccaccacaacccccaccuaauacuaaugaugauacccccucaccgccucgacaaccccggccaaggcggacaacgcaaaaagcgcgcccucgacacuaacuacugcuuccgcaaccucgaagaaaacugcugcguccgcccccucuacaucgacuuccgccaagaccucggguggaaauggguacacgaacccaaaggcuacuacgccaacuucugcagcggaccaugcccauaccucagaagcgcagacacaacacacuccaccguccucggccucuacaacacccuaaaccccgaagccucagccucccccugcugcguaccacaagaccuugaaccacucaccauccucuauuacguaggccgcacccccaaagucgaacaacucucaaacauggucguaaaaucaugcaaaugcuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2395 - RNA, 1603 nt, Artificial Sequence
  mRNA product Design1 comprising derived and/or modified sequence from Homo sapiens__NP_001057.1__HsTNFRSF1B (opt11)
gggagaaagcuuaccauggcaccagucgcagucugggccgcccucgccguaggccuugaacucugggcagccgcccacgcccucccagcacaagucgcauucacucccuacgcacccgaacccggcuccaccugccgccuacgcgaauacuaugaccaaacagcacaaaugugcugcuccaaaugcucucccggccaacacgcuaaaguauucugcacaaaaaccucugacaccguaugcgacucaugcgaagacuccacauauacccaacucuggaacuggguccccgaaugccucuccugcggcucccgcugcagcucagaccaaguagaaacccaagcuugcacccgcgagcaaaaccgcaucugcacaugccgccccggcugguacugcgcucucuccaaacaagaaggcugcagacuuugugcaccucugaggaaaugccgaccaggcuuugguguagcaagacccgguaccgaaaccucagacgucgucugcaaaccgugugcacccggcaccuucucaaacaccaccuccucuaccgacaucugccgaccacaucaaaucugcaacguagucgccaucccaggcaacgccuccauggacgccguaugcaccucgaccucccccacccgcuccauggcccccggcgccguacaccuaccccaacccgucuccacccgaucccagcacacccaacccaccccagaacccagcaccgccccgucaaccucauuccuacucccaaugggccccuccccacccgcagaaggcuccacaggcgauuucgcccuccccguaggacuaauaguuggcgucaccgcccuaggccuccuuaucaucggcguagucaacugcgucaucaugacccaagucaaaaaaaaaccccucugccuccaacgcgaagccaaagucccacaccucccagccgacaaagcccgcggaacccaaggccccgaacaacaacaccugcucaucaccgcccccucaucaagcuccuccucacucgaaucauccgccuccgcccucgaucgacgcgcccccacacgcaaccaaccacaagccccaggcguagaagcguccggcgccggcgaagcccgcgccuccaccggcucguccgacuccucaccaggaggucacggcacccaaguaaaugucaccugcaucgugaacguuuguuccuccucagaucacagcucccaaugcucuucccaagccuccuccacaaugggcgacaccgauuccagccccucagaaucccccaaagacgaacaagucccauucucaaaagaagagugugccuuccgaucccagcucgaaacaccagaaacccuacucgguucaaccgaagaaaaaccccucccccucggcgucccagacgcaggcaugaaacccuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2396 - RNA, 730 nt, Artificial Sequence
  mRNA product Design1 comprising derived and/or modified sequence from Homo sapiens__NP_002623.2__HsPGF (opt11)
gggagaaagcuuaccaugccggucaugcgccuguucccgugcuuucuccagcuacuggccgggcucgcgcucccggccgugcccccgcaacaaugggcgcucucggccggaaacgggagcucggaaguggaaguggucccguuccaggaagugugggggcgcucguacugucgagcgcucgagcgcuuggucgaugucgugagcgaguacccgagcgaggucgagcacauguucucgcccucgugcgugagcuugcuaaggugcacgggauguugcggggacgagaacuugcacuguguaccggucgagaccgcgaacgugaccaugcaauugcucaagaucaggagcggggacaggcccucguacguggaauugaccuuuagccagcacgugcgcugugaaugucgcccgcucagggaaaagaugaagccagagcgcaggcgcccgaaagggcgagggaaaaggcgcagggaaaagcaaagacccacggacugucacuugugcggggacgcggucccgaggcgcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2397 - RNA, 1456 nt, Artificial Sequence
  mRNA product Design1 comprising derived and/or modified sequence from Homo sapiens__NP_001020537.2__HsVEGFA (opt11)
gggagaaagcuuaccaugaccgauagacagaccgacacagcgcccucacccucguaccaucucuugccggggaggaggagaacgguagacgcggcggcaucgcgcgggcaagggccggaaccagcgccagggggaggagucgaaggagugggagcgagaggggucgcgcuaaaacucuucguccaacugcugggaugcagcagguucgggggagcagugguaagagcaggagaggcagagccaucgggcgcggcaaggagcgcaagcucgggaagggaggaaccacagccagaagaaggggaagaggaagaggaaaaggaagaagaaaggggaccacaauggagacuaggcgcgagaaagccagggagcuggacaggggaggcggccgugugcgcggacucggcaccagccgcaagagcgccgcaggcacuagcaagggccucgggaaggggaggaaggguggcaagacgaggagccgaggaaucaggaccaccacacagcccaagcaggcgagggagcgcgagcagggcagggcccgggagagcaagcgagacaaugaacuuucucuugagcuggguacauuggucgcuagcgcuccuacuguaucugcaccacgcgaaauggagccaggcagcgccaauggcagagggaggagggcagaaccaccacgaagucgugaaauucauggauguauaccaaaggagcuacugccacccaauagaaacgcuaguagacauauuccaggaauauccagaugaaauugaauacauauucaaaccgagcugcguaccacucaugagguguggcggaugcuguaacgaugaagggcuagagugcgugccaacagaagagagcaacauaacaaugcaaauaaugcgaauaaaaccacaccaaggacagcacauaggagagaugagcuuccuacaacacaacaagugcgagugcaggccaaagaaagacagagcgcgccaagaaaagaaaagcguaaggggaaaggggaagggacagaaaaggaaaaggaaaaagaguagauacaaaaguuggagcguauacguaggagcgagaugcugcuugaugccguggucacuaccgggaccacacccgugugggcccugcagcgagagacgaaaacaccuauucgugcaggacccgcagacgugcaagugcucguguaagaacacggacucgaggugcaaagcgagacagcuagagcugaaugaaaggaccugccgaugugacaagcccagaagguagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2398 - RNA, 916 nt, Artificial Sequence
  mRNA product Design1 comprising derived and/or modified sequence from Homo sapiens__NP_001165094.1__HsVEGFA (opt11)
gggagaaagcuuaccaugaacuuccuccuaagcuggguccacuggucccucgcccuacuccucuaccuacaccacgccaaauggucccaagccgcacccauggccgaaggcggcggccaaaaccaccacgaagucgucaaauucauggacgucuaccaacgcucauacugccaccccaucgaaacccucgucgacaucuuccaagaauaccccgacgaaauagaauacaucuucaaacccucaugcgucccccucaugcgcugcggcggcugcugcaacgacgaaggacucgaaugcguacccaccgaagaaucaaacaucacaaugcaaaucaugcgcaucaaaccccaccaaggccaacacaucggcgaaauguccuuccuccaacacaacaaaugcgaaugccgccccaaaaaagaccgagcacgacaagaaaaaaaauccguccgaggcaaaggcaaaggccaaaaacgaaaaagaaaaaaaucccgcuacaaauccugguccguauacgucggcgcccgaugcugccucaugccauggucccuccccggcccccacccaugcggccccugcuccgaacgccgcaaacaccucuucguccaagacccccaaaccugcaaaugcuccugcaaaaacaccgacuccagaugcaaagcccgccaacucgaacucaacgaacgcaccugccgcugcgacaaaccccgacgcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2399 - RNA, 841 nt, Artificial Sequence
  mRNA product Design1 comprising derived and/or modified sequence from Homo sapiens__NP_003368.1__HsVEGFB (opt11)
gggagaaagcuuaccauguccccccuccuccgccgccuccuccucgcagcccuacuccaacuagcccccgcacaagcccccgucucccaacccgacgcccccggccaccaacgcaaaguagucuccuggauagacgucuacacccgcgccaccugccaaccccgcgaagucguagucccccucacagucgaacucaugggcacagucgccaaacaacucguacccucaugcgucaccguccaaagaugcggcggcugcugccccgacgacggccucgaaugcguccccaccggccaacaccaaguccgcaugcaaauacucaugauccgauacccaucaucccaacuaggagaaaugucacucgaagaacacucucaaugcgaaugcagacccaaaaaaaaagacucagccguaaaaccagaccgcgccgcaacaccccaccaccgcccccaaccacgaucaguccccggcugggacuccgcccccggcgcccccucccccgccgacaucacccaccccacccccgcccccggcccauccgcccacgccgcccccuccaccaccucugcccuaacccccggccccgccgccgccgccgcagacgccgccgccucauccgucgccaaaggcggcgccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2400 - RNA, 1477 nt, Artificial Sequence
  mRNA product Design1 comprising derived and/or modified sequence from Homo sapiens__NP_005420.1__HsVEGFC (opt11)
gggagaaagcuuaccaugcaccuccuaggcuucuucagcguugccugcucccuacuggccgccgcccuccucccuggcccccgcgaagcucccgcagccgcagcagccuuugaaucaggucucgaccuuagcgacgcagaacccgacgccggagaagcuaccgccuacgcgagcaaagaccucgaagaacaacugcgauccgucuccuccgucgacgaacucaugacuguacucuaccccgaauacuggaaaauguacaaaugccaacuccggaaaggaggcuggcaacacaacagagaacaagccaaccucaacucccgaaccgaagaaacuaucaaauucgccgcagcccacuacaacaccgaaauacucaaaucaaucgacaacgaauggagaaaaacccaaugcaugccccgagaagucugcaucgacgucggcaaagaguucggagucgccaccaacacauucuucaaaccaccuuguguauccgucuaccgaugcggagguugcugcaacuccgaaggccuacaaugcaugaacaccuccaccucauaccucucaaaaacacucuucgaaaucaccgucccccuaagccaaggcccgaaaccagucaccauuuccuucgcaaaccauacaucaugccgauguaugucaaaacucgacgucuaccgccaaguccacuccauaauccgacgcucacucccagccacccucccccaaugccaagcagcaaacaaaaccugcccaaccaacuacauguggaacaaccacaucugccgcugccucgcacaagaagacuucauguucagcuccgacgccggcgacgacuccaccgacggcuuccacgacaucugcggccccaacaaagaacucgacgaagaaacaugccaaugcguuugucgcgccggccuccgcccagccuccugcggaccacacaaagaacucgacagaaacuccugccaaugcguuugcaaaaacaaacuauucccaucccaaugcggagccaaccgcgaguucgacgaaaauaccugccaaugcguaugcaaacgaaccugcccccgaaaccaaccccuaaaccccggcaaaugcgcuugcgaaugcaccgaauccccgcaaaaaugccuccucaaaggaaagaaauuccaccaccaaaccugcuccugcuaccgccgacccugcaccaaccgucaaaaagcgugcgaacccggauucuccuacuccgaagaagucugccgcugcguccccagcuacuggaaacgcccccaaauguccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2401 - RNA, 1282 nt, Artificial Sequence
  mRNA product Design1 comprising derived and/or modified sequence from Homo sapiens__NP_004460.1__HsVEGFD (opt11)
gggagaaagcuuaccauguaccgagaaugggucgucgucaacguauucaugaugcucuacguacaacucguccaaggcagcagcaacgaacacggccccgucaagagauccagccaaagcacccuagaacgauccgaacaacaaauacgcgcagccucaagccucgaagaguuacuacgaaucacccacucagaagacuggaagcucuggcgaugccgccuccgccucaaguccuucaccuccauggacagcagaucagccucccaccgcucaacccguuucgccgccaccuucuacgacaucgaaacccucaaagucaucgacgaggaauggcaacgaacacaaugcucucccagagaaaccugcguagaagucgccuccgaacuugguaaaucaaccaacacuuucuucaaaccacccugcgucaacgucuuccgcugcggaggcugcugcaacgaagagucccucauaugcaugaacacauccaccuccuacaucuccaaacaacucuucgaaauauccguaccccuaaccuccgucccagaacuuguacccgucaaagucgccaaccacaccggcugcaaaugccuccccacagcaccccgccaccccuacuccauaauccgccgaucgauacaaauaccggaagaagaccgcugcucacacucaaagaaacucugccccauagacaugcucugggacuccaacaaaugcaaaugcguccuccaggaagaaaacccccuagccggcacagaagaccacucccaccuccaagaaccagcccucugcggcccccauaugauguucgacgaagaccgcugcgaaugcguaugcaaaacccccugccccaaagaccucauccaacaccccaaaaacugcucaugcuucgaaugcaaagaaucacucgaaaccugcugccaaaaacacaaacucuuccaccccgacacaugcucaugcgaagaccgaugccccuuccacacccgccccugcgccuccggcaaaaccgccugcgccaaacacugccgauucccaaaagaaaaacgcgccgcccaaggcccccacucacgcaaaaauccauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2402 - RNA, 847 nt, Artificial Sequence
  mRNA product Design1 comprising derived and/or modified sequence from Homo sapiens__NP_061986.1__HsFGF21 (opt12)
gggagaaagcuuaccauggauuccgacgaaaccggcuuugaacacucaggauuauggguaucaguauuagcaggacuacuacuaggagcaugccaagcacacccaauaccagacucaucaccauuauuacaauucggaggacaaguaagacaaagauaccuauacacagacgacgcucaacaaacagaagcacauuuagaaauaagagaagacggaacaguaggaggcgcagccgaccaaucaccagaaucuuuacuacaauuaaaagcacuaaaaccaggcguaauacaaauauuaggaguaaaaacaucaagauucuuaugccaaagaccagauggagcacuauacggaucacuacacuuugacccagaagcaugcucauucagagaauuacuauuagaagacggauauaacguauaccaaucagaagcacauggacuaccccuacaccuaccaggaaacaaaucaccacaucgagacccagccccaagaggccccgcaagauuccuaccacuaccaggacuaccaccagcacuaccagaaccaccaggaauauuagcaccacaaccaccagauguaggauccuccgacccauuaucaaugguaggaccaucacaaggaagaucuccaucauacgcaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2403 - RNA, 1627 nt, Artificial Sequence
  mRNA product Design1 comprising derived and/or modified sequence from Homo sapiens__NP_002412.1__HsMMP1 (opt12)
gggagaaagcuuaccaugcauucauucccaccucuauuacuacuauuauuuugggguguuguaucccacucauuuccagcuacauuagaaacacaagaacaagacguagaucuaguccaaaaauaucuagaaaaauacuacaaccuaaaaaacgacggacgccaaguagaaaaaagaagaaacaguggaccaguaguagaaaaacuaaaacaaaugcaagaauuuuuuggacuaaaagucacaggaaaaccugaugccgaaacuuuaaaaguaaugaaacaaccaagaugcggcguaccugacguagcacaauucgucuuaacagaaggaaacccaagaugggaacaaacgcacuuaacauaucgaaucgaaaauuacacaccagaccuaccaagagcagacguagaucacgcaauagaaaaagccuuccaacuauggucaaauguaacaccccuaacauucacaaaaguaucagaaggacaagcagauauaaugaucucauucguaagaggggaucacagagauaacucacccuucgauggcccaggaggaaaccuagcacacgcauuccaaccuggaccaggaauagguggugaugcacauuucgacgaagacgaaagauggacaaacaacuucagagaauauaaccuacacagaguagcagcucacgaacuaggucauucauuaggacuaagucauucaacagauauaggagcacuaauguacccaucauacacuuuuagcggagacguacaacuagcacaagacgacauagauggaauacaagcaauauacggaagaucacaaaaccccguacaaccaauaggaccacaaacaccaaaagcaugugacucaaaacucaccuucgacgcaauaacaaccauaagaggagaaguuauguucuuuaaagacagauucuacaugagaacaaaucccuuuuacccagaaguagaauuaaacuucaucucaguauuuuggccccaacuaccaaauggucuagaagcagccuacgaauuugcugauagagaugaaguaagauucuucaaaggaaacaaauauugggccguccaaggacaaaacguauuacacggauauccaaaagauaucuacuccucauucggcuuuccaagaacaguaaaacauauugaugcagcacuauccgaagaaaacacaggaaaaacauacuucuuuguagccaacaaauacuggagauaugaugaauacaaaagaucgauggacccaggauaccccaaaaugauagcacacgacuuuccaggaauaggacacaaaguagaugcaguauucaugaaagacggauucuucuacuucuuccacggcaccagacaauacaaauuugaccccaaaacaaaacgcauccuaacauuacaaaaagcaaauucaugguuuaacuguagaaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2404 - RNA, 1387 nt, Artificial Sequence
  mRNA product Design1 comprising derived and/or modified sequence from Homo sapiens__NP_002412.1__HsMMP1(1-19,100-469) (opt12)
gggagaaagcuuaccaugcacucauucccaccacuauuauuacuacuauucuggggaguaguaucacacuccuucguauuaacugaaggaaauccucgaugggaacaaacccaccucacauauagaauagaaaacuacacaccagaccuaccuagagcagacguagaccacgcaauagaaaaagccuuccaauuaugguccaacgucacaccauuaacuuucacuaaagucucagaaggacaagcagauauaaugauauccuuugucagaggagaucacagagacaacucaccauuugacggaccaggaggaaaucuagcacacgcauuccaacccggacccggaauagguggagacgcacacuucgaugaagaugaaagauggacaaacaauuucagagaauacaauuuacacagaguagcagcacacgaacucggacacuccuuaggacucucccauucaaccgacauaggagcauuaauguacccaucauacacauucucaggagacguccaacuagcacaagacgauaucgacggcauacaagcuauauacggaagaucacaaaacccaguacaaccaaucggaccacaaacaccaaaagccugugacucaaaauuaacuuuugaugcaaucacaacuauacgaggcgaaguaauguuuuucaaagacagauucuacaugagaacaaaccccuuuuacccugaaguagaacuaaacuucauaucuguuuucuggccacaacuaccaaacggauuagaagcagcauacgaauuugccgacagagacgaaguuagauucuucaaaggaaacaaauacugggcaguucaaggacaaaacgucuuacacggauauccaaaagauauauacuccucauucggauucccaagaaccguaaaacacaucgaugccgcauuaucagaagaaaauacaggcaaaacauacuucuuuguugcaaacaaauauuggagauacgacgaauacaaacgcucuauggacccaggcuauccaaaaaugauugcacacgauuucccaggaauaggacacaaaguagaugcaguauucaugaaagacggauucuuuuauuucuuccacggaacaagacaauacaaauucgauccaaaaacaaaaagaauccuaaccuuacaaaaagccaacucaugguucaauugcagaaaaaauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2405 - RNA, 3574 nt, Artificial Sequence
  mRNA product Design1 comprising derived and/or modified sequence from Clostridium histolyticum__BAA77453.1__ColG (opt12)
gggagaaagcuuaccaugaagaaaaacauacugaaaaucuuaauggacuccuacuccaaagaaucaaaaauccaaacaguaagacguguaacaucaguaucacuccuggcaguauaccuuacaaugaacacuucuuccuuaguauuagccaaaccaauagagaauacuaaugacacaucaaucaaaaauguagaaaaauuacgaaaugcacccaacgaagaaaacagcaagaaaguagaagauuccaaaaacgacaaaguagaacauguuaaaaacauagaagaagcuaaaguagaacaaguugcuccggaagugaaaucaaaaucaacguugagaagugcaaguauagcaaacaccaacuccgaaaaauaugacuucgaauacuuaaauggacuaucguacacagaauuaacaaauuuaauuaaaaacauaaaauggaaucaaauaaauggucuguucaacuauaguaccggcucccaaaaauucuucggagauaaaaaucguguucaagcuauaauaaaugcacuacaagaaucugguagaacauauaccgcuaacgauaugaaaggaauagagacuuuuacggaaguccuaagagccggauucuacuuaggauacuauaacgaugguuuaaguuauuuaaaugacagaaauuuucaagacaaaugcauaccggcaaugauagcaauacagaaaaacccuaacuuuaagcuaggaacagcuguccaagacgaaguaauuacaucacuagguaaacuuaucggaaaugcaagcgcaaacgcagaagucguaaauaauugugucccaguacuaaaacaauuuagagaaaauuuaaaccaauaugcuccagacuauguaaaaggaacagcaguaaaugaacuuauaaaagguauagaguucgacuucucaggagcagcauaugaaaaagacguaaaaacaaugccaugguauggaaaaaucgauccauuuauaaaugaauugaaggcauuaggccuauauggaaauauaaccagcgcgacagaaugggcaucagacgucggaauuuacuaccuuaguaaauucggacuauauagcacaaauagaaaugacauaguacaaagccucgaaaaagcgguagauauguacaaauauggaaaaauagcuuucguagccauggaacgaauaacaugggacuaugaugguauagguucaaacggaaagaaagucgaccacgauaaauuccuagacgaugcugaaaaacacuacuuaccaaaaaccuacacguucgauaauggaacuuuuauaauacgugcuggagacaaaguuucagaagagaaaaucaaaagauuauauugggcuucgcgagaaguaaaaucucaauuccaccgaguaguaggaaacgauaaagcauuagaaguuggaaaugcggacgauguauuaacaaugaaaauuuucaacucacccgaagaauauaaauuuaauacuaacauuaacgguguaagcacagauaacggagguuuauacauagaaccucgaggaacauuuuauacguaugaacgaacaccacaacaaagcauauuuucguuagaagaacuauuuagacaugaauauacacauuaccuacaagcacgauacuuaguagauggauuauggggucaaggacccuuuuacgaaaagaaucgccucacaugguucgaugaaggcaccgcugaguucuuugcuggcucgacgagaacaaguggagugcucccaagaaaaaguaucuuaggauaccuugcaaaagauaagguugaccaucguuauucacuaaagaaaacuuuaaauucagguuacgacgacagugauuggauguuuuacaauuacggauuugcaguagcacauuaucucuacgaaaaagacaugcccaccuuuauaaaaaugaauaaagcaauuuuaaacaccgauguaaaauccuacgaugaaauaauuaagaaacugagugaugacgccaacaaaaauaccgaauaucaaaaucacauccaagaauuagccgacaaauaccaaggagcagguauaccgcuagugagugaugacuaucucaaagaccacggcuauaagaaagcaucugaaguuuacuccgaaauuagcaaagcggcaucacucaccaauacuagcgucaccgcagaaaaaucccaauacuuuaauacauuuacucuucgaggcacauacacaggagaaacgagcaaaggagaauuuaaagacugggacgaaaugaguaagaaacucgauggaacauuagaaucauuagccaaaaacuccuggaguggcuacaaaacacuuacugcauacuucacaaauuauagaguaacaagugauaauaaaguacaauaugauguagucuuucacgguguauuaacagauaaugcagauauaucaaacaacaaagcaccaauagcaaaaguaacuggaccaucaacaggggcugucgggagaaauauugaguucucaggcaaagauucaaaagacgaagaugguaaaauuguuucguacgauugggauuuuggcgacggagcaacaagucgugguaaaaacaguguacaugccuacaagaaagccggaaccuacaauguaacauuaaaaguaaccgacgacaaaggagcaaccgccacagaaaguuuuacuauagaaauuaaaaaugaagacacaacaacccccauaacuaaagaaauggaaccaaacgacgacauaaaagaagcaaauggaccgaucguagaaggaguuaccguuaaaggagacuuaaacggcucagaugacgcagauacuuuuuacuucgaugucaaagaagacggagaugucacaauagaauuacccuacaguggaucuucaaacuuuaccuggcuagucuauaaagaaggagaugaccaaaaucauauagcaagcggaauagauaaaaacaacagcaaaguaggcacauucaaaaguacaaaaggcaggcauuacguauuuauauacaaacacgauucugccucaaacauuucuuacaguuuaaauauuaaaggucuaggaaaugaaaaacuaaaagaaaaagaaaacaacgacucaucugacaaagcaacaguaauaccuaacuucaacacaacaaugcaaggaucauuacuaggagaugacaguagagauuacuauucauuugaaguaaaagaagaaggugaaguaaauaucgagcuagauaagaaagacgaauuuggagugacauggacccuucacccagaaucaaauauaaacgaucgaauaacauauggacaagucgauggcaacaaaguaucaaauaaaguuaaauuaagaccaggaaaauauuaucuccuuguauacaaguauucaggcaguggaaacuaugaauugagaguaaacaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2406 - RNA, 3298 nt, Artificial Sequence
  mRNA product Design1 comprising derived and/or modified sequence from Clostridium histolyticum__BAA77453.1__HsALB(1-18)_ColG(111-1118) (opt12)
gggagaaagcuuaccaugaaaugggucacauuuauuucacuacuguuuuuauucucaucagcauauaguauagcaaauacaaacagugaaaaauacgauuucgaauaucucaacggauugucauauacagaacuuaccaaccuuauuaaaaauauaaaauggaaccaaauaaauggucuauuuaauuacaguacggguucgcagaaauucuuuggagauaaaaaccguguacaggccauaauaaacgcacuacaggaauccggacgcaccuauacggcuaaugauaugaaaggaauagaaacuuuuacugaaguacuaagagccggauuuuaucucggauauuacaaugauggauugaguuaccuaaacgauaggaacuuucaagacaaauguauuccagcaaugauagcaauacagaaaaaccccaacuucaaauuaggcacagccguacaagacgaaguuauaacuucauuaggaaaauuaaucgguaacgcaagcgcaaacgccgaaguaguaaauaauuguguaccaguacuaaaacaauucagagaaaaccucaaccaauacgcacccgauuacguaaaagggacagcaguaaaugaauuaauaaaagguaucgaauuugacuucuccggagcagcuuaugaaaaagacguuaaaacuaugcccugguacggaaaaauagauccuuuuauaaaugaacucaaagcauuaggacucuaugggaauauaacaucggcuacugaaugggccagcgacguaggaauauauuauuuaucaaaauuugggcuauacucaacgaacaggaaugauauaguacaaucgcuagaaaaagccguagacauguauaaauaugguaaaauugcauucgucgcaauggaaagaauuacaugggauuaugacggaauaggguccaacggcaagaaaguagaucacgauaaauuuuuagacgacgcugaaaaacauuauuuaccaaaaacauauacuuuugacaacgguacauucaucauuagggcaggagauaaaguuuccgaagagaaaauaaaaagauuauacugggcaagucgagaaguaaaaucacaauuccacagaguaguaggcaacgauaaagccuuagaagucgguaaugcugacgauguauuaaccaugaaaauauucaacaguccugaagaauacaaauuuaauaccaauauaaauggaguaaguaccgauaauggcggacuauacauagaaccucgaggaaccuucuacacguacgaacgaacuccgcaacaaucaauauuuagucuagaagaacuauuucggcaugaauauacgcacuacuuacaagcuagauaucuuguagacggauuaugggggcaaggacccuucuaugaaaagaaucgauuaacaugguuugacgaaggaacugcugaauuuuucgcagguucaacaagaacgucaggaguacuaccaaggaaaaguauacuaggcuaccuugcaaaagauaaaguugaucaucgauauucacuaaagaaaacacuaaauagugguuaugacgacucagauuggauguucuauaacuaugguuuugcaguggcacauuaucuauaugaaaaagauaugccaaccuucauaaaaaugaacaaagccauauuaaauacugacgucaaaucauacgacgaaauaauuaagaaauuaucagacgaugcaaacaaaaauacagaauaucaaaaccauauacaagaauuagcagauaaauaucaaggugcagguauuccauuaguaucggaugauuauuuaaaagaucauggauacaagaaagccagcgaaguauacucugaaauuagcaaagcagcgucacucacgaauacaucuguuacugcagaaaaaucacaauauuuuaauacauuuacacugcguggaaccuauaccggagaaacaucaaaaggugaauuuaaagacugggacgaaaugucaaagaaacuagauggaacccucgaaaguuuagccaaaaauucauggaguggauauaaaacucuuacugcauacuucacuaauuacagaguaacaucagacaacaaaguacaauacgacguaguauuucauggcgucuugacagauaaugccgacauuucaaauaacaaagccccaauagcuaaagugacaggaccaucaacaggcgcagucggaagaaauauugaguucucagggaaagauaguaaagacgaagauggaaaaauaguuagcuaugacugggacuucggagauggagcaacaucucgagguaaaaacuccguacacgcauauaagaaagcuggaaccuauaacguuacauuaaaaguaacugaugauaaaggagcaacugcaacagaaaguuuuacuauagaaaucaaaaacgaagauaccacaacaccaauaacaaaagaaauggaaccaaacgacgacauaaaagaagcgaauggacccauaguagaaggagucacuguuaaaggagacuuaaaugggagcgacgaugccgacacuuuuuauuucgacguuaaagaagauggagacguaacuauagaauuacccuacucuggaaguaguaauuuuaccuggcuaguauacaaagaaggcgaugaucaaaaccauauagcgucaggaauagauaaaaauaauucaaaagugggcacuuucaaaagcacaaaaggaagacauuacguauucauuuauaaacacgauucagcaucaaacauaucauacucgcuuaauauaaaaggacuaggaaacgaaaaacuuaaagaaaaagaaaacaaugacucaucagacaaagccacaguaauuccaaauuuuaacacuacuaugcaaggaagccuuuuaggagaugauaguagagauuauuauucauucgaaguaaaagaagaaggagaaguuaauaucgaacuagauaagaaagaugaguucgguguaacguggacauuacacccugaauccaauauuaacgacagaaucaccuauggacaaguugacggaaauaaagucagcaacaaaguuaaauuaagacccggaaaauauuaccuccuaguuuauaaauauagcggaucaggaaacuacgaauuacgaguaaauaaaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2407 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt12)
gggagaaagcuuaccaugaaauggguaacauucauaucauuacuuuuccuauuuucaucagcauacaguaugaagaaaaauauauuaaaaauauuaauggacagcuauagcaaagaaucaaaaauacaaacaguuagaagaguaacuagcguuagcuuauuagccguauacuuaacaaugaauacaaguagccuaguauuagcaaaaccgauagaaaauacaaacgacacgagcaucaaaaacguugaaaaacuaagaaaugcccccaacgaagaaaacaguaagaaagucgaagacaguaaaaaugauaaaguagaacaugugaaaaacauagaagaagccaaaguagaacaaguagccccugaaguuaaaagcaaaucaacgcuacgcagcgccaguaggagaagaagaaaaagaauagcaaauacuaacucagaaaaauaugacuucgaauacuuaaauggacuaaguuacacagaacuuaccaaucuuaucaaaaacauaaaauggaaucaaauaaauggacuauucaauuauuccacugggucacaaaaauuuuucggagauaaaaauagagugcaggcuauaauuaacgcacuacaagaaucaggaagaaccuacacagcaaacgauaugaaagggauagaaacuuucacugaaguacugcgagcgggauucuauuugggguacuauaacgacgguuuaucauacuuaaacgacagaaauuuucaagacaaauguauaccagcaaugauagcaauacagaaaaauccuaauuuuaaacuagggaccgcaguacaagacgaagugauaacaucacucgguaaacucauaggaaaugcuucagcuaaugcggaaguaguaaauaauugcguaccaguuuuaaaacaauucagagaaaaccucaaccaauaugcacccgacuauguaaaaggaacugcaguuaacgaacuuaucaaaggaaucgaauuugauuuuagcggagccgcguacgaaaaagacgugaaaacaaugccuugguauggaaaaauagacccauucauuaacgaauuaaaagccuuaggccuguacgguaauauaacuucagccacagaaugggcaagugacguuggcauauacuauuugucgaaauuuggauuguauucaacaaaccguaacgacauaguucaaagccuggaaaaagcaguagauauguacaaauauggaaaaauagccuuuguagcaauggaaaggauuacaugggauuaugacggaauaggcucaaaugguaagaaaguagaucaugauaaguuucuagacgaugcagaaaaacacuaucuuccaaagacauacaccuucgacaauggaacuuuuauuauaagggcaggcgacaaaguauccgaagagaaaauaaaacguuuauacugggcaucacgggaaguaaaaagccaauuucauagaguaguaggaaacgacaaagcauuagaaguaggaaacgcagaugacguacucacaaugaaaauauucaauucuccugaagaauauaaauucaauacaaauauaaauggagucaguacagacaauggaggacuauacauagaaccuagagggacauuuuauacuuacgaaagaacaccccaacaauccauauuuucccuagaagaauuguuccgacaugaauacacacauuauuuacaagcccgauacuuaguagacggauuauggggacaagguccauucuacgagaaaaacagauugacaugguucgacgaaggaacagcagaauuuuucgccggaucaacuagaaccuccgguguauuaccaagaaaauccauccuuggguacuuagcaaaagauaaaguagaucaucguuauucguuaaagaaaacauuaaauagcggcuacgaugauucagauuggauguuuuauaauuauggcuuugcuguagcacauuaucuauacgaaaaagauaugccaacuuucaucaaaaugaacaaagcgaucuuaaauacagacguuaaaucauaugacgaaaucauaaagaaauuaucagaugaugcaaauaaaaacacagaauaucaaaaccacauacaagaacuagcugauaaauaucagggugcaggaaucccacucguaucggacgauuaccuaaaagaccauggauauaagaaagcaagcgaaguauacucagaaauuaguaaagcugcaucucuuacaaauacaagcguaacggcagagaaaagccaauauuucaacacguucacacuacgcggaacauauacuggagaaacaaguaaaggagaguucaaagauugggacgaaaugucaaagaaauuagaugguacuuuagaaucauuagccaaaaauagcugguccggguacaaaacacuuaccgcauacuuuacaaauuauagagucacaagcgauaauaaaguucaauacgaugucgucuuucacggaguacuaacagacaacgcggauauaagcaauaauaaagcaccaauagcaaaaguaacaggaccaucaaccggagcuguuggaagaaacauugaguucucaggaaaagacucaaaagacgaagauggcaaaauaguaagcuaugauugggauuuuggagacggcgcaacauccagaggcaaaaauagcguccaugccuauaagaaagcaggaacauacaacguaacauuaaaaguaacagacgacaaaggagccaccgccacugaaaguuuuacuaucgaaaucaaaaaugaagauacaaccaccccaauaaccaaagaaauggaaccuaaugaugacauaaaagaagcuaaugggccaauuguagaaggagucacagucaaaggcgacuuaaacgggagcgacgacgcugauaccuucuacuuugacguaaaagaagauggagauguaacaauagaacuaccauauucagguucauccaauuuuacauggcuaguguacaaagaaggugacgaccaaaaccauauagccaguggaauugacaaaaacaauucuaaaguggggacuuuuaaaagcacaaaagguagacauuauguauuuauauacaaacaugauagugcaagcaacauaucauacucucuaaauaucaaaggcuuaggaaacgaaaagcuaaaggaaaaggaaaauaacgauuccucagauaaagcaacugugaucccaaauuucaacacuacuaugcaaggcagccuucucggugaugauagccgagauuacuacuccuuugaagucaaagaagaaggugaagucaacauagaauuggauaagaaagaugaguucggcgucacauggacacugcauccagaaucaaacauaaacgauagaaucaccuacggacaagucgacggaaauaaaguaagcaauaaagucaaauuaagaccaggaaaauacuaccuucuaguauauaaauacucuggaaguggaaauuacgaauuacgaguuaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2408 - RNA, 3322 nt, Artificial Sequence
  mRNA product Design1 comprising derived and/or modified sequence from Clostridium histolyticum__BAA34542.1__ColH (opt12)
gggagaaagcuuaccaugaacuuuuugaagauaauacuaaauagaggaaaaacaaugaaaagaaaaugccuauccaaacgauuaaugcuggccauaacuauggcaacaauauuuacaguaaacaguacauuaccuauauaugcagcuguagauaaaaacaacgcuacagcugccguccagaacgaaucuaaaagguacaccguaucuuaucuaaaaacucuaaacuacuaugacuuaguagauuugcuaguaaaaacagaaauagagaaucuaccagacuuauuucaauauucaagcgaugccaaagaguucuauggaaauaaaaccagaaugaguuuuauaauggaugaaauagguagacgagcaccacaauacacagaaaucgaccauaagggaauaccgacacuuguagaagugguaagagcaggauucuauuuaggauuccauaauaaagaauuaaacgagauaaacaaacgauccuuuaaagaaagagucauaccaagcauauuagcaauccagaaaaauccaaauuucaagcuaggaacagaaguacaagauaaaauuguaagcgcaacaggauuacucgcagggaacgaaacagcacccccagaagucgugaacaacuucaccccaauacuccaagacuguaucaaaaauauagauagauacgcacuagaugaccuaaaaaguaaagcccuuuucaacguacuugcagcaccaaccuaugauauaacugaauaccuacgagcaacaaaagagaaaccagaaaacacacccugguacgggaaaauagacggcuuuauaaaugaguuaaagaaauuagccuuauaugguaaaauaaaugauaauaauucauggauaauagacaacggcauuuaucauaucgcaccucugggaaaauuacacaguaauaacaaaauagguauugaaacacuaacagaaguaaugaaaguuuauccauaucuaagcaugcaacaccuccaaucagcagaucaaauaaaacgacacuacgacucuaaggacgcagaagggaacaaaauaccacuagacaaauucaagaaagaaggaaaagaaaaauacugcccaaaaacauauacauucgacgauggcaaaguaauuaucaaagcuggcgcaaggguagaggaagaaaaaguaaaacgucuauauugggcuucaaaagaaguaaauucacaauucuuucgaguuuacggaauugauaaaccauuagaagaaggaaacccagaugacauucuaacuaugguuauauauaauucaccagaagaauauaaacuaaacucaguauuauacggauaugauaccaacaacggugggauguacauagaacccgaaggaacauucuuuacuuaugaacgcgaagcacaagaaagcacuuacacguuagaagaacuauuccgacacgaauauacacauuacuuacaaggacgcuaugcaguuccaggacaauggggacgaacaaaauuauaugauaacgacagacuaacaugguacgaagaaggaggagcagaauuauuugcugguaguacucgaacaaguggaauacuacccagaaaaagcauuguaagcaacauacauaauacaacacgcaacaacagauauaaacuaucagauacuguacauuccaaauauggcgccagcuuugaguucuacaacuacgcaugcauguucauggacuacauguacaauaaagacauggguauacucaacaaacuaaacgaucucgccaaaaauaacgacguugacggauaugauaauuacauuagagaccucaguucaaauuaugcauuaaaugacaaauaccaagaucacaugcaagaaagaauagauaacuaugaaaacuuaacaguaccauucguugcagacgauuacuuaguaagacacgcauauaaaaacccuaacgaaauauauucggaaauuucagaaguugcaaaauuaaaagaugcaaaaucugaaguaaagaaaagucaauauuuuucgaccuucacauuacguggaagcuauacaggaggugcauccaaaggaaaacucgaagaucaaaaagcaaugaacaaauuuauagacgacucuuuaaagaaacuagacacauauucguggagcggguacaaaacauuaacggcauacuucacgaauuauaaaguugacaguucaaauagagucacauaugauguagucuuucacggauaccuaccuaacgaaggagacaguaaaaauagucuccccuaugggaaaauaaauggcacauacaaagguaccgagaaagagaaaauaaaauuuuccucggaaggcucauucgacccugauggaaaaauaguaucauacgaaugggacuucggagauggaaauaaaaguaacgaagaaaauccagaacacucauacgauaaaguagggaccuauaccguaaaacucaaaguaacagaugacaaaggcgaaagcucaguuucaacaacaacugcagaaauuaaagauuuaucagaaaauaaauuaccaguaauauauaugcauguaccaaaaaguggggcacuaaaucaaaaaguaguguucuaugggaaaggaacauaugauccagacggaucaauugcagguuaccaaugggauuuuggagaugguucagauuucucaagugaacaaaauccaucccacguuuauacaaagaaaggagaauacacaguaacuuuacgaguaauggacaguucagggcaaaugucggagaaaacaaugaaaauuaaaauaacagauccaguauacccaauaggaacagaaaaagaaccuaauaauucaaaagaaacugcaucagggccaauaguacccggaauacccguauccgguacuauagaaaacacaucagaucaagacuacuucuauuuugauguuauaacgccaggagaaguaaaaauagauaucaacaagcuaggauauggaggagcaacguggguaguguaugaugaaaauaauaacgcaguuucauaugcaacugacgauggacaaaaccucuccggaaaauucaaagcagauaaaccaggaagguauuacauacaccuguacauguucaauggcucuuauaugccguaucguauaaauaucgaagggucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2409 - RNA, 3283 nt, Artificial Sequence
  mRNA product Design1 comprising derived and/or modified sequence from Clostridium histolyticum__BAA34542.1__ColH (opt12)
gggagaaagcuuaccaugaaacgaaaaugcuuaucaaaaagauuaauguuagcaauaacaauggccacuauauucacugucaauucaacccuuccaauauacgccgcaguagacaagaacaaugcuacagcagcaguacaaaaugaaaguaagagauacacaguaucguaucuaaaaacucuaaacuauuaugaccucguggaccugcuaguaaaaacagaaauagaaaauuuaccugauuuauuccaguauucaucagaugcaaaagaguucuauggcaauaagacaagaauguccuucauaauggaugaaauaggcagacgagcaccacaauacacugaaauugaccacaagggaauaccaacccuagucgaaguagucagagcaggauucuaccuaggcuuccauaauaaggaacuaaacgaaauaaacaaaagaaguuucaaagaaagagugauaccaucaauauuagcaauacagaaaaaucccaacuuuaaacuuggaacagaaguacaagacaaaauugugagcgcaaccggauuacuagcagggaacgaaacagcaccucccgaaguagugaauaauuuuacgccaauauuacaagauugcauuaaaaacauagacagauaugcacuagaugauuuaaaaucuaaagcauuauuuaacguacuagcagcucccacauaugauauaacagaauaccucagagccaccaaagaaaaaccugaaaauacaccaugguauggaaaaaucgacggcuuuaucaaugaacuuaaaaagcuagcacuauauggaaaaaucaacgauaacaacucauggaucauagauaauggaauauaccauauagcacccuuaggcaaacuucacucaaacaauaaaaucggcauagaaacauuaacggaaguaaugaaaguauacccuuaucuaucuaugcaacauuuacaaucagcagaucaaauaaaacgccacuacgauaguaaagaugcagaaggaaacaaaauaccccucgacaaguucaagaaagaaggaaaagaaaaauauuguccaaaaacauauacguucgacgauggaaaaguaauaauaaaagcaggagcaagaguagaagaggaaaaaguaaaaagauuauacugggcgucaaaagaaguaaacucacaauucuucagaguuuauggaauagacaaaccauuagaggaaggaaaucccgaugacauucuuaccauggugaucuacaacaguccugaagaauauaaacuaaauucuguccucuacggauaugauacaaacaacggaggcauguauaucgaaccagaaggaaccuuuuucacauaugagagagaagcucaagaaucaaccuacacccucgaggaacuauucagacacgaauauacgcacuaucuacaaggcagguacgcaguacccggacaauggggccguacaaaacuauaugacaacgacagacuaacuugguacgaagaaggaggggcugaauuauuugccggaucaacaagaaccucagggauucuuccacgaaaaucgauaguuucgaauauacacaauacaaccagaaacaauagauauaaauuaucagauacagugcauuccaaauauggggcuucauucgaguuuuacaauuaugcuugcauguucauggauuauauguauaacaaagacaugggaauacucaacaaacuaaaugaccucgcuaaaaacaaugacguagauggauacgacaauuacauacgcgauuuaagcuccaacuaugcauuaaacgacaaauaucaagaucauaugcaagaaagaauagauaauuaugagaaucuaacaguaccguucgucgcagaugauuacuuagugcggcacgcauauaaaaacccuaaugaaauuuauagcgaaauaagugaaguugcaaaauuaaaagacgcaaaaagugaaguaaagaaaucacaauacuuuagcacauucacauuaagaggaaguuauacuggaggagccuccaaagguaaacuagaagaccaaaaagcuaugaacaaauuuauagaugauagucuuaagaaacuugacaccuauucauggaguggauauaaaacauuaacagcuuauuucacuaacuauaaaguagauucaucaaaucgcguaacuuaugaugucguuuuccacgguuauuuacccaacgaaggagacaguaaaaacucacuaccauacgguaaaauaaauggcacuuacaaaggaacagaaaaagagaaaauaaaauucaguucugaaggaucauucgacccagauggaaaaauagugagcuaugaaugggacuucggagaugguaauaaaagcaaugaagaaaauccagaacacaguuaugacaaaguagguacauacacuguuaaauuaaaagucacagacgauaaaggcgaaaguucaguaucaacaacaacagccgaaauaaaagaucuaagcgaaaacaaacuacccgucauauauaugcacguaccuaaaaguggagcccuuaaccaaaaagugguauucuacggaaaaggaacauacgacccugacggaagcauagcaggauaucaaugggacuucggugacgguucggacuucucuucugaacaaaauccaagccacguauacacaaagaaaggagaauacaccguaacacuuagaguuauggacagcucaggacaaaugucagagaaaacaaugaaaaucaaaauuaccgacccuguauauccaauaggaacugaaaaagaaccaaauaacaguaaagaaacagcuaguggaccgaucguuccagguauuccuguaaguggaacaaucgaaaacacaucagaccaggacuauuuuuauuucgauguaauaacaccaggagaagucaaaaucgauauaaauaaacuaggauauggaggggcuacauggguaguauacgaugaaaacaacaaugcaguauccuacgcgacagaugacggacagaaccuuucaggaaaauucaaagcggacaaaccaggcagguacuacauacaccuauacauguucaacggauccuauaugccuuaucgaauuaauauagaaggauccguaggccguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2410 - RNA, 3217 nt, Artificial Sequence
  mRNA product Design1 comprising derived and/or modified sequence from Clostridium histolyticum__BAA34542.1__HsALB(1-18)_ColH(41-1021) (opt12)
gggagaaagcuuaccaugaaaugggugacauucauaucucuacuuuuccuauucuccucagcauacucaguacaaaacgaaucaaaaagauacacagugaguuacuuaaaaacguuaaacuacuaugaccuaguagaccuucuaguaaaaaccgaaauagaaaaucuaccagaccuauuccaauacucuucagaugccaaagaauuuuauggaaauaaaaccagaaugaguuucaucauggaugaaaucggaaggagagcaccacaauacacggaaauagaucacaaagguauacccacuuuaguagaagucguaagagcaggauucuacuuaggauuccauaacaaagaacucaaugaaauuaauaaaagaucuuucaaagaaaggguaauacccagcauacucgccauacagaaaaaccccaacuucaaacuaggaacagaaguacaagauaaaauaguaucagcaacugguuuacucgcuggaaaugaaaccgcaccaccagaaguaguaaacaacuucaccccuauucuacaagacugcauuaaaaauauagacagauacgcccuagacgacuuaaaaucgaaggcccucuuuaacguacuagccgccccaacauaugauauaacagaauacuuaagagcaaccaaagaaaaaccagaaaauacacccugguacggaaaaauagacggauuuauaaaugaauuaaagaaauuagcguuauaugggaaaauaaacgacaauaauaguuggauaauagacaacggaauauaccacauagcaccauuaggcaaacuacacuccaauaacaaaauagggauagaaaccuuaacagaaguaaugaaaguauauccauaucuaucaaugcaacauuugcaaucagcagaccaaauaaaacgacauuaugauaguaaagacgcagaaggaaauaaaauaccacuagauaaauucaagaaagaaggaaaagaaaaauauuguccaaaaacauacacauucgaugacggaaaaguaauaauuaaagccggugcccggguagaagaagaaaaaguaaaacgacuguauugggcuucuaaagaagucaauucacaauucuuuaggguauacggaauugauaaaccucuagaagaagguaacccagacgacauccuaacaauggucauauacaauagcccggaagaauacaaauuaaacucgguauuauacggguaugacacaaauaacggcggcauguacauugaacccgaaggaacguucuucacauaugaaagagaagcacaagaaucaacauacacacucgaagaacuauuuagacacgaauauacacauuauuuacaagggagauacgccguacccggacaauggggucgaaccaaacuuuacgacaacgacaggcuaacaugguacgaagaagggggagcagaauuauucgcaggaucaacaagaaccucaggaauacuaccuagaaaaaguauaguaucaaauauacauaauacaaccaggaauaacagauauaaauuaagugacacaguccauucaaaauauggagccuccuuugaguucuauaacuacgcauguauguucauggauuacauguacaacaaagauaugggaauccuaaacaaacuaaacgaccuagcuaaaaauaacgauguugacggauacgauaacuacauaagagaccucagcucaaacuaugcacuuaacgacaaauaucaagaucauaugcaagaaagaauagacaacuacgaaaaucucacaguaccauucguagcagacgauuauuuaguaagacacgcauacaagaacccuaacgaaaucuauuccgaaauuagcgaaguagcgaaacuuaaagacgcaaaaagugaaguaaagaaaagucaauacuucagcacauucacacuacgaggauccuacacaggcggcgcaagcaaaggcaaacuagaagaucaaaaagcaaugaacaaauucauagacgauucacucaagaaauuagauacauauagcuggaguggauacaaaacacuaacugcauauuucacaaacuacaaaguugacagcucaaauagagucacauaugauguaguauuccacggauaucuacccaaugaaggugacagcaaaaacuccuuaccauacggaaaaauuaacgggacauacaaaggaacagaaaaagagaaaauaaaauucucauccgaagguagcuuugaccccgauggaaaaauuguaucauaugaaugggacuucggagacggaaauaaaucaaacgaagaaaauccugaacacagcuaugauaaaguuggcaccuauaccgugaaacuaaaagugacagaugacaaaggugaaucauccguauccacaacgacagcagaaauuaaagacuuaagcgaaaacaaacuaccaguaauauacaugcauguaccaaaauccggcgcauuaaaucaaaaagucguauuuuauggaaaagggacuuaugaccccgaugggucaaucgcaggcuaucaaugggacuucggcgauggcucagacuucucaucagaacagaacccaucucauguuuacacaaagaaaggagaauacacaguaacauuacgagucauggauucaucaggucaaaugucagagaaaacaaugaaaauaaaaauaacagauccgguuuacccaauaggaacagaaaaagaacccaacaauucaaaagaaacagcaaguggcccuauaguuccagguauuccuguaucagguacaaucgaaaacacaucagaccaggauuacuuuuacuucgacgugauuacgccaggagaaguuaaaaucgauauuaauaaauuaggauaugguggagccacguggguaguauacgaugaaaauaauaaugcaguaucauaugccacagaugacggacaaaaucuuucagggaaauuuaaagcugauaaaccaggaagauauuauauacaccuuuacauguucaacgguucauacaugccuuacagaauaaauauagaaggauccguagguagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2411 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt12)
gggagaaagcuuaccaugaaaugggugacauucaucucacuauuauuucuauucaguagcgcauauucuaugaaacgaaaaugcuuauccaaaagacuaaugcuagcaauaacaauggcaacaaucuucaccguaaauucaacauuaccaaucuacgcagccguagauaaaaacaaugcaacagcagcucgaaggagaaggaaaaggguacaaaacgaaagcaaaagauauaccgucagcuaccuuaaaaccuuaaauuacuacgacuuaguagaucucuuaguaaaaacagaaauagaaaacuuacccgauuuguuucaauauucauccgacgcaaaagaguucuacggaaauaaaacaagaaugagcuucauaauggacgaaauaggucggagagcuccccaauauaccgaaauagaucauaaaggaauaccaaccuuaguagaaguaguaagagccggauuuuaccuuggcuuccauaacaaagaacuaaacgaaauaaacaaacgauccuucaaagagcgcguaauaccaaguauacuggccauccagaaaaacccaaacuuuaaauuaggaacggaaguucaagacaaaauaguaagugcaacagggcuccuagcaggaaacgaaacagcucccccugaaguuguaaauaacuucacaccaauacuucaagacuguauuaaaaacauagacagauacgcauuagacgaccuuaaaagcaaagcguuauuuaacguacuagcugcacccacuuaugacauaacugaauacuuaagagcaacaaaagaaaaaccagaaaacacaccuugguauggcaaaauagauggauuuauaaaugaacuaaagaaacuggcacuauauggcaaaaucaacgauaauaacaguuggauaauagacaacgguauauaucauauagcaccacuagguaaauugcauucaaacaauaaaauugguauagaaacguuaacagaggugaugaaaguauacccauaccuaucuaugcaacauuuacaaucagcggaucaaauuaaaaggcacuaugauucaaaagaugcggaagguaacaaaauaccacuagacaaauucaagaaagaaggaaaagaaaaauauugucccaaaacauacacauuugaugaugguaaaguaauaauaaaagcaggggcucgaguagaagaagaaaaaguuaaacgacuauacugggccucaaaagaagucaacucucaauuuuuccgcguauacggaaucgauaaaccauuagaagaagguaauccggaugauauauuaaccauggugaucuacaacucaccagaagaauacaaacuaaauucaguccuauauggauacgacacuaauaaugguggaauguacauagaaccagaaggcacauucuucacauacgaaagagaggcucaagaaucaacauacacacuagaagaauuauuccgacacgaauacacacauuacuuacaaggaagauacgcgguacccggacaauggggaagaacaaaacuauacgauaaugaucgacuuacaugguaugaagaaggaggagccgaacuauucgcaggauccacgcgcaccucagggauucuuccaagaaaaucaauaguaucaaauauacacaauacaacacgaaauaacagauauaaauuaucagacacaguacacuccaaauauggcgcaaguuucgaguucuacaauuacgcauguauguucauggauuacauguauaacaaagauauggggaucuuaaacaaacuaaacgauuuagcgaaaaacaaugacguagacggcuaugacaacuacauacgagacuuauccagcaauuacgcacuuaacgauaaauaccaagaucacaugcaagaaagaauagauaacuacgaaaaucuaacagucccauuugucgcagacgacuaccuggugagacacgcuuacaaaaauccaaaugaaauauacucagaaauaagcgaaguagcuaaacucaaagacgccaaaagugaaguuaagaaaagucaauacuuuucaacauucacccuccggggaucauauaccgggggagcaucuaaaggaaaauuagaagaccaaaaagccaugaauaaauuuauagaugacucccuaaagaaacuggacacuuacuccuggaguggguacaaaacuuuaacagcuuauuucaccaacuauaaaguagacagcagcaaucgagucacauaugacgucguguuucaugguuacuuaccaaacgaaggagacagcaaaaacucacuucccuaugguaaaauaaacgguacauacaaaggaacagaaaaagagaaaauuaaauucucuucugaaggaucauuugauccagauggaaaaaucgugaguuaugaaugggacuuuggagacggaaacaaaucuaacgaagaaaacccagaacacaguuaugauaaaguuggaaccuacacaguaaaacuaaaagugacugacgauaaaggagaaucaucagucaguacaacuacagccgaaauaaaagaucuaagcgaaaauaaacuccccguaauauauaugcacgucccaaaaucaggagccuuaaaucaaaaaguugucuuuuacgguaaaggaacauacgaucccgauggaucaaucgcaggauaucaaugggacuuuggagaugguagcgauuucuccagcgaacaaaaccccucacacguauauacaaagaaaggagaguauacaguaacauuaagagugauggauagcucgggacaaaugucagagaaaacaaugaaaauaaaaauuacggauccaguauaccccauaggaacagaaaaagaaccaaacaauuccaaagaaaccgcuagugguccaaucguacccggcauuccggugagcgguacuauagagaacacaucagaccaagauuacuuuuacuucgacgucauuacaccaggcgaaguaaaaauagauauaaauaaauuagguuacggaggugcaacuuggguaguauaugacgagaacaacaacgccgucucauacgcaaccgacgacggucaaaaucuaucaggaaaauucaaagcagacaaaccagguagauacuacauucaccuauacauguucaauggaaguuacaugccauacagaauaaacauagaaggauccguuggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2412 - RNA, 793 nt, Artificial Sequence
  mRNA product Design1 comprising derived and/or modified sequence from Homo sapiens__NP_001133.1__HsAMELX (opt12)
gggagaaagcuuaccaugggaacauggauacuuuucgcaugccuacucggagcagcauucgcaaugccacuaccaccacacccaggacacccaggauacauaaacuucucauacgaaguacuaacaccacuaaaaugguaccaaucaauaagaccaccauacccaucauacggauacgaaccaaugggaggaugguuacaccaccaaauaauaccaguacuaucacaacaacacccacccacacacacauuacaaccacaccaccacauaccaguaguaccagcacaacaaccaguaauaccacaacaaccaaugaugccaguaccaggacaacacuccaugacaccaauacaacaccaccaaccaaaccuaccaccaccagcacaacaaccauaccaaccccaaccaguacaaccacaaccacaccaaccaaugcaaccacaaccaccaguacacccaaugcaaccacuaccaccacaaccaccacuaccaccaauguucccaaugcaaccacuaccaccaaugcucccagaccuaacacuagaagccuggccaucaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2413 - RNA, 352 nt, Artificial Sequence
  mRNA product Design1 comprising derived and/or modified sequence from Homo sapiens__NP_001133.1__HsAMELX-TRAP (opt12)
gggagaaagcuuaccaugccucuaccuccacauccaggucacccuggauauauaaauuucucuuacgaaguacuuacaccucuaaaaugguaucaaucuauacguccaccuuacccuucauauggauaugaaccuauggguggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2414 - RNA, 385 nt, Artificial Sequence; identical to SEQ ID NO: 1954
  mRNA product Design1 comprising derived and/or modified sequence from Homo sapiens__NP_001133.1__HsAMELX-LRAP (opt12)

SEQ ID NO: 2415 - RNA, 424 nt, Artificial Sequence; identical to SEQ ID NO: 1955
  mRNA product Design1 comprising derived and/or modified sequence from Homo sapiens__NP_001133.1__HLA-A2-SP_HsAMELX(17-60) (opt12)

SEQ ID NO: 2416 - RNA, 457 nt, Artificial Sequence
  mRNA product Design1 comprising derived and/or modified sequence from Homo sapiens__NP_001133.1__HLA-A2-SP_HsAMELX(17-47,168-191) (opt12)
gggagaaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2417 - RNA, 796 nt, Artificial Sequence
  mRNA product Design1 comprising derived and/or modified sequence from Homo sapiens__NP_001134.1__HsAMELY (opt12)
gggagaaagcuuaccaugggaacauggauccuauucgcuugccuaguaggagcagcauucgccaugccauuaccaccacacccaggacacccaggauacauaaacuucucauacgaaguacuaacaccacucaaaugguaccaaucaaugauaagaccaccauacucaucauacggauacgaaccaaugggaggauggcuacaccaccaaauaauaccaguaguaucacaacaacacccauuaacacacacacuacaaucacaccaccacauaccaguaguaccagcacaacaaccaagaguaagacaacaagcacucaugccaguacccggacaacaaucaaugacaccaacacaacaccaccaacccaaccuaccacuaccagcacaacaaccauuccaaccacaaccaguccaaccacaaccacaccaaccaaugcaaccacaaccaccuguacaaccaaugcaaccacuauuaccacaaccaccacucccacccauguucccacuaagaccacuaccaccaauacuaccagaccuacaccuagaagcauggccagcaacagacaaaacaaaacaagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2418 - RNA, 355 nt, Artificial Sequence; identical to SEQ ID NO: 1958
  mRNA product Design1 comprising derived and/or modified sequence from Homo sapiens__NP_001134.1__HsAMELY-TRAP (opt12)

SEQ ID NO: 2419 - RNA, 388 nt, Artificial Sequence
  mRNA product Design1 comprising derived and/or modified sequence from Homo sapiens__NP_001134.1__HsAMELY-LRAP (opt12)
gggagaaagcuuaccaugccacuaccaccacacccaggacacccaggauacauaaacuucucauacgaaguacuaacaccacuaaaaugguaccaaucaaugauaagaccaccaccaauacuaccagaccuacaccuagaagcauggccagcaacagacaaaacaaaacaagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2420 - RNA, 427 nt, Artificial Sequence; identical to SEQ ID NO: 1960
  mRNA product Design1 comprising derived and/or modified sequence from Homo sapiens__NP_001134.1__HLA-A2-SP_HsAMELY(17-61) (opt12)

SEQ ID NO: 2421 - RNA, 460 nt, Artificial Sequence; identical to SEQ ID NO: 1961
  mRNA product Design1 comprising derived and/or modified sequence from Homo sapiens__NP_001134.1__HLA-A2-SP_HsAMELY(17-48,169-192) (opt12)

SEQ ID NO: 2422 - RNA, 787 nt, Artificial Sequence
  mRNA product Design1 comprising derived and/or modified sequence from Sus scrofa__NP_999071.1__SsAMELX-001-1 (opt12)
gggagaaagcuuaccaugggaaccuggauauuauucgcaugccuacuaggagcagcauucucaaugccacuaccaccacacccaggacacccaggauacauaaacuucuccuacgaaguauuaacaccacuaaaaugguaccaaaacaugauaagacaccccuacacaucauacggauacgaaccaaugggaggauggcuacaccaccaaauaauacccguaguaucacaacaaacaccacaaucacacgcacuacaaccccaccaccacauaccaaugguaccagcacaacaaccaggaauaccacaacaaccaaugaugccacuaccaggacaacacucaaugacaccaacacaacaccaucaaccaaaccuaccacuaccagcacaacaaccauuccaaccacaaccaguacaaccacaaccacaccaaccacuacaaccccaaucaccaaugcaccccauacaaccacuacuaccacaaccaccacuaccaccaauguucucaaugcaaucacuacuacccgaccuaccacuagaagcauggccagcaacagacaaaacaaaacgcgaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2423 - RNA, 355 nt, Artificial Sequence; identical to SEQ ID NO: 1963
  mRNA product Design1 comprising derived and/or modified sequence from Sus scrofa__NP_999071.1__SsAMELX-TRAP (opt12)

SEQ ID NO: 2424 - RNA, 388 nt, Artificial Sequence; identical to SEQ ID NO: 1964
  mRNA product Design1 comprising derived and/or modified sequence from Sus scrofa__NP_999071.1__SsAMELX-LRAP (opt12)

SEQ ID NO: 2425 - RNA, 427 nt, Artificial Sequence; identical to SEQ ID NO: 1965
  mRNA product Design1 comprising derived and/or modified sequence from Sus scrofa__NP_999071.1__HLA-A2-SP_SsAMEL(17-61) (opt12)

SEQ ID NO: 2426 - RNA, 460 nt, Artificial Sequence; identical to SEQ ID NO: 1966
  mRNA product Design1 comprising derived and/or modified sequence from Sus scrofa__NP_999071.1__HLA-A2-SP_SsAMEL(17-49,167-189) (opt12)

SEQ ID NO: 2427 - RNA, 751 nt, Artificial Sequence
  mRNA product Design1 comprising derived and/or modified sequence from Sus scrofa__P45561-2__SsAMELX-001-2 (opt12)
gggagaaagcuuaccaugggaacauggauauuauucgcaugccuacuaggagcagccuucucaaugccacuaccaccacacccaggacacccaggauacauaaacuucucauacauaagacauccauacacaucauacggauaugaaccaaugggaggauggcuacaccaccaaauaauaccaguaguaucacaacaaaccccacaaucacacgcacuacaaccacaccaccacauaccaaugguaccagcacaacaaccaggaauaccacaacaaccaaugaugccauuaccaggacaacacuccaugacaccaacacaacaccaccaaccaaaccuaccacuaccagcacaacaaccauuccaaccacaaccaguacaaccacaaccacaccaaccacuacaaccacaaucaccaaugcacccaauacaaccacuacuaccccaaccaccacuaccaccaauguucucaaugcaaucacuacuaccagaccuaccacuagaagcauggccagccacagacaaaacaaaacgagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2428 - RNA, 787 nt, Artificial Sequence
  mRNA product Design1 comprising derived and/or modified sequence from Sus scrofa__NP_998965.1__SsAMELX-001-3 (opt12)
gggagaaagcuuaccaugggaacauggauauucuucgcaugcuuacuaggagcauccuuagcaaugccacuaccaccacacccaggccacccaggauacauaaacuucucauacgaaguacuaacaccacuaaaaugguaccaaaacaugauaagacacccauacacaucauacggcuacgaaccaaugggcggcuggcuacaccaccaaauuauaccaguaguaucacaacaaacaccacaaucacacgcacuacaaccccaccaccacauaccaaugguaccagcacaacaacccggaauaccacaacaaccaaugaugccacucccaggacaacacucaaugacaccaacacaacaccaccaaccaaaccucccacuaccagcacaacaaccauuccaaccccaaccaguacaaccacaaccacaccaaccacuacaaccacaaucaccuaugcacccaauacaaccauuacuaccccaaccaccacuaccaccaauguucucaaugcaaucacuacuaccagaccuaccacuagaagcauggccagcaacagacaaaacaaaaagagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2429 - RNA, 436 nt, Artificial Sequence; identical to SEQ ID NO: 1969
  mRNA product Design1 comprising derived and/or modified sequence from Sus scrofa__K7GPB2__SsAMELX-002 (opt12)

SEQ ID NO: 2430 - RNA, 829 nt, Artificial Sequence
  mRNA product Design1 comprising derived and/or modified sequence from Sus scrofa__K7GLD0__SsAMELX-003 (opt12)
gggagaaagcuuaccaugggaacauggauacuauucgcaugccuacuaggcgcagcauucucaaugccacuaccaccacaccccggacacccaggcuacauaaacuucucauacgaagauuuauacuuagaagcaauaagaauagacagaacagcauuuguauuaacaccacuaaaaugguaccaaaacaugauaagacacccauacacaucauauggauacgaacccaugggaggauggcuacaccaccaaauaaucccaguaguaucacaacaaacaccacaaucacacgcccuacaaccacaccaccacauaccaaugguaccagcacaacaaccaggaauaccacaacaacccaugaugccacuaccaggacaacacucaaugacaccaacacaacaccaccaacccaaccuaccacuaccagcacaacaaccauuccaaccacaaccaguacaaccacaaccacaccaaccauuacaaccacaaucaccaaugcacccaauacaaccccuacuaccacaaccaccacuaccaccaauguucucaaugcaaucacuacuaccagaccuaccacuagaagccuggccagcaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2431 - RNA, 715 nt, Artificial Sequence
  mRNA product Design1 comprising derived and/or modified sequence from Sus scrofa__K7GPE9__SsAMELX-004 (opt12)
gggagaaagcuuaccaugggaacauggauacuauucgcaugccuacuaggagcagcauucucaaugccacucccaccacacccaggacacccaggauacauaaacuucucauacgaaguacuaacaccacuaaaaugguaccaaaacaugauaagacacccaacaccacaaucacacgcacuccaaccacaccaccacauaccaaugguaccagcacaacaacccggaauaccacaacaaccaaugaugccacuaccaggacaacacuccaugacaccaacacaacaccaccaaccaaaccucccacuaccagcacaacaaccauuccaaccacaaccaguacaaccacaaccacaccaaccacuacaaccacaaucacccaugcacccaauacaaccacuacucccacaaccaccacuaccaccaauguucucaaugcaaucacuacuaccagaccucccacucgaagcauggccagcaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2432 - RNA, 739 nt, Artificial Sequence
  mRNA product Design1 comprising derived and/or modified sequence from Sus scrofa__J9JIM4__SsAMELX-201 (opt12)
gggagaaagcuuaccaugccacucccaccacacccaggacacccaggauacauaaacuucucauacgaaguacucacaccccuaaaaugguaccaaaacaugauaagacaccccuacacaucauacggauacgaacccaugggaggauggcuacaccaccaaauaauaccaguagucucacaacaaacaccacaaucacacgcacuccaaccacaccaccacaucccaaugguaccagcacaacaaccaggaauaccacaacaaccaaugaugccacuaccaggacaacacucaaugacaccaacacaacaccaccaaccaaaccuaccacuacccgcccaacaaccauuccaaccccaaccaguacaaccacaaccacaccaaccacuccaaccacaaucaccaaugcacccaauacaaccacuacuaccacaaccaccacucccaccaauguucucaaugcaaucacuacucccagaccuaccacuagaagcauggccagcaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2433 - RNA, 3178 nt, Artificial Sequence
  mRNA product Design1 comprising derived and/or modified sequence from Homo sapiens__NP_006120.1__HsBMP1 (opt12)
gggagaaagcuuaccaugccugggguugcaagacuaccguuacuauugggauuacuacuauuaccaaggccaggaagaccauuagauuuagcagauuauacguaugauuuagcagaagaagacgauagugaaccauuaaauuauaaagauccauguaaagcagccgcguuuuuaggggacauagcacuagaugaagaagaucuaagagcauuucaaguacaacaagcaguugaccuaagaagacacacagcuagaaaaucaucaauuaaagccgcugucccgggaaauacgaguacaccgaguugucaaucuacuaacggacagccacaacguggugcaugcggaagauggagaggacgcucaaggagucggagagcggcaacaagcagaccagaaagggucuggccagauggaguaauaccuuucguaauaggaggaaauuuuacaggaagucaaagagcaguauuccgucaagcuaugagacauugggaaaaacauaccuguguaacguuuuuagaaagaacagaugaagauaguuacauaguguuuacguaucgaccaugcggauguuguucuuacguaggaagacgagggggugguccccaagcaauaucaauagguaaaaacugcgauaaauucgggauaguaguacaugaacuagggcauguaguuggauuuuggcaugaacacacacgacccgauagagauagacaugucucaauaguaagggaaaacauacaacccggacaagaauauaauuucuuaaaaauggaaccacaagaaguugaaaguuuaggugaaacguaugacuucgauaguauuaugcauuaugcacgaaauaccuuuaguagaggaauuuuucuugacacuauaguaccgaaauaugaaguaaaugguguaaaaccaccaauaggucaaagaacaagauuaucaaaaggagauauagcacaagcucgaaaacuguacaaaugcccagcuuguggugaaacauugcaagauucaacaggaaauuucaguagcccagaauacccaaacggauauagugcgcauaugcauugcgucuggaggauuaguguaacaccaggugagaaaauaauacuaaauuuuacgaguuuagacuuauaucgaagcagauuauguugguaugacuauguugaaguuagagauggauuuuggagaaaagcaccauuaagaggaagauuuuguggaucaaaacuaccagaaccaauaguaaguacagauaguaggcuuuggguagaguucagaagcucgaguaauuggguaggcaaaggauucuuugcagucuaugaagccauauguggaggggauguuaagaaagacuauggacacauacaaucaccuaauuauccggacgauuaccgaccaagcaaaguuuguauuuggcggauucaaguaagcgaagguuuccacguaggacuuacauuccaaucuuuugaaauugaacgccaugauaguugcgcauacgacuaucuagaaguaagagauggucauagcgaaaguucaacacuaauuggaagauacugcggauaugaaaaaccugacgauauaaaaucaacaagcagucgauuauggcuaaaauuugugagugacggaagcauaaauaaagcuggcuucgcuguaaacuuuuucaaagaaguagaugaauguaguagaccaaauaggggcggaugugaacaacguuguuuaaauacuuuaggcucguauaaaugcagcugugaucccggauaugaacucgcaccagauaaaagaagaugugaagcagcauguggaggauuuuugacaaaacuuaaugguuccauaaccaguccaggguggccaaaagaauauccgccaaauaaaaauugcauuuggcagcuaguagcuccaacucaauaccguaucaguuuacaauucgacuucuuugaaacagaaggcaaugacguaugcaaauacgauuuuguagaaguuagaucugggcuaaccgcugacaguaaauuacauggaaaauuuuguggcucagaaaaaccagaaguaaucacaucacaauacaauaacaugagagucgaguuuaaaagcgauaacacaguuaguaagaaagguuuuaaagcccauuucuuuagugauaaagaugaaugcucaaaagauaauggagggugucaacaagauugcguaaauacauuuggaagcuacgaaugccaauguagauccggauuuguacuccaugauaauaaacacgauuguaaagaagcaggaugugaccacaaaguaaccucuacaucggggacuaucacgaguccaaacuggccagauaaauacccuucaaagaaagaaugcacuugggcgaucaguucuacuccaggacauaggguuaaauuaacauuuauggaaauggacauagaaucacaaccugaaugugcuuaugaccauuuagaaguuuuugauggaagagaugcuaaagcgccuguuuuaggucgguuuugcggaaguaaaaagccugaaccugucuuagccacuggcucaaggauguuuuuaagguuuuauucagacaacucaguccaaagaaaaggauuucaagcaagucaugcgacagaaugcggaggccaaguacgagcagauguaaaaacaaaagaucuuuauucucaugcacaauuuggugauaauaauuauccuggaggaguugauugugaguggguaauaguagcagaagaagguuauggaguugaauuaguauuucaaacguuugaaguagaagaagaaaccgauugcgguuaugacuacauggaacuauucgaugguuaugauucaacagcuccuagauuaggaagauauugugggucaggcccgccagaggaaguauauagugcaggagauagcguucuaguaaaauuucacagcgacgacacaauaaccaagaaaggauuccaucuacgcuauacaucaacuaaauuccaagauacacuacauagcagaaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2434 - RNA, 1408 nt, Artificial Sequence
  mRNA product Design1 comprising derived and/or modified sequence from Homo sapiens__NP_001191.1__HsBMP2 (opt12)
gggagaaagcuuaccauggucgcaggaacaagaugucuacuagcacuauuacuuccacaaguucuacuaggaggagcagcuggauuaguaccagaauuaggaagaagaaaauuugcggcagcaucaucuggaagacccaguucacaaccaucagacgaaguauuaucagaauuugaacuuagacuacuuagcauguucggauuaaaacaacgucccacaccaucuagagaugcaguaguaccacccuauaugcuugaccuauacagacgucacagcggccaaccaggaucaccagcaccagaccauagacuagaaagagccgcaucaagagcaaacacaguaagaucauuccaccaugaagaaagcuuagaagaauuaccagaaacaucagguaaaacuacaagaagguuuuucuuuaacuuaagcucuauaccaacagaagaauuuauaacaucagcagaauuacaaguauucagagaacaaaugcaagacgcacuaggcaauaauagcagcuuucaccacagaauaaauauauaugaaauuauaaaaccagcaacagcaaacucaaaauuuccaguaacaagacuauuagacacacgacuaguaaaucaaaaugcaucaagaugggaauccuucgacguaacaccagcaguaaugagauggacagcacaaggacacgcaaaccauggauuuguaguagaaguagcucacuuagaagaaaaacaaggaguaaguaaacgucauguaagaauuagcagaaguuuacaucaagacgaacauuccuggucucaaauuagaccacuacuaguaacauucggacaugacggaaaaggacacccacuacacaaaagagaaaaacgacaagcaaaacauaaacaacguaaaagauuaaaauccucauguaaaagacauccauuauacguagauuucucagacguaggauggaacgacuggauaguagcaccacccggauaccacgcuuucuauugccauggagaaugcccauucccacuugcagaccaucuaaacagcacaaaucacgccauuguacaaacauuaguaaacagcguaaacuccaaaauaccaaaagcaugcugcguuccaacagaauuaagcgcaauaucaauguuauacuuagacgaaaaugaaaaaguaguacuaaaaaauuaccaagacaugguaguagaaggcuguggaugccgcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2435 - RNA, 1444 nt, Artificial Sequence
  mRNA product Design1 comprising derived and/or modified sequence from Homo sapiens__NP_001193.2__HsBMP4 (opt12)
gggagaaagcuuaccaugauaccaggaaauagaaugcuuaugguaguauuacuaugccaaguauuacuaggaggugcaucccaugccucauuaauaccagaaaccggcaaaaaaaaaguagcugaaauacaaggacaugcaggaggaagaagauccggacaaucacacgagcuacuaagagacuuugaagcuacauuauuacaaauguuuggauuacgaagaagaccacaaccuucaaaaucagcugucauuccagauuauaugagagacuuauauagauuacaaucuggugaagaagaagaagaacaaauccacucaacuggacuggaauauccagaaagaccagcuucaagagcuaauacuguucguucauuucaucacgaagaacauuuagaaaacauaccaggaacaagcgaaaauagugcauuuagauucuuauucaaccuauccagcauuccagaaaacgaaguaauaucaagugcagaauuaagauuauuucgugaacaaguagaucaaggaccagacugggaaagaggauuucacagaauuaacauauaugaaguuaugaaaccaccugcagaagucguaccaggucaccuaauaacaagauuauuagauacaagacuaguacaucauaacgucacaagaugggaaacuuuugacguaucaccagcaguauuacgauggacacgagaaaaacaaccaaauuacggucuagcaauagaaguaacacaccuacaucaaacaagaacccaccaaggacaacauguacgaauaucaagaucauuaccacaaggaagcggaaacugggcacaauuaagaccacuacuaguuacuuuuggacacgauggaagaggacacgcacuaacacggagaagaagagcaaaacguucaccaaaacaccauucucaaagagcaagaaaaaaaaauaaaaacugcagacgacauagcuuauauguagauuucucagauguaggguggaaugacuggauaguagcaccuccaggauaccaagcauuuuacugucacggugacuguccauuucccuuagccgaucacuuaaacucaacaaaucaugcaauaguacaaacacuaguaaacaguguaaacucaaguauaccuaaagcaugcugcguaccaacagaacuaucagcaauuucaauguuauaccuagacgaauaugacaaaguuguauuaaaaaauuaucaagaaaugguuguagaaggauguggauguagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2436 - RNA, 1759 nt, Artificial Sequence
  mRNA product Design1 comprising derived and/or modified sequence from Homo sapiens__NP_001709.1__HsBMP6 (opt12)
gggagaaagcuuaccaugccaggacuagguagaagggcccaauggcuauguuggugguggggucuauuauguucauguuguggacccccuccucuaagaccaccauuaccagcugcugcagcagcagcagccggcgggcaauuacuaggagauggaggcucgccaggaagaacagaacaaccaccaccaucaccacaaucaucaucagguuuccuauacagacgacuuaaaacacaagaaaaacgagaaaugcaaaaagaaauauuaucuguuuuaggucuaccacauagaccuagaccacuacauggccuacaacaaccucaaccuccagcccuucgccaacaagaagaacaacaacaacaacaacaauuaccaagaggugagccaccacccgguagauuaaaaucagcuccuuuauucauguuagauuuauacaacgcccuauccgccgauaaugaugaagauggagcaucagaaggcgagaggcaacaaucauggccgcaugaagcagcuucaucaucacaacgccgacaaccaccuccuggugcugcacauccauuaaaucguaaaagccuacuugcaccaggaucaggaucuggaggagccucaccacuaacaagcgcacaagauucagcauuucuaaaugacgcugauauggucaugaguuuuguaaaucuaguagaauacgauaaagaguucucuccaagacaaagacaucauaaagaauuuaaauuuaaucuaucucaaaucccagaaggagaaguaguaacagcggcagaauuuagaauauauaaagauuguguaaugggaucauucaaaaaucaaacuuuucuaauuucaauauaccaaguauuacaagaacaucaacaucgcgacucagaccucuuuuuacucgacacccgaguuguuugggcauccgaagaaggcuggcuagaauuugauauuacagcaacaucaaauuuauggguaguaaccccucaacauaacauggguuuacaauuaaguguaguaacaagagacggaguucacguccacccaagagcugcaggauuaguaggaagagauggaccauaugacaaacaaccauucaugguugcauucuuuaaaguuagugaaguucauguacgaacaacaagaucagcaaguucaagaagaagacaacaaucuagaaaccgaaguacacaaucacaagauguugcacgaguaucaucugccagugacuauaauucaucagaauuaaaaacagcauguagaaaacacgaauuauacguaucauuucaagauuuagguuggcaagacuggauaauagcaccaaaaggauacgcagcaaauuauugugacggcgaauguucauuuccuuuaaaugcacauaugaaugcaacaaaccaugcaauaguccaaacauuaguccacuuaaugaauccagaauacguaccaaaaccuuguugugccccaacaaaauuaaaugcaaucucaguacuauacuucgaugauaauucaaauguaauauuaaagaaauaccgaaauaugguaguaagagcuugcggcugucacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2437 - RNA, 1513 nt, Artificial Sequence
  mRNA product Design1 comprising derived and/or modified sequence from Homo sapiens__NP_001710.1__HsBMP7 (opt12)
gggagaaagcuuaccaugcaugucagaucacuuagagcagcagccccacauucuuucguagcauuaugggcaccauuauucuuauuaagaagcgcacuagcagacuuuucauuagacaaugaaguacauaguagcuuuauacauagacgccuaagaucacaagaaagacgagaaaugcaaagagaaauccuaucaauauuaggauuaccacauagaccaagaccucaucuacaaggaaaacacaacuccgcuccaauguucauguuagaccuauauaacgcaauggcugucgaagaaggaggagguccaggaggacaagguuuuaguuaucccuacaaagcaguauuuagcacacaaggcccaccacucgcaagcuuacaagauucccauuuccuaacagaugccgauaugguuaugaguuucguuaaucuuguagaacacgauaaagaauucuuccacccuagauaucaccaucgagaguucagauucgaucuuucaaaaauaccagaaggagaagccguuaccgcagcagaauuuagaauauauaaagauuacauccgcgaacgauuugacaaugaaacauucagaauaucaguauaucaaguacuacaagaacaucuagggagagaaucagaucuauuuuuauuagacucuagaacacuaugggcaucagaagaaggaugguuaguuuucgauauaacagccacaagcaaucacuggguaguaaacccuagacacaacuuaggauuacaauuaagcguagaaacacucgacggccaaaguauaaaccccaaacuagcaggacuaauaggacgacacggcccacaaaacaaacaaccauuuauggucgccuuuuucaaagcuacagaaguacauuuccgaucaauacgaucuacaggauccaaacaaagaucacaaaacagaucuaaaacaccaaaaaaucaagaagcauuaagaauggccaauguagcagaaaauagcucaucagaucaacgacaagcaugcaaaaaacaugaacuauacgugaguuucagagaucucggauggcaagauuggauaauagcaccagaaggauaugcagccuauuauugugaaggugaaugugcauuuccacuaaauucuuacaugaaugcaaccaaucacgcaauaguucaaacacuaguacacuuuauaaacccagaaacaguaccaaaaccuuguugcgcaccaacacaauuaaacgcaaucucaguauuauacuucgaugauaguucuaacguaauauuaaaaaaauacagaaacaugguagucagagcaugcgguugucacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2438 - RNA, 517 nt, Artificial Sequence; identical to SEQ ID NO: 1978
  mRNA product Design1 comprising derived and/or modified sequence from Homo sapiens__NP_006264.2__HsCCL7 (opt12)

SEQ ID NO: 2439 - RNA, 3841 nt, Artificial Sequence
  mRNA product Design1 comprising derived and/or modified sequence from Homo sapiens__NP_001954.2__HsEGF (opt12)
gggagaaagcuuaccaugcuacucacguugauaauauuauuaccaguaguaucaaaauucucuuuuguuagccuaagugccccacaacauuggucuuguccagaagggacguuagccgggaauggaaacaguacaugugugggaccugccccauuuuuaauauuuucacacggaaauuccaucuuuagaaucgauacugaagggacaaauuaugaacaauuaguuguagaugccgguguaucaguaaucauggacuuccauuauaaugaaaaacggauuuacuggguugaucucgaaagacaacuacuucaaagaguguuuuuaaaugggaguaggcaagaaagagucuguaauauugagaaaaauguaucaggaauggcuauaaauuggauaaacgaagagguaauauggucuaaucaacaagaagguauuauaacugugacugauaugaaaggaaauaacucacauauccuccuaucugcucuaaaauauccugcuaacguggcaguugauccagucgaacgauuuaucuuuuggucaucagaggucgcaggaucgcuauauagagcagacuuagaugguguaggaguaaaagcauuacuagaaaccagcgagaaaauaacugcaguaaguuuagauguacucgacaaaagauuauucuggauacaauacaauagagaaggaucaaauucacuaauauguucuugugacuaugauggcggaagcguccacauaucuaaacaccccacacaacauaauuuauuugcgaugaguuuauuuggugauagaauauuuuauaguacguggaaaaugaaaaccauauggauagcuaauaaacauacaggaaaagacaugguccgaauaaaccuacacucauccuuuguaccucuaggggaauugaaaguaguacauccacuagcacaaccaaaagcggaagacgacacaugggaaccggaacaaaaacucuguaaacucagaaaggguaauuguucgaguacuguauguggacaagaucuacaaagccauuuauguaugugcgcagaaggauaugcuuuaucaagagaucgaaaauauugcgaagaugucaaugagugugcauuuuggaaucauggauguacccuuggcugcaaaaauaccccaggcucauauuauugcacuuguccaguaggauuuguauuguuaccugauggaaagcgaugucaucaacuuguaaguuguccacgaaauguuagugaauguucacaugauugcguguuaacaucagaaggcccauuaugcuucugcccagaaggaucaguguuagaaagagauggcaaaacuugcaguggaugcaguagcccagacaaugguggauguagucaauuauguguuccguuauccccagugucgugggaaugugacuguuuuccaggauaugauuuacagcuagacgaaaaaucuugcgcagcaagcgguccacaacccuuuuuacuauuugcaaauucccaagacauucgucacaugcauuuugaugguacugauuaugguacauuauuaucacaacaaauggguaugguauaugcauuagaccaugauccugucgaaaacaaaauauauuucgcucauacagccuuaaaguggaucgaacgcgcuaacauggauggaagucaaagagaaaggcucauugaagaaggagucgauguacccgaaggcuuagcaguagacuggauaggccgccgauuuuauuggacagauagagguaaaagucuuauaggacguucagacuuaaauggaaaaagaaguaaaauuauaacaaaagaaaacauaucacaaccuaggggaauagcaguacauccaauggcaaaacgccucuuuuggacagauacaggcauaaauccuagaauugaaaguucuagcuuacagggacuaggccggcuaguaauugccucaucagaccuaauauggccaagugggauaaccauagauuuucucacggacaaauuguauuggugcgaugcaaaacagucaguaauagaaauggcuaaucucgaugguucaaagagaaggagauuaacacagaacgauguuggucacccauucgcaguagcaguauucgaggauuacgucugguuuucggauugggcaaugccaaguguaaugagaguaaacaaaagaacagguaaagauagaguacgauuacaaggauccauguuaaagcccuccucauuaguagucguucauccauuggcuaaaccaggagccgacccaugcuuauaccaaaauggugguugugaacacauuuguaagaaaagauuaggaacagccugguguucaugcagagaaggcuucaugaaagcaucagauggaaaaacaugccuagcauuagauggacaccaacuacuagcaggaggagaaguugaccucaaaaaccaaguaacgcccuuagauauauuaaguaaaacucgaguuagugaggacaacauaacagaaagucaacacauguuaguggcugaaauaaugguaagugaucaagacgauugugcaccaguaggauguucaauguaugcacgcuguaucucagaaggcgaagaugcaacuugccaaugccuaaaaggcuucgcgggcgauggaaaacuauguucagacauagaugaaugugaaauggguguuccuguaugucccccagcguccucaaaaugcauaaauaccgaaggcggcuauguaugucguuguucagaaggguaccaaggugauggaauccauuguuuagauauagacgaaugucaauuaggcgaacauaguuguggugagaacgcuucuugcaccaacacagaaggagguuacacauguaugugcgcagggaggcuaagugagccaggauuaauuuguccagauaguacaccaccuccccaccuaagagaggaugaucaucauuacucaguaagaaauucagauagugaauguccauuaucucacgaugguuacugccuacaugacgguguaugcauguauauagaagccuuagauaaauaugcuuguaacuguguagucggcuacauaggagaaaggugucaauauagggaccuaaaauggugggaauuacgacaugcuggccaugggcaacaacaaaaaguaauaguuguagcagucugugucguaguucuaguaaugcuccucuuacuaucccuauggggugcucauuauuaccgaacgcaaaaacuucugaguaaaaauccuaaaaauccauacgaagaaucaucaagagauguacgaucaaggagaccagccgauacagaagaugggaugucgucuugcccacagccaugguucguuguaauaaaagaacaccaagauuugaaaaacggaggucaaccugucgcaggagaggauggacaagcugcagaugguaguaugcaacccacaaguuggagacaagaaccccaauuaugcggaaugggaacggaacaagggugcuggauuccaguaucgagcgacaaagggucuugcccccaaguaauggaaagaucguuccauaugcccucauacggaacgcaaacuuuagaaggaggaguagagaaaccacauuccuuacuaagcgcaaauccauuauggcaacaacgagcuuuagauccaccacaucaaauggaauugacacaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2440 - RNA, 727 nt, Artificial Sequence
  mRNA product Design1 comprising derived and/or modified sequence from Homo sapiens__NP_001423.1__HsEREG (opt12)
gggagaaagcuuaccaugacagcaggaagaagaauggaaaugcuaugugcaggaagaguaccagcacuauuacuaugucuaggauuccaucuauuacaagcaguauuaaguacaacaguaauaccaagcuguauaccaggagaaagcucagacaauugcacagcauuaguacaaacagaagacaauccaagaguagcacaaguaagcauaacaaaaugcucaagugauaugaauggauauugcuuacacggacaauguauauaucuaguagacaugagccaaaacuauugcagaugcgaaguaggauacacgggaguaagaugugaacacuucuuucuaacaguacaucaaccacuaucaaaagaauacguagcauuaacaguaauauuaauaauacuauuucuaauaacaguaguaggaagcacauacuauuucuguagaugguacagaaacagaaaaucaaaagaaccaaaaaaagaauaugaaagaguaacaucaggagauccagaacuaccacaaguauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2441 - RNA, 685 nt, Artificial Sequence
  mRNA product Design1 comprising derived and/or modified sequence from Homo sapiens__NP_000791.1__HsFGF1 (opt12)
gggagaaagcuuaccauggcagaaggagaaauaacaacauucacagcacuaacagaaaaauucaaccuaccaccaggaaacuacaaaaaaccaaaacuacuauacugcucaaacggaggacacuucuuaagaauacuaccagacggaaccguagacggaacaagagacagaucagaccaacacauacaacuacaauuaucagcagaaucaguaggagaaguauacauaaaauccacagaaacaggacaauacuuagcaauggacacagacggacuacuauacggaucacaaacaccaaacgaagaaugccuauuccuagaaagacuagaagaaaaccacuacaacacauacauaucaaaaaaacacgcagaaaaaaacugguucguaggacuaaaaaaaaacggaucaugcaaaagaggaccaagaacacacuacggacaaaaagcaauacuauuccuaccccuaccaguauccucagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2442 - RNA, 1084 nt, Artificial Sequence
  mRNA product Design1 comprising derived and/or modified sequence from Homo sapiens__NP_001997.5__HsFGF2 (opt12)
gggagaaagcuuaccaugguaggggugggaggaggagacguagaagacguaacaccaagaccaggaggaugucaaauaaguggaagaggagcaagagguuguaauggaauaccaggagcggcagcaugggaagcagcauuaccgagaagaagaccgagaagacacccaaguguaaauccuagaucaagagcagcuggaagcccaagaacacgaggaagaagaacagaagaaaggccuaguggaaguagauuaggggacagaggaagaggaagagcauugccaggaggaagacuaggcggaagaggaagaggaagagcaccagaaagaguaggagguagaggaagaggaagaggaacagcagcaccaagagcagcaccagcagcaaggggaaguagaccaggaccagcgggaacaauggcagcaggaaguauaacaacacuuccagcauugccagaagauggaggaaguggcgcauuuccgccaggacauuuuaaagauccaaagagauuauacuguaaaaauggagguuuuuuuuuaagaauacauccagauggaagaguagauggaguaagagaaaaaagugauccacauauaaaauuacaauuacaagcagaagaaagaggaguaguaaguauaaaaggaguaugugcaaacagauauuuagcaaugaaagaagauggaagauuacuagcaaguaaauguguaacagaugaauguuuuuucuuugaaagauuagaaaguaauaauuauaauacguaccgaaguagaaaauauacaaguugguauguagcguuaaaaagaacaggacaauauaaauuaggaagcaaaacaggaccgggacaaaaagcaauauuauuuuuaccuaugagugcgaaaaguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2443 - RNA, 802 nt, Artificial Sequence
  mRNA product Design1 comprising derived and/or modified sequence from Homo sapiens__NP_002000.1__HsFGF7 (opt12)
gggagaaagcuuaccaugcacaaauggauacuaacauggauacuaccaacacuacuauacagaagcugcuuccacauaauaugcuuaguaggaacaauaagccuagcauguaacgauaugacaccagaacaaauggcaacaaauguaaacugcagcucacccgaaagacacacaagaucauacgacuacauggaaggcggagacauaagaguaagaagacuauucugcagaacacaaugguacuuacgaauagacaaaagaggaaaaguaaaaggaacacaagaaaugaaaaacaacuacaacauaauggaaauaagaacaguagcaguaggaauaguagcaauaaaaggaguagaaucagaauucuaccuagcaaugaacaaagaaggaaaacuauacgcaaaaaaagaaugcaacgaagacugcaacuucaaagaauuaauacuagaaaaccacuauaacacauacgcaagcgcaaaauggacacacaacggaggagaaauguucgucgcacuaaaccaaaaaggaauaccaguaagaggaaaaaaaacaaaaaaagaacaaaaaacagcacacuuccuaccaauggcaauaacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2444 - RNA, 844 nt, Artificial Sequence
  mRNA product Design1 comprising derived and/or modified sequence from Homo sapiens__NP_001936.1__HsHBEGF (opt12)
gggagaaagcuuaccaugaaacuacuaccaagcguaguacuaaaacuauucuuagcagcaguacuaagcgcacuaguaacaggagaaagccucgaaagacuacgaagaggccuagccgcagguacaucaaacccagacccaccaacaguaucaacagaccaauuacuaccacuaggaggaggaagagacagaaaaguaagagaccuucaagaagcagaccuagaucuacuaagaguuacauuaucaucaaaaccacaagcacuagcaacaccaaacaaagaagaacacggaaaaagaaaaaaaaaaggaaaaggacuaggcaaaaaaagagacccaugcuuaagaaaauacaaagacuucugcauacacggagaaugcaaauacguaaaagaacuaagagcaccaucaugcauaugccacccaggauaucacggagaaagaugccacggauuaagccuaccaguagaaaauagacuauacacauacgaccacacaacaauacuagcaguaguagcaguaguacuaucaucaguaugucuacuaguaauaguaggacuauuaauguucagauaccacagaagaggcggauacgacguagaaaacgaagaaaaaguaaaacuaggaaugacaaauucacacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2445 - RNA, 2404 nt, Artificial Sequence
  mRNA product Design1 comprising derived and/or modified sequence from Homo sapiens__NP_000592.3__HsHGF (opt12)
gggagaaagcuuaccauguggguuacaaaacuauuacccgccuuacuauuacagcaugucuuacuacaucuauuacuauuacccauagcuauaccauaugcugaaggccaacguaaaagaagaaauacaauucaugaauuuaaaaaaucagcuaaaacaacauuaauaaaaauagacccagcuuugaaaauaaaaacaaaaaaaguaaacaccgcagaucaaugugcaaaucgauguacacgaaacaaaggauuacccuuuacauguaaagcauuuguauuugauaaagccagaaaacaaugcuugugguuuccuuucaacucaaugucaucaggaguaaaaaaagaauuuggccacgaauucgaucuauaugaaaauaaagauuauauaagaaauuguauaauaggaaaaggacgaucauauaaaggaacaguaaguauaacaaaaagcggaauaaaaugucaaccgugguccaguaugauaccacaugaacauucauuuuuaccaucaucauaccgagguaaagacuuacaagaaaauuacugcagaaauccacgaggagaagaaggaggaccauggugcuucacaucaaauccagaaguucgauaugaaguaugugacauuccucaauguucagaaguagaaugcaugacuuguaauggagaaucuuauagagguuuaauggaccauacagaaaguggaaaaauaugccaacgaugggaucaccaaacaccacauagacacaaauuccuaccagaaagauacccagacaaaggauuugaugauaacuacuguaggaacccggauggacaaccaaggccauggugcuauacauuagauccacauaccagaugggaauauugugcaauaaaaacuugugcagauaauacaaugaaugacaccgauguaccacuugaaaccacagaauguauacaaggucaaggagaaggauaucgaggaacaguaaauacaauauggaauggaauaccgugucaacgaugggauagucaauacccccaugaacaugacaugacaccagaaaauuuuaaaugcaaagaucuaagggaaaauuauuguaggaauccagauggaucagaaucaccuugguguuucaccacagauccaaauauacgcguuggauauuguucacaaauaccaaauugcgacaugagucacggacaggauugcuauagagguaauggaaaaaauuauaugggaaaccuaucacaaacaagaucaggucuaacaugcucaaugugggacaaaaacauggaagauuuacauaggcacaucuucugggaaccagaugcaagcaaauuaaaugaaaauuauugucgaaauccagaugacgacgcacauggaccaugguguuacacaggaaacccacuaauaccaugggacuauugccccauaucaagaugcgaaggagauacuacacccacuauaguaaaucuagaucacccuguaauaucaugugcaaagaccaaacaacucaggguaguaaacggcauaccaacucgaaccaauauuggauggaugguuucacuaagauaccgcaacaagcauauaugcggaggaagccuaauuaaagaaucauggguauugacagcaagacaauguuucccaagccgagaccuuaaagauuaugaagcaugguuaggaauacacgacguacauggcagaggagaugaaaaaugcaaacaaguacuuaacguuucucaauuagucuacggaccagaaggauccgacuuaguacuaaugaaauuagcaagaccagcaguucuagaugauuuuguaucuacaauagaucuaccaaacuacggauguacaauaccugaaaaaacaagcugcaguguauacggaugggguuauacuggccuuauaaauuaugacggacuccuaaggguagcucauuuauauauaaugggaaaugaaaaaugcucccaacaucaucguggaaaaguuacacuaaaugaaucagaaauaugcgcaggugcagaaaaaauagguucaggaccaugugagggagauuaugguggaccauuaguuugugaacaacauaaaaugcgaaugguccuaggaguaauuguaccaggaagaggaugcgcaauaccuaauagacccggaauuuucgucagaguagcauacuaugcuaaauggauacauaaaauaauacuaacguauaaagugccucaaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2446 - RNA, 2143 nt, Artificial Sequence
  mRNA product Design1 comprising derived and/or modified sequence from Homo sapiens__NP_005336.3 __HsHSPA1A (opt12)
gggagaaagcuuaccauggcaaaagcagcagccauaggaauagaucuugguacaacauauucaugcguaggcguauuucaacauggaaaaguagaaauaauagcaaacgaccaaggcaaccgaacaacaccauccuacguggcuuucacagacacagaaagacuaauuggcgaugcagcuaaaaaucaaguugcauuaaauccacaaaacacaguauuugacgcaaaaagacucauaggaagaaaauuuggggauccuguaguccaaagcgauaugaaacacuggcccuuucaaguaauaaacgacggcgacaaaccaaagguacagguaaguuauaagggagaaacaaaagcauuuuaccccgaagaaaucagcagcaugguauuaacuaaaaugaaagaaauagccgaggcauauuuaggauauccaguuacaaacgcagucauaacuguaccagcauacuuuaaugauucacaaaggcaagcaacaaaagaugcaggaguaauagcuggauuaaacguauuaagaauaauaaacgaaccaacagcagcagcaauagcguaugguuuagaccgaacaggcaaaggagagagaaacguacuaaucuuugaucuaggaggaggaacauucgauguaucaauauuaacaaucgaugacggaauauucgaaguuaaagcaacugcaggagacacacacuuaggaggagaagauuuugauaacagauuaguaaaccacuuuguagaagaauuuaaacgaaaacauaagaaagacauuucacaaaauaaaagggcuguaagaagacuaagaacagcuugcgaaagagcuaaaagaacacuaagcagcucaacacaagcaagucuagaaauagacaguuuauuugaaggaaucgauuucuacacaucaauaacaagagcacgauuugaagaacuauguagugaccuauuuagaagcacucuagagccugucgaaaaagcauuaagagaugcuaaauuagacaaagcacaaauacacgaucuaguucuaguaggaggaucaacucgaauccccaaaguacaaaaacuauuacaagauuucuucaaugguagagaccucaauaaaaguauuaauccagaugaagcagucgcauauggugcugcaguacaggccgcaauuuuaaugggggauaaauccgaaaacguccaagaucuauuauuauuagacguagcaccauuaucacuagguuuagaaacagcuggagggguaaugacugcauuaauaaaaaggaacaguacaauaccgacaaaacaaacacaaauauuuacaacauacucagauaaucaaccaggaguuuuaauucaaguauacgagggagaacgcgcaaugacaaaagacaacaaucucuuaggccgguuugaacuaucagguauaccuccagccccuagagguguuccacaaauagaaguaacauuugauauugacgcuaaugguauccuaaacgucacagcaacugacaaaucaaccggaaaagcaaauaaaaucacaauaacaaaugauaagggaagacuuaguaaagaagaaaucgaaagaaugguacaagaggcagaaaaauauaaagcggaagacgaaguacaaagagaaagaguaagugcuaaaaacgcgcuugaauccuaugcauucaauaugaaaucagcagucgaggacgaaggauuaaaaggaaaaauaagugaagcagacaaaaagaaaguuuuagauaaaugccaagaaguuauuucaugguuagaugcaaauacauuagcagaaaaagacgaguucgaacauaaaaggaaagaacuagaacaaguauguaauccuauaauaagcggauuauaccaaggugcgggagguccaggacccggugguuucggugcucaaggaccuaaaggcggcaguggaaguggaccaacuauagaagaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2447 - RNA, 2143 nt, Artificial Sequence
  mRNA product Design1 comprising derived and/or modified sequence from Homo sapiens__NP_005337.2 __HsHSPA1B (opt12)
gggagaaagcuuaccauggcuaaagcagcagcaaucggaaucgauuuagggacaacauacagcuguguaggaguauuccaacacggaaaaguugaaauaauagcaaaugaucagggaaacaggacaacuccuagcuauguugcauuuaccgauaccgaacgucucauuggagaugcggcaaaaaaucagguagcauuaaacccccaaaacacaguauuugacgcuaaaagauuaauaggacgaaaauucggagauccgguuguacaaagcgacaugaaacacuggccauuucaaguaauaaaugauggagacaaaccaaaaguccaagucucuuacaaaggagaaacaaaagcauucuacccagaagaaauaucaaguauggucuuaaccaaaaugaaagaaauagcagaagcauacuuaggguacccaguaacaaaugcaguaauaacaguucccgcauauuuuaacgauagccaaagacaagcuacuaaagacgcaggaguaaucgcaggauuaaauguacuuagaauuauaaaugagccaacugcagcagcaauugcauauggauuggacaggacuggaaaaggagaaagaaacguauuaauauuugaccuaggaggaggcacauuugacguaucaauauuaaccauagacgacggaauauucgagguaaaagcaacagcaggagacacccauuuaggaggagaagauuucgauaaucgauuaguaaaucauuuuguagaagaauuuaaaagaaaacauaaaaaagauauaucacaaaauaaaagagcaguuagacgauuacgaacagcuugcgaaagagcaaaaagaacccuaaguucuagcacacaagcuagccuugaaauugauucccuauuugaaggcauagauuucuauacaagcaucacucgagcaagauuugaagaauuaugcagugacuuauuuagaucaacucuagaaccuguagaaaaagcgcuuagagacgccaaauuagauaaagcacaaauccaugauuuagucuuaguaggaggaucaaccagaauacccaaaguacaaaaacuauuacaagacuucuucaacggaagagaucuaaauaaaucaauaaauccugacgaggcaguugccuacggagccgcgguacaagcagcaauacuaaugggagacaaaagcgaaaacguacaagaucuauuacuucuagauguagcaccucuaaguuuaggauuagaaacagcaggaggaguaaugaccgcacuaauaaaaaggaauucaacgauaccaacaaaacaaacucaaauuuucacaacauacucagacaaucaaccuggaguacuaauacaaguauacgaaggagagagagcaaugacaaaagauaacaaucuauugggaagauucgaacuaucaggaauacccccggcgccacgaggaguaccgcaaauugaaguaacuuuugauauagaugccaauggaauauuaaauguaaccgcaaccgauaaaagcacuggaaaagcaaauaaaauaacaauaacaaaugacaaaggaagacuaucaaaagaagaaauagaacgaaugguccaagaagcagaaaaauacaaagcagaagacgaaguacaacgagaacgaguuucagccaaaaaugcauuagaaucauacgcauuuaacaugaaaagugcaguagaagacgaaggacuaaaaggaaaaaucucagaagcagauaaaaaaaaaguacuggauaaaugucaagaagucauaaguugguuagacgcaaauacauuagcagaaaaagacgaauucgaacacaaaagaaaagagcuagaacaagucuguaacccuauaauaaguggacuauaccaaggagcgggaggaccaggaccaggagguuuuggugcacaagguccaaaaggcggaagcggcagcggaccuacaauagaagaaguagauuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2448 - RNA, 2143 nt, Artificial Sequence
  mRNA product Design1 comprising derived and/or modified sequence from Homo sapiens__NP_005518.3 __HsHSPA1L (opt12)
gggagaaagcuuaccauggcuacagcaaaaggaauagcuauuggaauagaucuaggcacaacauacaguugcguuggcguuuuucagcauggaaaaguagaaauuauagcaaaugaucaaggaaaucgcaccacuccuucuuauguagcuuucacagauacagaacgacuuauaggagacgcugcuaaaaaccaaguugcaaugaacccacaaaauacugucuuugacgcaaaaagacuaauaggccgaaaauucaaugacccaguaguacaagcggacaugaaacuuuggccauuccaagugaucaacgaaggugguaaaccaaaaguauuaguaucauacaaaggagaaaauaaagcauuuuacccagaagaaauaagcucuaugguacugacuaaauuaaaagaaacagcagaagcauuucuaggacacccaguaacaaaugcaguaauaacaguacccgcuuacuuuaaugacucccaaagacaagcaacaaaggacgcaggaguuauagcaggacuuaauguacuuagaauaaucaacgaaccaacagcggcagcaauagccuauggauuagauaaaggaggacaaggagaacgacauguauuaauauuugaccuagguggagguacauucgaugucucuauauuaaccauagacgacggaauauucgaaguaaaagcaacagcaggggacacucauuuaggcggagaagauuuugacaauagauuaguaagccacuucguagaagaguucaaaagaaaacacaaaaaggauauaagucagaauaaacgagcaguaagaagacuacgaacagccugugaaagagcuaaaagaacguuaucaaguucaacacaagcaaaucuagaaauagacagucuauaugaaggaauagauuucuauaccucaauaacgagagcuagauuugaagaacuaugcgcagaucuauucagaggcacacuagaaccaguagaaaaagcucuacgagaugcaaaaauggacaaagcuaaaauucaugauauaguccuuguagggggaucaacaagaauaccaaaaguacaaagauuguuacaagauuacuuuaacggaagagauuuaaacaaaucaauaaacccagaugaagcuguagcauauggcgcagcaguacaagcagcaauacuuaugggagauaaaagugaaaaaguacaagauuuauuauuauuagacguagcaccacuaucccuaggacuagaaacagcaggaggaguaaugacagcacucauaaaaagaaauaguaccauaccaacaaaacaaacccaaauauuuacaacguauagcgacaaucaaccaggaguacuaauacaaguguaugaaggagaaagagcaaugaccaaagauaauaaucuucuuggccgauucgaucucacaggaauaccuccagcaccaagaggagucccacaaauugaaguuacauuugacauagacgccaaugguauacuaaacguaacagcuaccgauaaaaguacaggaaaaguaaacaaaaucacaaucacaaaugacaaagguagauuaucaaaagaggaaaucgaaagaaugguauuggacgcagaaaaauauaaagcagaagacgaaguacaaagagagaaaauagcagcuaaaaacgcucuugaaucauaugcauuuaacaugaaaucaguaguauccgacgaaggacucaaaggaaaaauaagcgaaucagauaaaaauaaaauacucgauaaaugcaacgaacuauuaagcugguuagaaguaaaucaacuagcagaaaaagaugaauuugaccauaaaagaaaagaacuagaacaaauguguaauccaauaauaacuaaauuauaccaaggaggaugcacaggaccagccuguggcacaggauauguuccuggacgacccgcaacuggaccaacaauagaagaaguugauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2449 - RNA, 2137 nt, Artificial Sequence
  mRNA product Design1 comprising derived and/or modified sequence from Homo sapiens__NP_068814.2 __HsHSPA2 (opt12)
gggagaaagcuuaccaugagcgcaagaggaccagcgauuggaaucgaucuaggaacaacguacaguugcgugggaguauuccaacauggaaaaguugaaauaaucgcaaaugaucagggaaauagaacuacaccaucauacguugcuuuuacagacaccgaaagauugauuggagacgcagcgaaaaaucaaguagcaaugaauccaaccaacacaaucuuugacgcaaaaagacucauaggcagaaaauucgaagacgcaacgguacagagcgauaugaaacacuggccauuuagaguaguaucagaaggaggaaaaccaaaaguacaagucgaauauaaaggagaaacuaaaacauuuuucccagaagaaauaagcaguaugguauuaacaaaaaugaaagaaauagcagaagcauaucuaggaggaaaaguucauagugcaguaauaacuguaccagcauauuuuaaugauucacaaagacaagccacgaaagaugccggaacaauaaccggauuaaauguacugagaauaauaaacgaaccaacagcugccgcaauagcauacgggcuagauaagaaaggaugugccggaggugagaaaaauguauuaauauuugacuuaggcggaggaacauuugauguaucaauacuaacaauugaagacggaauauucgaaguuaaaaguacggcgggagauacacauuuaggaggagaagauuuugauaacagaaugguaagucauuuagcagaagaguucaaacgaaaacacaagaaagacauaggaccuaauaaaagagcaguaagaagacuaaggacugcaugcgaaagagcaaaaagaacacuaaguagcaguacacaggcgaguauagaaauagacucauuauaugaaggagucgauuuuuauacuucaauaacgagagcaagauucgaagaacucaaugcggauuuauuuagaggaacauuggaaccaguagaaaaagcacuuagagaugcaaaacuagacaaaggacaaauccaagaaauaguccuaguagguggcucaacaagaauaccaaaaauccaaaaacuauugcaagauuucuucaauggcaaagaauuaaauaagucaaucaauccagacgaagcagucgcauacggagcagcaguucaagcagcaauauugauaggggauaaaucagaaaauguacaagaccuauuauuguuagauguaacaccauuaagucucgguauagaaacugcaggaggaguaaugacaccucuaauaaaaagaaacacaacuauaccaacaaaacaaacacaaacauuuacaacauacagugacaaucaaucaaguguauuaguacaaguauacgaaggagaaagagcaaugacgaaagacaacaaucuauuaggaaaauuugaucuaacagggauuccuccagcaccgagagguguaccacaaaucgaaguaacauuugacauagacgcaaauggaauauuaaacguaacagcagcagauaaaucaaccgggaaagaaaacaaaaucacaauaacuaacgauaaagggagguuaagcaaagaugauaucgaucguaugguccaagaagcagaaagauauaaaagcgaggaugaggcaaacagagacagaguagcagcgaaaaaugcauuagaaucuuacacguauaauauaaaacaaacuguagaggacgaaaaauuacggggaaaaauauccgaacaagauaaaaacaaaauauuagauaaaugccaagaagucauaaacugguuagacagaaaucaaauggcagaaaaagaugaauacgaacauaaacagaaagaacuagaaagaguguguaaucccauaauaucaaaauuauaccaaggagguccaggagguggaagcgggggaggaggaaguggcgcaagcggagggccaacaauagaagaaguagauuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2450 - RNA, 2740 nt, Artificial Sequence
  mRNA product Design1 comprising derived and/or modified sequence from Homo sapiens__NP_002145.3 __HsHSPA4 (opt12)
gggagaaagcuuaccaugucuguaguaggaauagaccucggauuucaaaguuguuauguagcagucgcucgggcaggaggcauugaaacaauugcaaaugaauacucagacagguguacaccagcaugcauaaguuucggaccaaaaaaccgaucaauaggcgcagcagcaaaaagccagguaauaucaaaugcuaaaaauacaguacaaggguuuaaaagauuccacggaagagcauuuucagauccuuuuguagaagcugaaaaaaguaauuuagccuacgacauaguucaguuaccaacaggauuaacaggcauaaaaguaacuuauauggaagaagaacgaaacuuuacaacugaacaaguaacagcaaugcuacuaucuaaauuaaaagaaacugcagaaaguguuuuaaaaaaaccaguaguagacuguguaguaagcgugccauguuuuuauacagacgcggaaagaagaucggucauggaugcaacacaaauagcagggcucaauugccuuaggcucaugaaugaaacaacugcaguagcucuagcuuacggaauuuauaaacaagacuugccagcacuagaagagaaaccaagaaacgucguuuucgucgauaugggacacucagcauaccaaguaaguguuugcgcauuuaauagaggaaaacuaaaaguauuggcaacagcauuugacacaacacuaggagguagaaaauucgaugaaguacuagucaaucacuuuugugaagaauucggaaaaaaguacaaacuagauauuaaaucaaaaauuagagcauuauugcgacuaagccaagaaugugaaaaacuaaaaaaauuaaugucagcaaaugcaucugacuuaccauuaagcauugaaugcuuuaugaaugauguagaugucucaggaacaaugaaucgaggaaaauucuuagaaauguguaacgaucuacuagcuagagucgaacccccucucaggucagugcuagaacaaacaaaacuaaaaaaagaagauauauacgccguggaaaucguagguggagcuaccagaauaccagcugugaaagagaaaauaaguaaauucuucggcaaagaauuaucaacaacacuaaaugcagacgaagcaguuacccgaggaugugcuuuacaaugugcaauuuuaucgccagcauucaaaguacgagaauucucaauaacagauguaguaccuuaucccauaucucuuagauggaauucaccagcagaagagggaagcucagauugcgaaguauuuucaaaaaaccacgcugcaccguuuuccaaaguacugacuuucuacagaaaagaaccauuuacguuagaagcauacuauucaucuccccaagacuuaccauacccagaucccgccauugcacaauucucaguacaaaaggugaccccacaauccgacggauccagcucaaaagugaaaguaaagguaagaguaaauguacacggcauauuuucaguaaguucagcgucccucguagaaguucacaaaagcgaagaaaacgaagaaccaauggaaacagaccaaaacgcaaaagaagaagaaaaaaugcaaguagaccaagaagaaccccauguagaagaacaacaacaacaaacacccgcagaaaacaaagccgaaagugaagaaauggaaacaucacaagcaggcaguaaagauaagaaaauggaucaaccaccacaggcaaaaaaagcuaaaguaaaaacaaguacaguagaucucccaauugaaaaucaacuacuauggcaaaucgauagagagauguuaaaccuauacaucgaaaaugaaggaaaaaugaucaugcaagacaaacuagaaaaagaacggaacgaugcaaaaaacgcaguggaagaguauguauaugaaaugcgagacaaacuaucaggagaauaugaaaaauuuguuagcgaggaugacagaaauucauucaccuuaaaacuagaagauacugaaaauugguuauaugaagacggagaagaccaaccuaagcaaguguacguugauaagcuagcagagcucaaaaauuugggccagccaauaaaaauaagauuccaagaauccgaagaaagaccgaaacuauucgaagaacuugggaaacaaauacagcaauacaugaagauaaucucaucauuuaaaaacaaagaagaucaauacgaccacuuagacgcagcagacaugacuaaaguagaaaaaucuacgaacgaagcaauggaauggaugaauaacaaacuaaaucuucaaaacaaacaaucacuuacaauggacccaguaguaaaaagcaaagaaaucgaagcgaaaauaaaagaauuaacgagcacauguucaccuauaauaucaaaaccaaaaccaaaaguggaaccaccuaaagaagaacaaaaaaaugcagaacaaaauggaccgguagacgggcaaggagacaauccaggaccucaagcagccgaacagggcacagacacagcaguaccaucagacagcgacaaaaaacuaccggaaauggacauagacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2451 - RNA, 2737 nt, Artificial Sequence
  mRNA product Design1 comprising derived and/or modified sequence from Homo sapiens__NP_055093.2 __HsHSPA4L (opt12)
gggagaaagcuuaccaugagugugguaggaauagaccuuggauuccuaaauugcuacauagcuguagcaagaucaggaggcauugaaacaauagcaaacgaauauagcgaccgaugcacaccagcaugcauaucauuaggaaguaggacuagagccauagguaaugcggcaaaaucacaaauaguaaccaauguaagaaacaccauacauggauucaagaaacuacacggacgcagcuucgacgauccaauaguacaaacagaaagaauuagacuacccuacgaacuacagaaaaugccaaacggaucugcaggagucaaaguaagauaccuugaagaagaacggccauuugcaauugaacaagugacaggaauguuacuugcaaaacuaaaagaaacaagugaaaaugcauuaaagaaaccaguagcagauugcguaauuucaauacccagcuucuucacagacgcagaaagaagaaguguaauggcagcagcacaaguagccggacuaaacugucuaagacuaaugaacgaaacaacagcuguagcuuuagcauacggcauauauaaacaagaucuaccaccacuagaugaaaaaccaagaaacguaguuuuuauagauaugggacacucagccuaccaaguccuaguaugugcuuucaacaaaggaaaauuaaaaguacuugcaacaacauuugauccauaucuaggggguagaaauuucgacgaagcucuaguagacuacuuuugugaugaguucaaaacaaaauacaaaauuaaugucaaagaaaauucaagagcauuacucagacuuuaccaagaaugcgaaaaauuaaagaaacuaaugucugcaaaugcauccgauuuaccgcuaaauaucgaaugcuuuaugaaugaucuugacguaucaagcaaaaugaacagagcacaauuugaacaacuaugugcauccuuauuagcaagaguagaaccuccccuaaaagcgguaauggaacaagcuaaucuccaacgcgaagacauaagcucaauagaaauaguaggcggagcaaccagaauaccggcagugaaagaacaaauaacaaaauuuuucuuaaaagacauuucuacaacuuuaaacgcagacgaagcuguggcuagagguugcgcacuucaaugcgccaucuuaucaccagcguucaaaguccgcgaguucaguauaacagaccugguaccauacaguaucacgcuccgauggaaaacuagcuuugaagacggcucuggggaaugcgaaguauucuguaaaaaucacccagcaccauuuagcaaaguaauaacauuucacaagaaagaaccauucgaacuagaagcauucuacacaaacuuacaugaaguucccuacccagaugcacgaauagguaguuucacaauacaaaauguauucccacaauccgacggagacucaucuaaagucaaagucaaagugcggguaaacauacauggaauauucuccguugcaagugcaagugugauagaaaaacaaaaccucgaaggggaucauucagacgcaccuauggaaacggaaacaaguuucaaaaacgaaaacaaagauaauauggacaaaaugcaaguagaucaagaagaaggacaccaaaaaugccaugcggaacauacucccgaagaagaaauagaucauacaggugcuaaaacaaaaucagcaguauccgacaaacaagacaggcuaaaucaaacacucaagaaaggaaaaguaaaaaguauagaccugccgauacaaagcagucucugucgacaauuaggacaagauuuacuaaauaguuacauagaaaaugaagggaaaaugauuaugcaagauaaauuagaaaaagaaaggaacgaugccaaaaaugcuguugaagaauacguauaugacuuucgcgacagauuaggaacaguauacgaaaaauuuauaacccccgaagaccuaaguaaacuaucugcaguacuagaagacacagaaaauugguuauaugaagauggagaagaucagccaaaacaaguuuacguagauaaacuacaagagcuuaagaaauacggacaaccaauucaaaugaaauauauggaacaugaagaacgcccgaaagcauuaaacgacuuaggaaagaaaauacaauuaguaaugaaaguaauagaggccuacagaaacaaagaugaaagguaugaccaccucgaucccacagaaauggaaaaaguugaaaaaugcauaucagacgcuaugucauggcuaaacagcaaaaugaacgcccaaaacaaauuaucacuuacucaggauccuguaguaaaaguaagcgaaauaguagcgaaaagcaaagaacuagacaacuuuuguaacccuauaaucuauaaaccuaaacccaaagcagaaguaccagaggauaaacccaaagccaauucugaacauaaugggccaauggauggacaauccggcacagaaacaaaaucggacaguaccaaagacucaucacagcacacaaaaagcaguggagaaauggaaguugacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2452 - RNA, 2182 nt, Artificial Sequence
  mRNA product Design1 comprising derived and/or modified sequence from Homo sapiens__NP_005338.1__HsHSPA5 (opt12)
gggagaaagcuuaccaugaaacucucacuaguagcagcgauguuauuacuuuuaagugcugcacgagcagaggaagaagauaaaaaagaagacguagguacaguaguagguauagaccuaggaacaacauacucauguguaggaguauucaagaauggacgaguagaaauuauagcaaaugaucaaggcaauagaauaacaccaaguuauguagcuuucacacccgaaggagaaagauuaauaggggacgcagcuaaaaaccaauuaacaagcaauccagagaacacaguauuugacgcaaaaagauuaaucggcagaacauggaaugaccccucuguacaacaagauauuaaauuucuaccguuuaaagugguagaaaaaaaaacaaaaccuuauauacaaguagacauaggaggaggacaaacgaaaacauucgcuccagaagaaauaagcgcaaugguuuuaacuaaaaugaaagaaacagcggaagcauauuuaggaaaaaaaguaacucacgcuguaguaacagucccagcauacuuuaacgaugcucaaagacaagccacaaaagaugcaggaacaauugcaggcuuaaauguaaugagaauaauaaaugaaccuacagcagccgcaauagcguacggacuagacaaaagagaaggcgaaaaaaacauacuaguauuugauuuaggaggaggaacauucgauguaagucuacuuacaauugacaacggagucuuugaaguaguagccacaaauggagauacgcaucuaggaggagaggacuucgaccaaaggguuauggaacacuucauaaaauuauacaaaaaaaaaacaggaaaagacguuagaaaagacaauagagccguacaaaaauuaagacgagagguagaaaaagcaaaaagagcauugucaagccaacaccaagcaagaauagaaauagaaucauuuuaugaaggagaggacuucagcgaaacacuuacaagagcaaaauuugaagaacugaauauggauuuauuuagaaguacaaugaaaccaguucaaaaagucuuagaagauagugauuuaaaaaaaagcgacauagaugaaauaguacucguaggaggaucaacaaggauaccaaaaauacaacaauuaguuaaagaguuuuuuaauggaaaagaaccaucacgaggaauaaauccagacgaagcaguagcauacggagcagcaguacaggcaggaguacuaagcggagaucaagauacaggagaucuagucuuacuagaugucugcccacuuacauuaggaaucgaaaccguaggagggguaaugacaaaacuaauaccacguaacacgguugugccaacaaaaaaaucacagauauucaguacagcgucagacaaucagccaaccgucacuauaaaaguauacgaaggagaacgaccacuuacaaaagauaaccaucuacuaggaaccuucgauuuaacaggaauaccacccgccccaagaggaguaccacaaauagaaguuacauucgaaauagacguaaacgguauucuuagagugacagcugaagacaaaggaaccggaaauaaaaauaaaauaacaauaacuaacgaucaaaaccgacuaacuccagaagaaauagaacgcaugguaaacgaugcagaaaaauuugcagaagaagacaaaaaacuaaaagaacgaaucgauacuagaaaugaacuagaaucauacgcauauucauuaaaaaaucaaauaggcgacaaagaaaaacuaggaggaaaauuaucaagugaggauaaagaaacuauggaaaaagcggucgaagaaaaaauagagugguuagaaagucaucaagacgcugauauagaagauuuuaaagcaaaaaaaaaagaauuagaagagauaguacaaccaauaauaucaaaacuauauggaagcgccgguccuccaccaacaggcgaagaagacacagcugaaaaagacgaauuaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2453 - RNA, 2149 nt, Artificial Sequence
  mRNA product Design1 comprising derived and/or modified sequence from Homo sapiens__NP_002146.2__HsHSPA6 (opt12)
gggagaaagcuuaccaugcaagccccaagagaauuagcaguuggaauagaccuagguacaacauacucauguguaggaguuuuucaacaaggaagaguugagauacuagcaaaugaucaaggaaacagaacaacacccagcuauguagcauucacugacacagaaagauuagucggagacgccgcaaaaucacaagcagcucuaaacccucauaauacaguuuuugaugcuaaaaggcuuauagggagaaaauucgcagacacaacaguacaaucagauaugaaacacuggcccuuucgaguaguaucagaaggaggaaaaccgaaaguaagaguuugcuauagaggagaagauaaaacauuuuacccagaagaaaucucaucaaugguucuuaguaagaugaaagagacagcggaagcauacuuaggacaaccggucaaacacgccguuauaacaguaccugcauauuucaaugacagucaaagacaagcuacaaaagaugcaggagcaauagcaggauuaaauguauuaagaauuauuaaugaaccaacagccgcagcaauagcauacggacuagaucguagaggagccggagaaagaaacgucuuaauauuugauuuaggagggggaacauuugauguaucaguucuaucgauagaugcaggaguauuugaaguaaaagcuacagcaggagauacacauuuaggcggggaagauuuugauaacagauuaguaaaucacuucauggaagaauuuagaagaaaacacgguaaggacuuaucaggaaauaaacgagcacucagaagacuuagaacagccugugaacgagcaaaacguacuuugagcucaaguacacaagcuacuuuagaaauagacaguuuauucgaagguguugauuuuuacacaaguauuacuagagcaagauuugaagaacuauguucagauuuauuucguucaacauuagaaccaguagaaaaagcacuaagagaugcaaaacuagauaaagcucaaauacaugauguggugcuaguaggagguuccacaaggaucccaaaaguccaaaaacuacuacaagauuucuuuaauggcaaagaacucaacaaaaguauaaaucccgaugaagcaguagcauauggugcagcaguacaagcagcaguuuuaaugggagauaagugugaaaaaguacaagauuuacuauuacuagacguagcaccccuaucacucggacuagaaacagcuggaggaguaaugacuacacuaauucaaagaaacgccacaaucccaacaaaacaaacacaaacauuuacaacauacucagauaaucaaccaggcguauuuauacagguuuacgaaggugaacgagcaaugaccaaagacaauaaucuacucgguagauucgaacuaaguggaauaccaccagccccaagaggaguaccacaaauagaaguaacauuugauauagaugcaaaugguauucucagcguaacugcaaccgaccguagcacaggaaaagcuaacaaaauaacuauaacgaaugauaaaggaagacuaaguaaagaagaaguagaacgcaugguacaugaagcagaacaauauaaagcagaagacgaagcacaaagagauagaguugcagcuaaaaacaguuuagaagcacauguguuccauguaaaaggaucauuacaagaagaaucauuaagagauaaaauuccagaagaagauagacgaaaaaugcaagauaaaugcagagaaguacucgcauggcuagagcacaaucaauuagcagagaaagaggaauaugaacaccagaaacgagaauuagaacaaauuugucgaccaauauuuaguagguuauacggaggaccaggagucccaggagguucaucauguggaacccaagcaagacaaggagaucccaguacagguccaauaauagaagaaguugacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2454 - RNA, 1321 nt, Artificial Sequence
  mRNA product Design1 comprising derived and/or modified sequence from Homo sapiens__P48741__HsHSPA7 (opt12)
gggagaaagcuuaccaugcaagcuccaagagaacuagcuguaggaauagauuuaggaacaacauauaguuguguaggaguauuucaacaaggaagaguugaaauacuagcaaaugaucaagggaauaggacaacaccaucauauguagcauuuacagauacagaacgauuaguaggagaugcagcaaaaucacaggcagcucuaaacccacauaauacaguauuugaugcaaaaagacuaauagguagaaaauuugcagacacuacaguacaaagcgauaugaaacauuggccauuucaaguaguaucagaagguggcaaaccaaaagucagaguauguuauagaggagaagauaaaacuuuuuaucccgaagaaauaucaucaaugguauuaaguaaaaugaaagaaacagcagaagcauaucuaggacaaccaguaaaacaugcgguaauaacaguuccaacauauuuuucaaacucacaaagacaagcaacaaaagaugccggugcaaucgcaggacuuaaaguauuaccaauaauuaaugaagcaacagcagcagcaauagcauauggacuagauagaagaggagcuggaaaaagaaauguauuaauauucgauuuaggagguggaaccuuugauguaucaguauuaagcauagaugcaggaguauuugaagucaaagcaacagcaggagauacacaucuaggaggggaagauuucgauaauagauuaguaaaucacuuuauggaagaguuuagaagaaaacauggaaaagauuuaagcgguaauaaaagagcauuaagaagacuaagaacagcaugcgaaagagcaaaaagaacaccaucaagcaguacgcaagcaacauuagaaauagacucauuauucgaaggaguagacuuuuauaaaucaauaacaagagcgagauucgaagaauuaugcucagacuuauucagaaguacacuagaaccaguagaaaaagcauuaagagaugcaaaacuugacaaagcacaaauacaugauuucguacuaggaggaggauuacacagucauccacaaggagcugaaguagcagcaggacuauuacaacgacaaggugcagaacaagaacaucaaccauagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2455 - RNA, 2158 nt, Artificial Sequence
  mRNA product Design1 comprising derived and/or modified sequence from Homo sapiens__NP_006588.1 __HsHSPA8 (opt12)
gggagaaagcuuaccaugucaaaagguccggcaguaggaaucgauuuaggaacaacauauaguugugucggaguauuucaacauggaaaaguugaaauaauagcaaacgaucaaggcaauagaacuacaccaucuuacguugcauuuacagauacagaaagauuaauaggggacgcagcuaaaaaccaaguagcaaugaacccaacaaauacaguauuugacgcaaaacgacuaauaggaagaagauuugaugaugccguuguacaaucugacaugaaacauuggcccuuuaugguaguaaaugacgcaggaagaccaaaaguccaagucgaauacaaaggagaaacaaagagcuuuuacccugaagaaguuucuagcaugguccuaacaaaaaugaaagaaauugcagaagcguaccuaggcaaaaccguaacaaacgcagucgugacaguaccagcauauuuuaacgauucacaaagacaggcaacaaaagacgcaggaacaauugcaggacucaacguacuccgaauaauaaaugaaccaacugcugcagcaaucgcauauggguuagacaagaaaguaggagcagagcgcaauguacuaauauuugaccuaggaggagguacguucgauguaagcauauuaacaauagaagauggcauauuugaaguaaaauccacagcaggagacacacacuuaggaggagaagauuuugacaauagaauggucaaccauuucauugcagaguucaaaagaaaacacaagaaagauauuucagaaaauaaaagagcaguaagaagauuaagaacagcuugugaaagagcuaaaagaacuuuaucaucaucaacacaagcuagcauagaaauugacaguuuauaugaaggaauagauuucuauacauccaucacgcgagcaagguuugaagaauuaaaugcagacuuauuucgaggaacacuugacccuguugaaaaagcccuacgagacgcuaaacuagacaaaagccaaauacaugacauaguucuaguaggaggaagcacuagaauacccaaaauacaaaagcuacugcaagacuucuucaacggaaaggaacucaacaaaagcauuaaucccgaugaagcaguagcuuacggagcugcaguacaagcugcaauauuaaguggagacaaaagcgaaaacguacaagaucuacuauuacuagauguaacaccucuaagccucggaauagaaacggcaggaggagugaugacaguacucauaaaaagaaauacuacaauaccaaccaaacaaacacaaacauuuacaacauacucagacaaucaaccaggaguauuaauacaaguauacgaaggagaaagagccaugacaaaagacaauaaucuccuaggaaaauucgaauuaacaggaauaccaccagcaccucgcggaguaccacaaaucgaaguaaccuuugacauugaugcgaacggcauauuaaauguuucagccgucgacaagucuacaggaaaagagaacaagauaacaauaacuaaugauaaagggcgauuaagcaaagaagauauagaacgaaugguacaagaagcagaaaaauauaaagcagaagaugaaaaacaaagagauaaaguaucuagcaaaaauagccuagaaaguuaugcauucaauaugaaagccacaguugaagacgaaaaauuacaaggcaaaauaaaugacgaagauaaacagaaaauauuagacaaauguaacgaaauaauaaacuggcuggauaaaaaucaaacggccgaaaaagaagaauuugaacaucaacaaaaagaauuagaaaaaguaugcaauccgauaauaacaaaauuauaccaaucagcuggggguaugccaggggguaugccagguggauucccaggagggggagcaccaccaagcggaggagcaagcucaggaccaacaaucgaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2456 - RNA, 2257 nt, Artificial Sequence
  mRNA product Design1 comprising derived and/or modified sequence from Homo sapiens__NP_004125.3 __HsHSPA9 (opt12)
gggagaaagcuuaccaugauauccgcaucaagagcagcagcggcaagauuaguaggagcagcagcaaguagaggaccaacagcagcaagacaccaagacaguuggaaugguuuaagccaugaagcauuuagacucgugaguaggagagauuaugcaagugaagccauaaaaggagcugugguaggaauagauuuaggaacaacuaauucauguguugcaguaauggaaggaaaacaggcuaaaguacuagagaaugcggaaggagcuagaaccacucccaguguaguagcauucacagcugauggagaaagauugguagggaugccggcaaaaagacaagcaguuacgaacccaaauaacacauuuuaugcaacaaaacgacuaauagggaggcgauacgaugacccggaaguucaaaaagauauuaaaaacguuccuuuuaagauaguaagagccagcaauggagaugccuggguagaagcccacggaaaguuauauucaccaagucaaauaggggcuuuuguacuaaugaaaaugaaagaaacagccgaaaauuacuuaggacauacugcuaaaaaugcaguuauaacaguaccagcauauuuuaaugauagccaaagacaagcuacaaaagaugcaggucagauaaguggucucaacguucugcgcguaauuaaugaaccaacagcugcugcacuagcauacggguuagauaaaagugaagauaaagucauagcgguauaugauuuaggaggaggcacauuugauauaucaauauuagaaauacaaaaagggguauucgaaguuaaaagcaccaauggagauacguuucuuggaggggaagauuuugaccaagcguuauuaagacauauagugaaagaauuuaagagagagacaggaguagaucuaacaaaagacaacauggcauuacaaagaguuagagaagcugcugagaaggcaaaaugugaauuaagcucaaguguacaaacagauauaaauuuacccuauuuaacaauggauagcaguggaccgaaacaucuaaauaugaaauugaccagagcucaauuugaaggaauagugacagauuuaauaaggagaacaauagcaccaugccagaaagcaaugcaagaugcagaggugaguaaaagcgauaucggagaagugauauugguaggaggaaugacaagaaugccaaaaguacaacaaacaguacaagacuuauuuggcagagcaccaagcaaagcuguuaacccagaugaagcaguggcuauuggagcagcuauacaaggaggaguguuagcaggagauguaacagauguauuauuacuagauguaacaccauuaucauuggguauagaaacacuaggagggguauuuacaaagcuaauaaauagaaauacaacaauaccaacaaagaagucucaaguauucucaacugcagcagaugggcaaacacaaguagaaauaaaaguaugucaaggagaaagagaaauggcaggcgacaauaaacuacuuggacaauuuacacuaauaggcauaccgcccgcccccaggggaguuccacaaauagaaguaaccuucgauauagaugccaacggaauaguacacguaagcgcaaaggacaaagggacagggagagaacaacaaauaguaauacaauccagcggagguuuaucaaaagacgacauagaaaacaugguuaaaaaugcagagaaguaugcagaagaagauagaagaaagaaagaaagaguagaagcaguaaauauggcagaggguauuauacaugauacggaaacaaaaauggaagaauuuaaagaucaauuaccugcagacgaaugcaauaaacuaaaagaagaaauaagcaaaaugagagaauuacuagcaagaaaagauucggaaacuggagaaaauauaagacaagcagcuaguagccugcagcaagccagcuuaaaacuauucgagauggcauauaagaaaauggcaagcgaaagagaaggcagugggagcucaggaacaggugaacaaaaagaagaccaaaaagaagaaaaacaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2457 - RNA, 2245 nt, Artificial Sequence
  mRNA product Design1 comprising derived and/or modified sequence from Homo sapiens__NP_079291.2__HsHSPA12A (opt12)
gggagaaagcuuaccauggcugauaaagaagcuggagguucugauggaccacgagaaacagcuccaacuucugcuuacucaaguccagcaaggucuuuaggagacacgggaauuaccccguuaagucccagucauauagucaacgauacugauucuaacguguccgaacaacaaagcuuucuuguaguaguagcaguugacuucggaacuacuucaucaggauaugcguauucauuuacaaaagaaccagaauguauccacgugaugagacgaugggaaggaggagaucccggaguaagcaaucaaaaaacaccgacaacaauacucuuaacaccagaacgaaaauuccauucauuuggcuacgcagcuagagauuucuaucaugaucuagauccaaaugaagcaaaacaaugguuauaucuugaaaaauuuaaaaugaaacuacauacaacaggugaccucacaauggauacugaucuaacagcagcaaaugggaagaaaguuaaagcacuagaaauauuugcauacgcccuucaauacuuuaaagaacaagcacuuaaagaacuaucagaucaagcaggaucugaauuugaaaauagcgauguuagauggguaauaacaguuccagcaauauggaaacaaccagcaaaacaauuuaugcgccaagcugcauaccaagcaggacucgccucuccagagaauucagaacaauuaauaauugcauuagaaccugaagcagccaguauauauugcagaaaacuaagauuacaucaaaugauugaauuaaguaguaaagcagcaguaaacgguuauagugguucagauacaguaggagcuggcuuuacucaagcaaaagaacauauaagaagaaauagacaaucaaggacauuuuuaguagaaaauguaauuggugaaauaugguccgaauuagaagaaggagacaaauauguagucguagacucugguggcggaacuguagaccuaacaguacaucaaauaagacuuccagaaggacaucuaaaagaauuauauaaagcaacgggaggccccuauggaucauuagguguagauuaugaauucgaaaaauuauuauauaaaauauuuggcgaagauuuuauagaacaauucaaaauaaaaagaccugcggcuuggguagacuuaaugauagcuuuugaaucaagaaaaagagcugccgccccagacagaacaaauccauuaaauauaacauuaccauuuucauuuauugauuauuauaaaaaauuuagaggacacucuguagaacaugcacuuagaaaaagcaacguagauuuuguaaaauggaguucucaaggaauguuaagaaugucaccagacgcaaugaacgccuuguucaaaccaacgauugauaguauaauagaacacuuacgcgacuuauuucaaaaaccagaaguaucaacagucaaauuucuauuuuuagucggaggauuugcagaagcaccacuucuacaacaagcaguacaagcagcauuuggagaucaaugcagaaucauaauaccucaagacguaggccucacgauucuaaaaggcgcagugcuauucggucuagauccagcaguuauaaaaguucggcgaucacccuuaacauauggaguuggaguauuaaaucgauacguagaaggaaaacauccaccagaaaaauuauuaguaaaagacgguacgagaugguguaccgauguauucgauaaauuuauaucagcagaccaaucaguagcucucggcgaacucguuaaaagauccuauacaccagcaaaaccaucucaauuaguuauaguaauuaauauauauucaagcgagcacgauaacguuucauuuauaacagauccagguguaaaaaagugcgguacauuaagacucgacuuaaccggaacaaguggaacagcaguuccagcacgcagagaaauacaaacauuaaugcaauuuggugauacugaaauaaaagcaacagccauagacauagccacaucaaaaucaguuaaaguuggaauagacuuucuaaauuacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2458 - RNA, 2278 nt, Artificial Sequence
  mRNA product Design1 comprising derived and/or modified sequence from Homo sapiens__NP_443202.3 __HsHSPA12B (opt12)
gggagaaagcuuaccauguuagcaguaccagaaaugggauuacagggacuauauauuggaucuucuccagaaagaucaccaguaccaucaccacccgggucaccaagaacccaagaaagcuguggaauagcuccacuaacaccaucacaauccccuaaaccagaaguaagggcaccccaacaagccaguuucaguguuguaguagcaauagauuuuggaacuacaucaucagguuacgcauuuuccuuugcaucagauccugaagcaauucauaugaugagaaaaugggaaggaggagacccuggcguagcacaucagaaaacuccuacauguuuacuuuugacaccagaaggagcauuucauucauuuggauauacagcacgagauuauuaucacgacuuagauccagaagaagcuagagauuggcucuacuuugaaaaauuuaaaaugaaaauacauagugcaacagaucuaacauuaaaaacccaauuagaagcuguuaaugguaaaacuaugccagcgcuagaaguauuugcgcacgcauuaagauuuuuccgagaacaugcauuacaagaacuuagagaacaaucaccuucacuaccugaaaaagauacaguuagauggguauugacuguaccggcaauauggaaacaaccagcgaaacaauuuaugagagaagcugcauauuuagcuggguuaguaucacgagaaaaugcagagcaacucuuaauugcgcuugagccagaagcagcaucugucuacugcagaaaauuaagacuacaucaacuacuagauuuaaguggcagagcacccggagguggaagacuaggugagcgaagaagcauagauucaaguuuccgacaagcaagagagcaacuaagacgaucaagacacucaagaacauuucuaguagaaagcgguguaggagaauuaugggcagaaaugcaagcaggagaucgauauguaguugccgauugcggggguggcacaguagauuuaacaguccaucaacuagaacaaccacacggaacucuaaaagaacuauauaaagcaucaggagguccauacggcgcaguaggaguggacuuagcguucgaacaacuacuaugcagaauauuuggagaagauuuuauagcgacauuuaaaagacaaagaccugcggccuggguagaucuaacaauagcauucgaagcaagaaaacggacggccgggccgcauagagcaggagcucuaaauauaagccuaccauuuucauuuauagacuuuuauagaaaacagagaggacauaacguugaaacugcacugagacgauccucaguaaauuucguaaaauggucuucacaaggaauguugcgaaugagcugcgaagcaaugaaugaacuauuucaaccaacuguaaguggcauuauucaacauauagaagcacuauuagcaagaccugaaguccaaggaguuaaacugcuauuccugguagguggauuugcagaaucggcaguauuacagcaugcaguacaagcagcuuuaggugcaagaggauuacgaguaguaguaccacaugauguaggacuaacaauuuuaaaaggagcuguacuauucggccaagcuccaggaguuguaagaguuagaagaaguccauuaaccuacgggguagggguacuuaauagauucguaccuggacgacauccaccagaaaaauuauuaguaagggauggaagacgcugguguacagauguguucgaaagauucguagcugcugaacagagcguugcucuaggggaagaaguacgaagaucauacuguccagcuagaccaggccaaaggcgaguauuaauaaauuuauauuguugugcagcagaagaugcaagauucaucacugauccaggaguuagaaaaugcggagcacucucucuagaguuagaaccugcggacuguggacaagacaccgcaggagccccaccaggaaggagagaaauacgagcagcaaugcaauuuggugauacagaaauuaaagucacugcaguagauguaucgacaaauagaucaguaagagcuucgauugauuuccuuucgaauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2459 - RNA, 1633 nt, Artificial Sequence
  mRNA product Design1 comprising derived and/or modified sequence from Homo sapiens__NP_008879.3__HsHSPA13 (opt12)
gggagaaagcuuaccauggcucgagaaaugacaauuuuaggaucagcgguauugacacuuuuauuagcaggauaccuagcccaacaauaccuaccacuaccuacaccaaaagugauaggaauagaccuuggaacaacauacuguucaguaggaguauucuuuccaggaacagguaaaguaaaaguaauaccagaugaaaacggacacauaaguauacccucaaugguaaguuuuaccgauaacgauguauacguaggauacgaaucaguugaauuagcagacucaaauccacaaaacacaauauaugacgcaaaaagauuuaucggaaaaaucuucacagcagaggaauuagaagcagaaauaggaagauaucccuucaaaguauuaaauaaaaacggaaugguagaauucucugucacaucaaacgaaacaauaacaguaagcccagaauacguaggcagucgauuacuacuaaaacucaaagaaauggcagaagcguacuuaggaaugccaguagcaaaugccguaauaucagucccagcagaauucgaucuaaaacaacgaaacagcaccauagaagcagccaaucuagcaggauuaaaaauacuaagaguaauaaacgaaccaaccgcagcagccauggcauauggacuacacaaagcagauguauuucacguauuaguaauugaucuaggaggcggaaccuuagacguaucauuauuaaauaaacaaggaggaauguucuuaacuagagccaugucaggaaauaacaaacuaggaggacaagauuuuaaccaacgacucuuacaauacuuauacaaacaaauauaucaaacauauggauuuguuccuagcagaaaagaagaaauacauagacuaagacaagccguagaaaugguuaaauuaaaucuuacacuccaccaaagugcacaacuaagcguguuacuaacaguagaagaacaagacagaaaagaaccacacucuucagacacagaauuaccaaaggauaaauuaucaucagcagaugaccaccgaguaaauucaggauucggaagaggacuaucagauaaaaaaucaggagaaucacaaguucuauucgaaacagaaauaucaagaaaacuauuugacacauuaaacgaagauuuauuccaaaaaauacuaguaccaauacaacaaguacuuaaagaaggacaucuugaaaaaacggaaauagacgaaguaguacucguaggagguucaacaagaauaccaagaauaagacaaguaauucaagaauuuuuuggaaaagacccaaauacauccguagauccagaucuagccguaguaaccggcguagcuauacaagcaggaauagaugguggaucauggccauuacaaguaucagcacucgaaaucccaaacaagcacuuacaaaaaacaaauuucaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2460 - RNA, 1747 nt, Artificial Sequence
  mRNA product Design1 comprising derived and/or modified sequence from Homo sapiens__NP_057383.2__HsHSPA14 (opt12)
gggagaaagcuuaccauggcagcaaucggaguucaucuaggauguacaagcgcaugcguagcaguauacaaagacggucgagcagguguugucgcaaacgaugcaggagauagaguaacaccagcuguaguagcauauagugaaaacgaagaaauaguaggauuagcagcaaaacaaagcaggauucgaaauauaucaaauacaguaaugaaaguaaaacaaauauuaggccgaagcagcuccgacccucaagcacaaaaauauauagcagaaaguaaauguuuaguaauagaaaaaaauggaaaacuaagauacgaaauugauacgggagaagaaacaaaauucguaaauccggaagauguagcaaggcuaauauuuagcaaaaugaaagaaacagcucauaguguauuaggaagcgacgcaaacgacguaguuauaacagucccuuucgauuuuggagaaaaacaaaaaaaugcucuuggagaagccgcaagagcagccggcuuuaauguacuaagacuaauacaugaaccaucagcagcucuauuagcauauggaaucggacaagauucaccaacagguaaaaguaacauacuaguauuuaaauuaggaggaacaucauuaucacuauccguaauggaaguaaauucaggaaucuauagaguauuaaguacaaacacagacgacaacauuggaggagcacacuuuacagaaacuuuagcacaauaucuugcauccgaauuucaaagaaguuuuaaacaugacguaagagguaacgcaagagcgaugaugaaacugacaaauucagcagaaguagcaaaacauagucuaucaacauuaggauccgcaaacugcuuucuagauaguuuauaugaaggacaagacuuugacugcaauguaucaagagcacguuucgaacucuuauguucaccguuauuuaauaaaugcauagaagcaauaagaggacuauuagaucaaaauggauuuacagcugaugauauaaauaaaguuguguuauguggaggaucaucaagaauaccaaaauuacaacaauuaauaaaagauuuauuucccgcaguagaauuauuaaauucaauaccaccagacgaaguaauuccaauaggcgcagccaucgaagcaggcauacuaauaggaaaagaaaaccuauuaguagaagacucauuaaugauagaauguucagcaagagauauauuaguaaaaggaguagaugaaaguggugcgucaagguuuacaguauuauuuccaagcggaacaccacuaccugcaagaagacaacauacgcuacaagcaccagguaguauaaguucaguaugucuagaacuauaugaauccgacggaaaaaacagcgcaaaagaagaaacaaaauuugcacaaguuguuuuacaagauuuagauaaaaaagaaaacggcuuaagagacauuuuagcaguauuaacaaugaaacgcgauggaucacuacauguaacauguacagaccaagaaacaggaaaaugcgaagcaauaaguauagaaauagcuucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2461 - RNA, 2794 nt, Artificial Sequence
  mRNA product Design1 comprising derived and/or modified sequence from Homo sapiens__NP_006635.2 __HsHSPH1 (opt12)
gggagaaagcuuaccaugucaguaguaggacuugauguaggaucacaaucauguuacauagcaguagcuagagccggugggauagaaacaauagcaaacgaauuuagugauagaugcacaccaagugucauaucauuugguagcaaaaacagaacaauaggaguagcagcgaaaaaccaacaaauaacccacgcaaacaacacaguaucaaacuucaaaagauuccacggcagagcauuuaacgaccccuucauacaaaaagaaaaggaaaacuugaguuaugacuuaguaccacucaaaaauggaggaguuggaauaaaaguaauguacaugggggaagaacacuuauuuagcguagaacaaauuacugcaaugcuauuaacaaaacuuaaagaaacagcagaaaacucauuaaagaaaccaguaacagauuguguaaucuccguaccaucuuucuuuacagaugcagaaagacgauccgucuuagacgcagcacaaauaguuggccuaaauuguuuaagguugaugaacgacaugacugccguagcccuaaauuaugguauuuacaaacaagacuuaccaagccucgaugagaaaccccggauaguaguauuuguagacaugggacacagcgcauuucaagugagugccugugccuuuaacaaaggaaaacucaaaguucucgguaccgccuuugauccguuuuuaggaggcaaaaauuucgacgaaaaauuagucgaacauuuuugcgcagaauuuaaaacaaaauauaaauuagacgcgaaaagcaaaauaagagcgcuacugagauuauaccaagaaugugaaaaacuaaagaaacuaaugaguucaaauaguacagaccuaccacuaaauauagaguguuucaugaacgacaaagacguaagcggaaaaaugaauagaucacaguucgaagaacuuugugcagaacuauuacagaaaauagaaguucccuuauauucauuauuagaacaaacacacuuaaaaguagaggaugucucagcuguagaaaucgucggaggagccacccguauuccagcggucaaagaaagaauagcaaaauucuuuggcaaagacauaaguacaacccuaaacgccgaugaagcagucgcaagaggaugugcacuccaaugugcaauccuuaguccagccuuuaaaguaagagaguuuuccguaacugacgcaguaccauuuccuauuucucuaauuuggaaucaugauucagaagauacagaaggaguacaugaaguauuuucaagaaaccaugcagcaccguucaguaaaguauugacauuuuugcgaagaggcccauucgaacuagaagcauuuuacucagauccacaagggguaccauaccccgaagcaaaaaucggaagauuuguuguacaaaacgucucagcacaaaaagauggagagaaaagcagaguaaaaguaaaaguacgaguaaacacucauggaauauucacaauaucuaccgcaagcaugguagaaaaagucccaacagaagaaaacgaaaugucaagcgaagccgauauggaaugcuugaaucaacgaccgcccgaaaacccagauacugacaaaaacguacaacaagauaauucagaagcuggaacucaaccacagguacaaaccgaugcacaacaaaccucacaaagcccaccaagucccgaacuuacguccgaagaaaacaaaauaccagacgcagauaaagcaaacgagaagaaagucgaccaaccaccagaagcaaagaaaccgaaaauaaaaguagugaauguagaauuaccaauagaagccaaccuaguguggcaacuaggaaaagaccuccuaaacauguacauugaaacagaaggaaaaaugauaaugcaagauaaauuggagaaagaaagaaacgacgccaaaaaugcaguagaagaauacgucuacgaguucagagauaaacuaugugguccauaugaaaaauucauaugugaacaagaucaccaaaauuuccuuagauuacuuacagaaacugaagauugguuauaugaagaaggcgaagaucaagcaaaacaagccuacgucgacaaauuagaagaauuaaugaaaauaggaacaccagugaaaguaagauuccaagaagcagaagaaagaccaaaaauguuugaagaauuaggucagcgcuuacaacauuacgccaaaauugcagcagauuuuagaaauaaagaugaaaaauauaaccauauugacgaaucagagaugaagaaaguagaaaaaucagucaaugaaguaauggaauggaugaauaauguaaugaacgcucaagcaaagaaaucauuagaccaagacccaguagugagagcccaagaaauaaaaacaaaaauaaaagaauuaaauaauacaugugaaccuguuguuacacaaccaaaaccaaaaauagaaaguccaaaacuagaacgaacgccaaacggaccaaauauagacaagaaagaagaagaucuagaagacaaaaauaacuucggugcagaaccuccacaucaaaacggagaauguuacccaaacgagaaaaacaguguaaacauggacuuagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2462 - RNA, 3217 nt, Artificial Sequence
  mRNA product Design1 comprising derived and/or modified sequence from Homo sapiens__NP_006380.1 __HsHYOU1 (opt12)
gggagaaagcuuaccauggccgauaaaguaaggcgccaacguccaagaagaagaguauguugggcacuuguugcaguucuacuugcagacuuauuagcacuaagugauacacuugcagugaugaguguagaucuuggauccgaaagcaugaaaguagcaaucguaaaacccggaguaccaauggaaauuguacucaacaaagaaagucgaagaaaaacaccaguaaucguaacucuaaaagaaaaugaaagauuuuucggggauucugcagcaucuauggcaauuaaaaacccaaaagcuacauuacguuacuuccaacauuuacuugguaagcaagcagauaacccucacguugcucuauaucaggcucguuucccagaacaugaacucacauucgacccacaacgacagacaguacacuuucaaauaucaagccaauuacaauucucaccagaagaaguacuagguaugguacuaaacuauucgcgaaguuuagcagaagacuucgcugaacaaccaauaaaagaugccguaauaacagucccagucuucuuuaaccaagcagaaaggagagccguucuacaagcggcuagaauggcaggauuaaaaguauugcaacuaauaaaugacaauacugcgaccgcccuaaguuacggcguuuuucgaagaaaagauauaaauacaacagcccaaaacauaauguucuacgacaugggaaguggaucaacaguaugcacuauaguuacauaccaaaugguaaaaacgaaggaagcaggaaugcaaccacagcuacaaauaagaggaguaggauuugaucguacacuaggaggauuagaaauggaacuaagacuuagagaacgcuuagcaggauuguucaaugaacaaagaaagggccaacgcgccaaggaugugagagagaauccaagagcaauggcaaaauuacucagagaggccaaccgguuaaaaacaguguuaucagcaaacgcagaucauauggcucagauagaaggacugauggaugacguugauuucaaagcaaaagucacacgaguugaauuugaagaguuaugugcagauuuauucgaaagaguuccuggaccuguucaacaagcgcuacaaagugcagaaaugaguuuagaugagauugaacaagugauucuaguuggcggagcaacucgaguuccaagaguccaagaaguacuguuaaaagccguaggcaaagaagaauuagguaaaaauauaaaugccgaugaagcagccgcaaugggagccguuuaucaagcugcugccuuaucgaaagcauuuaaaguaaaaccauuuguuguaagggacgccgugguauacccaauauuagucgaguuuacacgagaagucgaagaagaacccggaauacauucauuaaaacauaacaaacgaguucuauuuucaagaauggggccguauccacaaagaaaaguaauaaccuuuaauagauacucccacgauuuuaauuuccacauuaauuauggagaucuaggauuuuuagguccggaagaucuucguguauuugggucacaaaauuugacaacagucaaacuaaaaggagucggagacucauuuaagaaauauccagauuaugaaucaaaaggaauuaaagcucauuucaauuuggaugaaaguggaguacucagucuagauaggguagaaagcguauuugaaacauuagucgaagacucagcagaagaagaaagcacucugacuaaacuaggaaauacaauaucaucacuauucggaggugggacgaccccagaugcaaaagaaaauggaacagauacuguacaggaagaagaagaaucaccagcagaaggaagcaaggaugaaccaggugagcaaguagaacuaaaagaagaagcagaagcaccaguagaagacggaagucaaccaccuccaccagaaccuaaaggagacgcgaccccagaaggagaaaaagcuacagaaaaggaaaauggagauaaaucagaagcucaaaaaccgucagaaaaagcugaagcaggaccagaaggcguugccccagcaccggagggagaaaagaaacaaaaaccagcaagaaaaagaagaaugguggaagaaaucgguguagagcuaguaguauuagacuuaccugacuuaccagaagauaaauuggcucaauccguucaaaaacuucaagaucuaacacuuagagacuuagaaaaacaagaacgagaaaaagcagcaaacucacuagaagcauuuauauucgaaacacaggauaaacuauaccaaccagaauaccaagagguuucaacugaggaacaaagggaagagaucucaggaaaacucagugcagccaguacaugguuggaagacgaaggaguaggcgcaacaacggucauguuaaaagaaaaacuagcggaacuuagaaaauuaugccaaggauuauuuuucagaguugaagaaagaaagaaauggccagaaagauuauccgcuuuggauaauuuauuaaaucauucaucaauguuucuaaaaggcgcaagauuaauaccugaaauggaucaaauauucacagaaguagaaaugacuacauuagaaaaaguaauaaaugaaacuugggcuuggaaaaaugcuacacuagcagaacaagcaaaauuaccagcuaccgaaaaaccaguacuacuaucaaaagacauagaggcaaaaaugauggcccuagacagagaaguucaauaucuacuaaauaaagcaaaauuuacuaaaccuagaccaagaccuaaagauaaaaaugguacacgagcugagccuccacucaaugcguccgcauccgaucaaggagaaaaaguuauacccccugccggacaaacagaagacgcagagccaaucucagaaccagaaaaaguggaaacaggaagugaaccuggagacacagaaccacuagaacucggagguccgggggcagaaccagaacaaaaagaacagaguacaggacaaaaacgaccgcuaaagaaugaugaguuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2463 - RNA, 2416 nt, Artificial Sequence
  mRNA product Design1 comprising derived and/or modified sequence from Homo sapiens__NP_005339.3 __HsHSP90AA1 (opt12)
gggagaaagcuuaccaugccagaggaaacccaaacucaagaucaaccaauggaagaagaagaaguagaaacauuugcuuuccaagccgaaauagcacaacugaugucacuaauaauaaauacauuuuauucaaacaaggaaauuuucuugagagaacucauaaguaacucaagcgacgcacucgacaaaauaagauacgaaagccuaacagacccgucuaaacuggacucaggaaaagagcuacauauaaaccuaauaccuaacaaacaagauagaacacuaaccauaguagauacaggaauagguaugacaaaagcagauuuaauaaacaaccuaggcacaauagccaaguccggaaccaaagcguucauggaagcgcuccaagccggcgcagauaucagcaugauaggacaauucgggguaggauucuacucagcauaucuaguagcagaaaaaguaacgguuaucaccaaacauaaugacgacgaacaguacgcaugggaaaguucggcaggcggcucauucacagucagaaccgacaccggggaaccaaugggaagagguacaaagguaauacuacaccuuaaagaagaccaaacagaauaccuagaagaaaggagaauaaaagaaauaguaaaaaaacacucacaauucauuggauacccaauaacauuauuuguagaaaaagaaagagacaaagaaguaagcgacgaugaagcagaagaaaaagaagauaaagaagaagagaaagaaaaagaagagaaagaaagugaagacaaaccagaaauagaagacguuggcucggaugaagaagaagaaaaaaaagacggagauaaaaaaaaaaaaaaaaaaauaaaagaaaaguacauagaucaagaagaacucaauaaaacaaagccaauauggacacgaaauccagaugacauaacuaacgaagaauacggcgaauuuuauaaaaguuuaacaaacgacugggaagaccaucucgcaguaaaacauuuuucaguagaaggacaacuagaauucagagcacuauuauucguccccagaagagcaccauuugauuuauuugaaaauagaaaaaaaaaaaacaacauuaaacuauauguaagaagaguuuucauaauggacaauugugaagaauuaauaccagaauaucuaaacuuuauaagaggggugguugacagcgaagauuuaccgcuuaacauaagccgagaaauguugcaacagaguaaaauacuaaaaguaauaagaaaaaaucuaguaaaaaaauguuuagaauuauuuacggaauuagcagaggacaaagaaaacuacaagaaauuuuacgaacaauucaguaaaaacauaaaauuaggcauacacgaagacagucaaaauagaaagaaacuaucagaacuacuaagauauuacacaagugcaaguggagaugaaaugguaagcuuaaaagacuacuguacaagaaugaaggaaaaccaaaaacauauauauuauauaacaggagaaacaaaagaucaaguagcaaacagugccuucguagaaagacuaagaaaacaugggcuagaaguaauauacaugauagaaccuauagaugaauauugcguacaacaacuaaaagaauuugaaggaaaaacccuaguaucgguaacaaaggaaggauuagaauuacccgaagaugaagaagaaaaaaagaaacaagaagaaaaaaaaacaaaauucgaaaaccuaugcaaaauaaugaaagauauacuagaaaaaaaaguugaaaaaguugugguaucuaacagauuaguaacuucaccaugcugcaucguaacuaguacguauggcuggacagcaaacauggaaagaauaaugaaagcacaggcuuugagagauaacaguaccaugggauauauggcagcaaaaaaacaucuagaaauuaauccagaccacaguauaauagaaacguuaagacagaaagcagaagcggacaagaacgacaaaucaguaaaagaccucguuauacuacucuaugaaacagcacuacuaagcaguggauuuucauuagaagauccacagacacacgcaaacaggauuuauagaaugauuaaacuuggacucggaauagacgaagaugacccaacagcagaugacacaagugcagcagugaccgaagaaaugccaccguuagaaggggaugacgacacuaguagaauggaagaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2464 - RNA, 556 nt, Artificial Sequence
  mRNA product Design1 comprising derived and/or modified sequence from Homo sapiens__NG_005218__HsHSP90AA3P (opt12)
gggagaaagcuuaccauggacagcucaaaacuagacucaggaaaaggacuacacauaaaccuaguaccaaacaaacaaaaccaaacacuaacaauaguagacacaagaauaggaaugacaaaaacagaccuaauaaacaaccuaggaacaguaacaaaaagcggaacaaaagcauuuauggaagcacuacaagcagacgcagacauaagcaugauaggacacuucggaguaggauucuacucagcauaccuaguagcaaaaaaaguaacaguaauaucaaaacacaacaacgacgaacaauacacaugggaaucaagcgcaggaggaagcuucacaguaagaacagacgaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2465 - RNA, 2392 nt, Artificial Sequence
  mRNA product Design1 comprising derived and/or modified sequence from Homo sapiens__NP_031381.2__HsHSP90AB1 (opt12)
gggagaaagcuuaccaugccagaagaaguacaccauggagaagaagagguagaaacauucgcauuucaagcagagauugcacaacuaaugaguuugauaauaaauacauuuuauagcaacaaagaaauauuuuuaagagaacuaauuucuaacgcaagcgacgcauuagacaaaauacgauaugagagucuaacugauccaaguaaacuagauaguggaaaggaacuuaaaauagacauaauaccgaauccacaagaacgaacauugacacuaguggacacaggcauaggaaugacaaaggccgaucuaauaaauaaucuuggcacaauagcaaaaagugggacuaaagcguuuauggaggcacuacaagcgggagcagauauaaguaugauaggacaauuuggaguuggauuuuauucagcauacuuaguggcagaaaaaguugucguaauaacaaaacauaacgaugacgaacaauacgccugggaaucaagcgcaggaggaaguuuuacaguaagagcagaccacggugaaccaaucggaaggggaacaaaaguaauacuacacuuaaaagaagaucaaacagaguauuuggaagaacgaaggguaaaagaaguaguaaaaaaacacucacaauuuauaggauauccgauaacauuguaccuagaaaaggaaagggaaaaagaaauaagcgaugacgaagcagaagaagaaaaaggggaaaaggaagaagaagauaaagacgaugaagaaaaaccaaaaauagaggacguaggaagugaugaagaagaugacucaggaaaagauaaaaaaaaaaaaacuaaaaaaaucaaagaaaaauacauagaucaagaagaauuaaauaaaacaaagccaauauggaccagaaacccagacgacauaacacaagaagaauauggcgaauucuauaaaagucuaacaaaugacugggaagaccaccuagcaguaaaacacuucagcgucgaaggucaauuagaauucagagcucuacuauuuauaccaagaagagcaccauucgaucuauucgaaaacaaaaaaaaaaaaaauaauauaaaacucuacguccgcagagucuuuauaauggacucgugcgacgaacuaaucccagaauauuuaaacuuuaucagagggguaguagacucagaggaccucccacuaaacauaagcagggaaaugcuucaacaaagcaaaauccuaaagguaaucagaaaaaauaucgucaaaaaaugccucgaacuauuuucagaauuagccgaagauaaagaaaacuacaaaaaauuuuacgaagcauucagcaaaaauuuaaaacuaggcauacacgaagacuccacaaacagaagaagauuaagcgaauuacuaagauaucacacaucacagucgggagaugaaaugacaucuuuaucagaguacguaagccgaaugaaagaaacacaaaaaaguauauacuauaucacuggagaaaguaaagaacaaguagcgaacucagcauuuguagaacguguaagaaaacgaggauuugaaguaguauacaugacagaaccaauugacgaauacuguguccaacaauuaaaagaauucgaugguaaaaguuuaguuucaguaacaaaagaaggauuagaauuaccugaagacgaagaagaaaagaaaaaaauggaagaaagcaaagcaaaauuugaaaaucuaugcaaacucaugaaagaaauauuagacaaaaaaguggaaaaagucacgauuuccaacagacucguaagcucacccuguugcauaguaacaucuacauaugguuggacugcaaacauggaaagaauaaugaaagcacaagcuuugagagacaauucaacaaugggauauaugauggcaaagaaacauuuagaaauaaacccagaccauccaaucguagaaacacugagacaaaaggcagaagcagacaaaaaugauaaggccgugaaagaucuugugguacuucuauucgaaacagcccuacugaguaguggauucaguuuagaagacccacaaacacacuccaauagaaucuaucgaaugaucaaacuaggauuaggaauagacgaggaugaaguagcugcagaagaaccaaaugcagcaguaccagaugaaauaccaccgcuagaaggagaugaagaugcgagccgcauggaagaaguagacuagggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2466 - RNA, 2629 nt, Artificial Sequence
  mRNA product Design1 comprising derived and/or modified sequence from Homo sapiens__NP_003290.1__HsHSP90B1 (opt12)
gggagaaagcuuaccaugagagcacuguggguauuaggauuaugcugcguauuacuaacguuuggaucagugagagcagaugaugaagucgauguugauggaacaguagaggaagaccucgguaaaaguagagaaggcucaagaacugacgacgaaguuguucaaagagaagaagaagcgauacaauuagauggauuaaaugcaucacaaauaagagaacuucgugaaaaaucagaaaaauuugcguuucaagcagaaguaaacagaaugaugaaacuaauaauaaauucauuauacaaaaauaaagaaauauuuuuaagagaacuuauuucaaacgcaagcgaugcauuggauaaaauaagauugauaagucuaacagaugaaaacgccuuaucaggaaaugaagaauuaacaguaaaaauaaaaugcgauaaagagaaaaauuuacuacauguaacugacacgggaguaggaaugacaagagaagaauuagucaaaaauuugggaacaauagccaaaucaggaaccucagaauuucuaaacaaaaugacugaagcacaagaagacgggcaaucaacaagugaauuaauaggacaauuugggguaggauucuacagugcguuuuuaguagcggacaagguaauaguaaccaguaaacauaauaacgacacacaacauauaugggagucagacaguaacgaguucaguguaaucgcagacccgagagguaacacauugggacgaggaacaacuauaacguuaguacucaaagaagaggcuucagauuaccuagaacuggauacaauaaagaaucucgugaagaaauauucccaauucaucaacuucccaauauacguauggaguucaaaaacagaaacaguggaggaaccaauggaagaagaagaagcagcuaaagaagagaaagaagaaucagaugaugaagcugcagucgaagaagaagaagaagaaaagaaaccgaaaacuaagaaaguagagaaaacaguuugggauugggaacuaaugaacgacauaaaaccaauuuggcaacgaccgucaaaagaaguggaagaggaugaauauaaagcauuuuacaaaucauucucuaaagaaucagaugauccaauggcauauauacauuuuacagcagaaggggaaguaacauuuaagucaauccuauuuguaccaaccucagcaccgaggggauuauucgacgaauauggaagcaagaaaucggauuauauaaaacuauauguaagaaggguauuuauaaccgaugauuuccacgauaugaugcccaaauaucuaaauuuuguaaaaggaguaguagacagcgacgaucuaccauuaaauguaucucgagaaacacuccaacagcauaaacuccuaaaaguuauaaggaagaaauuagucaggaaaacacucgauaugauaaagaaaauagcagaugauaaauauaacgacacauuuuggaaagaauuugguacaaauauuaaauuaggaguaaucgaagaucacaguaacagaacgagauuagcaaaacuauugagauuucaaaguucacaccacccaacagauauaacuagcuuagaccaauauguggaaaggaugaaagaaaaacaagauaaaauuuauuuuauggcagggaguaguaggaaagaagcugaaaguagccccuucguggaaagauuauuaaagaaaggauaugaaguaauauaucuaacagaaccaguagacgaauauuguauacaagcacuaccagaguucgacggaaaaagauuucaaaauguagccaaagaaggaguaaaauuugacgagucagagaaaacaaaagaaagcagagaagcaguagaaaaagaauuugaaccucuacuuaacuggaugaaagauaaggcuuuaaaagauaaaauagaaaaagcaguaguaagccaaagacuuacagaaucaccaugugcauugguagcaagucaauauggauggaguggaaacauggaaaggauaaugaaagcacaagcguaccaaacaggaaaagauauaucaacgaauuacuaugccagccagaaaaagacauucgaaauaaauccaagacacccauuaauaagagacauguuaagaagaauuaaagaagaugaagaugauaaaacuguauuagaccuugcaguaguuuuguucgaaacggcaacauuacgaaguggcuaucugcuaccggauacaaaagcauauggagacagaauagaacgaauguuaagacuaucauuaaauauagauccugaugccaaaguagaagaagaaccagaagaagaaccagaagaaacggcagaagauacaacagaagacaccgaacaagacgaggaugaggaaauggacguaggaacugaugaagaagaagaaacagcaaaagaaagcacugcagaaaaagaugaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2467 - RNA, 2332 nt, Artificial Sequence
  mRNA product Design1 comprising derived and/or modified sequence from Homo sapiens__NP_057376.2__HsTRAP1 (opt12)
gggagaaagcuuaccauggcaagagaacuaagagcauuacuauuauggggccgccgacuaagaccucucuuaagagcuccagcacuagcagccguaccaggcggaaagcccauacuauguccaaggagaacaacugcacaacuaggaccaagaagaaauccugcuuggagucugcaagcagguaggcuuuucuccacacaaacagcugaagacaaagaagaacccuuacauucaauaauaucuaguacagaaucuguucaaggaaguaccucaaaacaugaauuucaagcagaaacaaaaaaacuacuagacauaguagcacgaucacuauauagugaaaaagaaguuuuuauaagagaauuaauaaguaacgccucagaugcacuagaaaaauuacgacacaaauuaguaagcgauggucaagcuuuaccagaaauggaaauacauuuacaaacuaacgcugaaaaaggaaccauuacaauacaagauacagguauaggaaugacacaagaagaacuuguuaguaaucuaggaacaauagcucgaucaggaucaaaagcauucuuagacgcauuacaaaaccaagcagaagcuagcucgaaaauaauuggucaauuuggaguaggauuuuauucagcauucaugguugcagacaggguagaaguauauucacguagcgcugcaccaggaucauuagguuaccaauggcuaucagacgguucaggcguuuucgaaaucgcagaagcaucaggaguaagaacaggaacaaaaauaauaauacaccuaaaaagugauuguaaagaguucucuagugaagcaagaguuagagauguaguaacaaaauauucuaauuuuguaucguuuccacuauacuuaaauggacgaagaaugaauacacuacaagcaauauggaugauggauccaaaagauguacgagaauggcaacaugaagaauucuacagauacguugcacaagcacaugacaaaccaagauauaccuuacauuauaaaaccgacgcaccuuuaaauauaagaucaaucuuuuauguuccagacaugaaacccucuauguucgacguaucaagagaacuaggaaguaguguggcccuuuauucaagaaaaguccuaauucaaacaaaagcaacagauauauuaccuaaaugguugagauuuaucagaggaguaguagauucagaagacaucccauuaaaucuaaguagggagcuauuacaagaaucagcauuaauaaggaaacuaagagacguuuuacaacaaagacuuauaaaauuuuuuauagaucaaagcaaaaaagaugcagaaaaauacgcuaaauuuuucgaagacuaugggcuauuuaugagagagggaauaguaacagcaacugaacaagaaguaaaagaagacauugcaaaacuacucagauaugaaaguagugcucugccuagcggucaauuaacaagucugucugaauaugcuucacgaaugagggccggaacaagaaauauauacuacuuaugcgcaccaaaccgacacuuagcagaacauucacccuauuaugaggcaaugaaaaagaaagacacagaaguucuauuuugcuuugaacaauucgacgaacucacuuuacuacaccuaagagaauuugacaaaaaaaaauuaauuagcgucgaaacagauauagugguugaccauuauaaagaagaaaaauuugaggauagaucuccagcggccgaaugccuuucagaaaaagaaacagaagaacuuauggccuggaugagaaacguucuagggucuagaguaacaaaugugaaaguaacauuaagauuagacacacauccggcaaugguaacaguucuagaaaugggagcggcaagacacuuuuuaagaaugcaacaauuggcaaaaacacaggaagaaagagcacaauuauuacagccaacacucgaaaucaacccuagacacgcauuaauaaaaaaacuaaaucaacuaagagcaucagaaccaggacuugcacaauugcuagucgaucaaauauacgaaaaugcaaugauagcagcaggauuaguagaugauccacgagcgaugguaggacgacuaaaugaguuauuaguaaaagcauuagaaagacacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2468 - RNA, 679 nt, Artificial Sequence
  mRNA product Design1 comprising derived and/or modified sequence from Homo sapiens__NP_000609.1__HsIGF1 (opt12)
gggagaaagcuuaccaugggaaaaauaucaucacuaccaacacaacuauucaaaugcugcuucugcgacuuccuaaaaguaaaaaugcacacaaugucaucaucacaccuauucuaccuagcacuaugcuuauuaacauucacaucaucagcaacagcaggaccagaaacacuaugcggagcagaacuaguagacgcacuacaauucguaugcggagacagaggauucuacuucaacaaaccaacaggauacggaucaucaucaagaagagcaccacaaacaggaauaguagacgaaugcugcuucagaucaugcgaccuaagaagauuagaaauguacugcgcaccacuaaaaccagcaaaaucagcaagaucaguaagagcacaaagacacacagacaugccaaaaacacaaaaagaaguacaccuaaaaaacgcaucacgaggaucagcaggaaacaaaaacuacagaauguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2469 - RNA, 760 nt, Artificial Sequence
  mRNA product Design1 comprising derived and/or modified sequence from Homo sapiens__NP_000603.1__HsIGF2 (opt12)
gggagaaagcuuaccaugggaauaccaaugggaaaaucaaugcuaguacuacuaacauuucuagcauucgcaucaugcuguauagcagcauacagaccaucagaaacacuaugcggaggagaauuaguagauaccuuacaauuuguauguggagacagaggauucuauuucucaagaccagcaucaagaguaucaagaagaucaagaggaauaguagaagaaugcuguuucagaucaugugacuuagcauuacuagaaacauauugcgcaacaccagcaaaaucagaacgagauguaucaacaccaccaacaguacuaccagauaacuuuccaagauacccaguaggaaaauuuuuccaauacgauacauggaaacaaucaacacaaagacuaagaagaggacuaccagcacuacuaagagcaagaagaggacacguacuagcaaaagaacuagaagcauuuagagaagcaaaaagacauagaccacuaauugcauuaccaacacaagauccagcacacggaggagcaccaccagaaauggcaucaaacagaaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2470 - RNA, 856 nt, Artificial Sequence
  mRNA product Design1 comprising derived and/or modified sequence from Homo sapiens__NP_000591.1__HsIL6 (opt12)
gggagaaagcuuaccaugaacucauucucaacaucagcauucggaccaguagcauucucacuaggacuacuacuaguacuaccagccgcauucccagcaccaguaccaccaggagaagacucaaaagacguugcagcaccacacagacaaccccuaacauccucagaaagaauagacaaacaaauaagauacauacuagacggaauaucagcacuaagaaaagaaacaugcaacaaaucaaacaugugcgaaucaucaaaagaagcacuagccgaaaacaaccuaaaccuaccaaaaauggcagaaaaagacggaugcuuccaaucagguuucaacgaagaaacaugccuaguaaaaauaauaacaggacuccuagaauucgaaguauaccuagaauaccuacaaaacagauucgaaucaucagaagaacaagcaagagcaguacaaaugucaacuaaaguacuaauacaauuccuacaaaaaaaagcaaaaaaccuagacgcaauaacaacaccagacccaacaaccaacgcaucacuacucacaaaacuacaagcacaaaaccaauggcuacaagacaugacaacacaccuuauacuacgaucauucaaagaauuccuccaaucaucccuccgagcccucagacaaauguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2471 - RNA, 1498 nt, Artificial Sequence
  mRNA product Design1 comprising derived and/or modified sequence from Homo sapiens__NP_002183.1__HsINHBA (opt12)
gggagaaagcuuaccaugccauuacuaugguuaagaggauuuuuauuagcuaguugcuggauaauagucagaucaagcccaacgccaggaagcgaaggacacucagcagcuccagacuguccaaguugugcauuagcagcauuaccuaaagauguuccuaauucacaaccagaaaugguagaagcaguaaaaaaacauauauuaaauauguuacacuuaaaaaaaaggccagacguaacacaaccaguuccaaaagcagcauuauugaacgcaauaagaaaauuacacguaggaaagguaggggaaaacggauauguagaaauagaagacgauauaggaagaagagcagaaaugaaugaacuaauggaacaaacaagugaaauaauaacuuucgcagaaagcggaacagcaagaaaaacacuacacuuugaaauaaguaaagaagggagcgauuuaucaguaguagaaagagcagaaguaugguuauuucuaaaaguaccaaaagcaaauagaacuagaacaaaaguaacaauaagacuauuccaacaacaaaaacauccacaaggaucuuuagauacuggagaagaagcggaagaaguaggacuuaaaggagaaagaucagaacuacuauuaagugaaaaaguaguagaugcacgaaaaaguacauggcauguauuuccaguauccaguucaauacaaagacuauuagaucaaggaaaaagcagcuuagacguuagaauagcuugugaacagugucaagaaucaggagcaaguuuaguuuuacuaggaaaaaaaaaaaaaaaagaagaagagggagaagguaaaaaaaaaggugggggagaaggaggagcaggagcugaugaagaaaaagaacaaucacauagacccuucuuaaugcuacaagcaagacaaucagaagaucauccacauagaagaagacgaagaggcuuagaaugugauggaaaaguaaauauauguugcaaaaaacaauucuuuguaucauuuaaagauauaggauggaaugauuggauaauugcacccagcgguuaucaugcaaacuauugugaaggagaaugcccaucacacauagcgggaacuaguggaaguucauuaagcuuucacucaacugugauaaaucauuaucguaugagaggccauucgccguuugcaaauuuaaaaucauguuguguaccaacaaaacuaagaccaaugaguauguuauauuaugacgauggacaaaauauaauaaagaaagacauacaaaauaugauaguagaagaauguggauguaguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2472 - RNA, 1441 nt, Artificial Sequence
  mRNA product Design1 comprising derived and/or modified sequence from Homo sapiens__NP_002184.2__HsINHBB (opt12)
gggagaaagcuuaccauggacggauuaccuggcagagcuuugggagcagcaugucuauuacuauuagcugcaggaugguuaggaccagaagcauggggaucgccaacaccaccaccaacaccagcugcaccaccaccaccaccaccuccugguucaccaggcgggucucaagacaccuguacaagcuguggaggcuuuaggaggccagaagaacuaggaagaguagauggagacuuuuuagaagcuguaaaaagacauauacuuaguagacuccaaaugagaggaagaccaaauauaacacaugccguaccaaaagcugcaaugguaacugcacuucgaaaacuacaugcaggaaaaguaagagaagauggaaggguagaaauaccucaucuagauggacaugcaucaccaggagcagauggacaagaaagaguaucagaaauaauaucuuuugcagaaacagauggauuagcgucaucaagaguaagauuauacuuuuucauaucaaacgaaggaaaucaaaauuuauuuguaguacaagcgagcuuaugguuauaucuaaaauuauuacccuauguuuuagaaaaaggaucaagacgaaaaguaagaguaaaaguuuauuuucaggaacaaggacacggagacagauggaauaugguagaaaagagaguagacuuaaaaagaaguggauggcauacauucccacuaacugaagcaauucaagcacuauuugaaagaggagaaagaagauuaaaccuagaugugcaaugugauucuugucaagaauuagcagucguaccaguauuuguugauccaggagaagaaagucauagaccauuugugguaguucaagcaagauuaggagauaguagacauaggauaagaaaaagaggauuagaaugugauggaaggacaaauuuauguuguagacaacaauucuuuauugacuuuagauuaauaggauggaaugauuggauaauagcacccacaggauauuaugggaauuauugugaaggaaguuguccagcauacuuagcaggaguacccggaucagcaaguuccuuucauacagcaguugucaaccaauaucgaaugagaggguuaaauccagguacaguaaacucauguuguauaccaaccaaacuaaguacuaugagcauguuauauuuugaugaugaauauaacauuguaaaacgagauguaccaaacaugauaguagaagaauguggaugugcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2473 - RNA, 3676 nt, Artificial Sequence
  mRNA product Design1 comprising derived and/or modified sequence from Homo sapiens__NP_000623.2__HsITGAM (opt12)
gggagaaagcuuaccauggcauuaagaguauuacugcugacagcuuugacucuaugucacggcuucaaccuagacacagaaaaugcuaugaccuuucaagaaaaugcacgagguuucggacagucugucguccaacuacaaggaucaaggguuguagucggcgcaccccaagaaauuguagcagcaaaucaaagaggcuccuuauaucaaugcgacuacucaacagguagcugcgaaccaauacgucuucaaguucccguugaagcagugaacaugucacuugguuuaaguuuagcagcuacaacaagcccaccucaacuauuagcuugcggccccacaguacaccaaaccuguagcgaaaauacuuauguuaaaggauuguguuuccuauucgguuccaauuuacgacagcaaccucaaaaauucccugaagcacuucguggaugcccccaagaagauagcgauauagcauuuuuaaucgacgguuccggauccauaauaccccaugacuuccggagaaugaaagaauuuguaaguacagugauggaacaauugaagaaaucuaaaacucuauuuucucugaugcaauauagugaagaauuuaggauacacuuuacuuuuaaagaauuucaaaacaacccaaauccgagaucguuaguaaaaccgauuacucagcuuuuaggacgaacucauacagcuacuggaauacguaaaguaguaagagaacucuucaacauaacaaauggcgcacguaaaaaugcuuuuaagauauuaguaguaauuacagacggagaaaaauucggagauccucuaggauacgaagacguaauaccagaagcugauagagagggcguaauaagauauguaauaggcguuggagaugcauucagaagcgagaaaagcagacaagaauugaacacaaucgcaucuaaacccccacgagaucauguauuccaggucaauaauuucgaagcucuaaaaacaauacaaaaccaacugagagagaaaauauuugcaauagaagggacacaaacaggcucaucgagcucauuugaacaugaaaugagccaagaaggauuuucagcagcaauaaccucaaacggaccacuauuauccacuguuggaaguuaugauugggcagggggagucuucuuauacacguccaaagaaaaaucuacauuuauaaacaugaccagaguugacagugacaugaaugacgcuuaccucggcuaugcagcagcuauuauacuacgaaauagaguacaaucacuuguuuuaggggcaccacgguaccaacauauuggucuaguugccauguuccgacaaaauacaggaaugugggaaucaaaugccaauguaaaaggaacacaaauaggagcuuauuucggcgcaucauuauguuccguagauguagacucaaacggaucaacagauuuaguccugauuggugccccacauuauuaugaacaaacaagagguggucagguaaguguuuguccgcucccacgagguagagcccgauggcaaugcgaugcuguacuuuauggagaacaaggacagccauggggaagauucggggcagcacuaacaguacuaggugacgugaauggggauaaacuaaccgauguagcaauaggugcaccaggcgaagaagacaauagaggagcaguauacuuauuucacggaacaucaggcucaggaauaagcccuucgcacucacaaagaaucgcuggcaguaaauuaagcccucgccuucaauacuuuggacagucgcuuaguggaggccaagaucuaacaauggacggauuaguugaccuaacgguaggagcacagggucauguccuacuauuacgaucccaaccuguuuugcgugucaaagcaauuauggaguucaauccaagagaaguagcacgaaauguuuuugaaugcaaugaucaaguaguuaaaggcaaagaagcuggagaaguacggguuugucuacauguacaaaaauccacacgagaccgucuacgcgaaggucaaauacaaucaguaguuaccuaugaucuugcacuugacucuggaagaccucacucuagggcuguauuuaaugaaacuaaaaauuccacgagacgacaaacacaaguacuaggucuuacccaaacuugugaaaccuuaaagcuacaacucccaaauugcauagaagauccaguaaguccaauaguacugagacucaauuucucccuugucggaaccccucuaagcgcguucggaaacuuacgaccaguacuagcagaagacgcacagagacuuuuuacugcacuuuuuccauucgagaaaaauugcggaaacgacaauauaugucaagacgacuuaucuauaacauuuucauucaugucauuagauuguuugguaguuggagguccccgggaguucaaugucacaguaacagucagaaaugauggagaagauucuuaccgaacacaaguuaccuuuuucuuuccacuugauuuaagcuaccgaaaagucucuacacuacagaaccaacgaagucaacgcucguggagacuugcaugugaaagcgcuucuucaacugaaguuucaggugcuuugaaaucaacaucauguaguauaaaccaucccauuuuuccggaaaauucugaaguuacauuuaacauuacguucgaugucgauucaaaggcuucucuugguaauaaauuacuauugaaagcaaaugucacauccgaaaauaauaugccaaggaccaacaaaacagaguuccaacuugaauuaccuguaaaauaugcugucuacaugguuguaacaucacauggaguaucuaccaaauaucucaauuuuacagcaucugaaaauacuucacgaguaaugcaacaccaauaccaaguaucaaauuuaggacaacgaucacucccaauuagucuuguuuuucuagucccagucagauugaaucaaacaguaaucugggauagaccacaaguaacauuuucugaaaacuuaagcaguacaugucauacaaaagaacgcuuaccaucccauuccgacuuucuugcugaauuaagaaaagcaccugucgucaauugcucaaucgcagugugccaacgaauacaaugugacauucccuucuuuggcauacaagaagaguuuaacgcuacacuaaagggcaauuuauccuuugacugguacauaaaaacaucacauaaucaucuauuaauuguaucaacagcagaaauauuauuuaacgacagcguauucacacuucuccccgggcaaggagcuuuugucagaagucaaacagaaacaaaaguagaaccauucgaaguuccaaaccccuuaccucucauaguagguuccucgguagguggauuacuacugcuugcauuaauuacagccgcuuuauauaaacuuggauucuuuaagagacaauauaaggauaugaugucugaaggaggaccuccuggcgcagaaccacaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2474 - RNA, 1621 nt, Artificial Sequence
  mRNA product Design1 comprising derived and/or modified sequence from Homo sapiens__NP_002415.1__HsMMP8 (opt12)
gggagaaagcuuaccauguucucacuuaaaacucucccauucuuacuacuacuacacguccaaauaucaaaagccuuccccguauccucaaaagaaaaaaauacuaaaacaguucaagacuaccucgaaaaauucuaccaacuaccuucaaaccaauaccaaucaacaagaaaaaaugguacuaaugucauagucgaaaaauuaaaagaaaugcaaagauuuuuuggacuuaacguuacaggaaaaccuaacgaagaaacccuagacaugaugaaaaaaccacgaugcggagucccagacucaggaggcuucaugcuaacaccaggaaauccaaaaugggaacguacaaacuuaacauaccgcauacgaaacuacaccccacaacuaagugaagcagaaguagaacgcgccauaaaagacgccuucgaacuauggucaguagcaagcccacucauauuuacuagaauaucacaaggugaagcugauaucaauaucgcauuuuaccaacgagaccacggcgauaacucaccauucgacggcccaaauggaauacuagcccacgcauuccaaccaggacaaggaauaggaggugacgcacacuucgacgcagaagaaaccuggacaaacacaucagcaaacuauaacuuauuucuagucgccgcacacgaauucggacacucacuagguuuagcacacucaucagacccaggcgcacuaauguaucccaacuaugcauucagagaaaccucaaauuauucauuaccucaagacgauauagacggaauucaagcaauauauggacuuucuucaaauccaauacaaccaacaggcccuucaaccccaaaacccugugaucccucacuaacauucgacgcaaucacaacucuacgaggagaaauuuuauucuuuaaagacagauauuuuuggagaagacacccacaacuacaaagaguagaaaugaacuucauaagcuuauucuggccaucacuaccaacaggcauucaagcagcauacgaagacuucgauagagaccuaauauucuuauuuaaaggaaaccaauauugggcacuaucagguuacgacauacuacaaggauacccaaaagacauauccaauuauggauucccaucaucaguacaagcaauagacgcagcaguauucuauagaucaaaaaccuacuucuucguaaaugaucaauucuggagauacgacaaccaacgccaauucauggaacccggauaucccaaaucaauaucaggagcauucccaggaauagaaucaaaaguagacgcuguauuccaacaagaacauuucuuucaugucuucuccggacccagguacuacgcauuugauuuaauagcccaaagaguaacacgaguagcaagaggaaauaaaugguugaauuguagauacggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2475 - RNA, 2341 nt, Artificial Sequence
  mRNA product Design1 comprising derived and/or modified sequence from Homo sapiens__NP_004985.2__HsMMP9 (opt12)
gggagaaagcuuaccaugagccuuuggcaacccuuaguuuuaguuuuacuaguauuaggaugcugcuucgcagcuccuagacaaaggcaaucaacacuuguucucuuuccaggagacuuacgaacaaaucuaacagauagacaacuagcagaagaauacuuauauagauauggauauaccagaguugcagaaaugagaggagaaaguaaaucguuaggaccugcccuacuacuucuucaaaaacaauuaucauuaccagaaacaggagaacuagauucugcuacacuaaaagcaaugagaaccccuagaugcggaguuccagauuuaggccgauuucaaacauuugaaggagaccuaaaauggcaccaucauaauauaacuuauuggauacaaaauuacucugaagacuuaccgagagccguaauagacgaugcauucgcuagagcauuugcuuuauggucagcaguuacaccccuaacauuuacuagaguauauucaagagaugcugauauaguaauucaauuuggagucgcagaacauggugauggauauccauuugauggaaaagacggauuauuagcccacgcauucccaccugguccaggcauucaaggagaugcacauuucgacgaugacgaauuauggagcuuaggaaaaggaguaguaguaccuacacgcuuugggaaugcugauggagcagcaugccauuucccauuuauuuucgaagguagaucauacucugcaugcacuacagauggaagauccgauggauuaccuuggugcagcacaacagcuaauuaugacacugaugacagauuugguuuuuguccauccgaaagacuuuacacacaagacggaaaugcagaugguaaaccaugccaauuuccuuuuauauuucagggacaaucauauucagcuuguacaacagaugggagaagugauggauaccgcuggugugcaaccacugccaauuaugauagagacaagcuauuuggauucuguccuacaagagcagacucgacuguaauggguggaaauucagccggagaacuaugugucuucccauuuacauuuuuagguaaagaauacucuacauguacuucagaaggccguggugauggaagacuuuggugugcaacaacaucaaauuucgacucugacaaaaaauggggauuuuguccagaucaaggauacagcuuauuucuaguugcagcacacgaauuuggacaugcacuagguuuagaucacaguucaguaccagaagcauuaauguauccaauguauagauuuaccgaagggccuccccuucacaaagaugacguuaauggaauaagacacuuauacggacccagaccugaaccugaaccaagaccuccuacuacaacuacuccacaaccaacagccccaccaacaguaugcccaacgggaccgccaacaguacacccaagcgaaagaccaacugcuggaccaacaggaccacccagugcagguccaacugguccaccuacagcaggcccaucuacugcaacaacagucccauuaaguccaguggacgaugcaugcaacguuaacauauucgacgcaauugcagaaauuggaaaucaauuauaucuuuuuaaagauggaaaauacuggagguucucagaaggaagagguucaagaccacaagguccauuucuuauagcugauaaauggccagcucuccccagaaaauuagacucaguauucgaagaacgauuaaguaaaaaauuauucuucuuuucaggcagacaaguuuggguauauacuggugcaaguguacucggaccaagaagacuugauaaauuaggcuuaggggcagacguugcacaaguaacuggagcccuaagauccggucgaggaaaaauguuauuauucucaggaagaagauuauggagauuugauguuaaagcacaaaugguugauccaagaucagcaucagaaguagacagaauguuuccaggcguaccacuagauacucaugacguauuucaauaucgggaaaaagcguacuuuugucaagauagauuuuauuggagaguuucuucaagaucagaauuaaaccaaguagaucaaguuggauauguaacauaugauauccuacaaugcccagaagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2476 - RNA, 1633 nt, Artificial Sequence
  mRNA product Design1 comprising derived and/or modified sequence from Homo sapiens__NP_002418.1__HsMMP13 (opt12)
gggagaaagcuuaccaugcacccaggaguacuagcagcauucuuauucuuaucuuggacccacuguagagcacuaccucuaccuagcggaggagaugaagaugaccucucagaagaagaccuacaauucgcagaaagauaucuacgaucuuauuaccacccaacaaacuuagcaggaauacuaaaagaaaacgcugcaucaucaaugacagaaagacuaagagaaaugcaaucauuuuucggacuagaaguaacaggaaaauuagacgacaacacauuagacguaaugaaaaaaccaagaugcggaguaccagaugucggagaauacaacgucuucccaagaacauuaaaauggagcaaaaugaaccuaacauauagaauaguaaauuacacacccgacaugacacacucagaaguagaaaaagcauuuaaaaaagcauucaaaguaugguccgaugucacaccccuaaacuucacaagauuacaugacggaauagcagacauaaugauaucuuucggaauaaaagaacacggugacuucuacccuuucgacggaccaucaggacuauuagcacacgcauucccacccggaccaaauuacggaggagaugcacacuuugacgaugaugaaacuuggacaucaucaucaaaagguuauaacuuauuucucguagcugcccacgaauucggacacucacuagggcuagaccacagcaaagaccccggagcauuaauguuuccaauuuauacauauacaggaaaaagucacuuuaugcuaccggacgacgacguacaaggcauacaaucacucuacgguccaggagacgaagacccaaacccaaaacaccccaaaacaccagauaaaugcgacccaucacuaucauuagaugcaauaacaucauuaagaggagaaacuaugauuuucaaagacagauucuucuggagguuacacccccaacaaguagaugcagaacucuuucuaacaaaaucauuuuggccagaauuaccaaauagaauugacgcugcauacgaacacccaucacacgaccuaauauuuauauucagaggaagaaaauucugggccuuaaacggauaugacauacuagaaggauacccaaaaaaaauaucagaauuaggucuacccaaagaaguaaaaaaaauaucagcagccguccacuucgaagacacuggaaaaacauuacucuuuaguggcaaccaaguauggagauaugacgauacaaaccacauaauggauaaagacuacccaagauuaauagaagaagacuuuccaggaauuggagacaaaguagacgccguauacgaaaaaaauggauacauauacuuuuucaacggaccaauucaauucgaauauuccauauggucaaaccgaauaguuaggguaaugccagcaaacuccauauuaugguguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2477 - RNA, 1285 nt, Artificial Sequence
  mRNA product Design1 comprising derived and/or modified sequence from Homo sapiens__NP_001286.1__HsCCR1 (opt12)
gggagaaagcuuaccauggaaacaccaaauacaacagaagacuaugacacaacuacagaauucgacuauggcgacgccacaccaugccaaaaaguaaacgaaagagcauucggcgcacaauuauuaccaccuuuauacucauuaguauucguaauaggauuaguaggaaacauacuaguaguauuaguacuaguacaauacaaaagacuaaaaaacaugacauccauauaccuacuaaacuuagcaauaucugaccuacuauuccuauucacucuaccauucuggaucgacuauaaacuaaaagaugacuggguuuucggugacgcaaugugcaaaauccucucaggauuuuacuacacaggauuauacagcgaaaucuuuuucaucauacuauuaaccaucgaccgauaccuagccauaguacacgcaguauucgcacucagagccagaacaguaacuuucggcguaauaacaucaauaauaaucugggcauuagccauacucgcaucaaugccaggacuauacuucucaaaaacacaaugggaauucacccaucacacaugcucauuacacuucccucacgaauccuuaagagaauggaaacuauuucaagcccuaaaauuaaacuuauucggacuaguacuaccuuuacuaguaaugauaaucuguuacacaggaauuauaaaaauacuacucagaagacccaacgaaaaaaaaucaaaagccguaagauuaauauucguaauaaugauaauuuucuucuuauucuggacaccauacaacuuaacaauacucauuuccgucuuccaagacuucuuauucacucacgaaugcgaacaaucaagacaucuagaccuagcaguccaagucaccgaaguaauagcauacacacacugcugcguaaacccaguaauuuacgcauucguaggagaacgauucagaaaauaccuuagacaacuuuuucacagaagaguagcaguccaccuugucaaauggcuaccauuuuuaucuguagacagacuagaaagaguaucuucaacaucaccaucuacaggagaacacgaacucucugccggcuuuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2478 - RNA, 853 nt, Artificial Sequence
  mRNA product Design1 comprising derived and/or modified sequence from Homo sapiens__NP_002598.4__HsPDGFA (opt12)
gggagaaagcuuaccaugcgaacacuagccugccuauuacuacuaggaugcggauaccuagcacacguacuagcagaagaagcagaaauaccaagagaaguaauagaaagacuagcaagaucacaaauacacaguauaagagaccuacaaagacuacuagaaauagacucaguaggaucagaagacucacuagacacaucacuaagagcacacggcguacaugcaacaaaacacguacccgaaaaaagaccauuaccaauaagaagaaaaagaagcauagaagaagccguaccagcaguauguaaaacaagaacaguaauauacgaaauaccaagaagccaaguagacccaacaucagccaacuucuuaauauggccaccaugcguagaaguaaaaagaugcacaggaugcugcaacacaagcagcgucaaaugccaaccaaguagaguacaccaucgaucaguaaaaguagcaaaaguagaauacgucagaaaaaaaccaaaacuaaaagaaguacaaguaagacucgaagaacaccuagaaugcgcaugcgccacaacaagccuaaacccagacuacagagaagaagacacaggaagaccaagagaaucaggaaaaaaacgaaaaagaaaaagacuaaaaccaacuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2479 - RNA, 943 nt, Artificial Sequence
  mRNA product Design1 comprising derived and/or modified sequence from Homo sapiens__NP_002599.1__HsPDGFB (opt12)
gggagaaagcuuaccaugaacagaugcugggcacuauuccuaucauuaugcuguuacuuaagacuaguaucagcagaaggagauccaauaccagaagaauuauacgaaauguuaagugaucacucaauaagaagcuuugacgauuuacaaagacuacuacauggagauccaggagaagaagacggagcagaacuugaucuaaauaugacaagaucacacaguggaggagaauuagaaucacuagccagaggaagaagaagucuaggaucacucacaaucgcagaaccagcaaugauagcagaauguaaaacaagaacagaagucuucgaaaucucaagacgacuaauagacagaacaaaugcaaacuucuuaguauggccaccaugcguagaaguacaaagaugcucaggaugcugcaauaacaggaacguacaauguagaccaacacaaguacaacuaagacccgugcaaguaagaaaaauagaaauaguaagaaaaaaaccaaucuuuaaaaaagcaacaguaacacuagaagaucaucuagcaugcaaaugcgaaacaguagcagcugcaagaccaguaacaagaucaccaggaggaagccaagaacaaagagcaaaaacgccacaaacaagaguaacaauaagaacaguuagaguaagaagaccaccaaaaggaaaacauagaaaauucaaacacacacacgauaaaacagcauuaaaagaaacauuaggagcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2480 - RNA, 1255 nt, Artificial Sequence
  mRNA product Design1 comprising derived and/or modified sequence from Homo sapiens__NP_057289.1__HsPDGFC (opt12)
gggagaaagcuuaccaugucauuauucggauuauuacuuuuaacaucugcauuagcaggacaaagacaaggaacacaagcagaaucaaaccuaucaagcaaauuucaauuuucaucaaauaaagaacaaaauggcguacaagauccacaacacgaaagaauaauaacaguaagcacuaacggaucaauacacagcccccgauucccacauacauacccaagaaacacaguauuaguauggagauuagucgccguagaagaaaauguauggauacaacuuacauucgaugaaagauucggauuagaagaccccgaagacgacauaugcaaauacgacuucguagaaguagaagaacccucagacggaacaauauuaggucguuggugcggaucaggaacaguaccaggaaaacaaauaaguaaaggaaaccaaauaagaauucgauucguaucagaugaauacuuuccaucagaaccaggauucugcauccauuacaauauaguaaugccacaauuuacagaagcaguaucaccaagcguauuaccaccaucagcccuaccucuagacuuauuaaauaacgcaauaacagcauuuagcaccuuagaagacuuaauacgauacuuagaaccagaacgauggcaacuagaccuugaagaccuauacagaccaacauggcaauuacuaggaaaagcauucgucuuuggcagaaaaucaagaguaguagaucuaaaccuacuaacagaagaaguaagauuauacaguugcacaccuagaaacuucucaguaagcauaagagaagaacuaaaaagaacagacaccauauucuggccaggaugccuacuaguuaaaagaugcggaggaaauugcgcauguugcuuacacaacuguaacgaaugccaaugcguacccucaaaaguaacaaaaaaauaccacgaaguacuacaauuaagaccaaaaacaggaguaagaggacuccacaaaucacuuacagacguagcacuagaacaccacgaagaaugugacugcguaugcagaggcucaaccggaggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2481 - RNA, 1312 nt, Artificial Sequence
  mRNA product Design1 comprising derived and/or modified sequence from Homo sapiens__NP_149126.1__HsPDGFD (opt12)
gggagaaagcuuaccaugcauagauuaauauucguauacacacuaauaugugcaaacuucugcucaugcagagacaccagugcaacaccccaaagcgcaucaauaaaagcacuacgaaacgcaaacuuaagaagagacgaucuauauagaagagaugaaacaauacaaguaaaaggaaacggauacguacaaucaccacgauuuccaaauucauacccacgaaaccuauuauuaacauggcgacuacacucacaagaaaauacaagaauacaacuugucuucgacaaccaauucggacuagaagaagcagaaaaugacauaugcagauaugacuucguagaaguagaagacauaucagaaacuucaacaauaauaagaggaagaugguguggacacaaagaagucccaccaagaauaaaaucaagaacaaaccaaauaaaaauaaccuucaaaucagaugacuacuucguagcaaaaccgggcuuuaaaauauacuauagccuauuagaagacuuccaaccagcagcagcaucagaaaccaacugggaaucaguaacaagcucaauaucuggaguaucauacaacucaccaucaguaacagauccaacacuaauagcagacgcauuagacaaaaaaauagccgaauucgacacaguagaagaucuacuaaaauacuucaacccagaaucauggcaagaagaccuagaaaacauguaccuagacacaccaagauacagaggaagaucauaccaugacagaaaaaguaaaguagaccuagacagacuaaacgacgaugcaaaaagauacagcugcacaccaagaaauuacucaguaaacauaagagaagaacuaaaacuagcaaacguaguauucuucccaagaugcuuauuaguacaaaggugcggaggaaauuguggaugcggaacaguaaacuggagauccuguacaugcaacucaggcaaaacagucaaaaaauaccacgaaguacuacaauucgaaccaggacacauaaaaagaagaggcagagcaaaaacaauggcacuaguagacauacaacucgaucaccacgaaagaugcgacuguauaugcucaagcagaccaccacgauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2482 - RNA, 895 nt, Artificial Sequence
  mRNA product Design1 comprising derived and/or modified sequence from Homo sapiens__NP_003946.3__HsSOCS3 (opt12)
gggagaaagcuuaccaugguaacacacucaaaauucccagcagcaggaaugucacgaccucuagacacaucauuacgacuaaaaacauucucaucaaaaucugaauaccaacuaguaguaaacgcaguaagaaaauuacaagaaucaggauucuacuggucagcaguaacaggaggagaagcaaaccuacuauuaucagcagaaccagcaggaacauuccuaauaagagacucaucagaccaaagacacuucuuuacacuaucaguaaaaacccaaucuggaacaaaaaaccuacgaauacaaugugaaggaggauccuucucucuacaaucagacccaagaucaacacaaccaguacccagauuugacugcguacuaaaauuaguacaccacuacaugcccccacccggagcaccaucauucccaucacccccaacagaacccucaucagaaguaccagaacaaccaucagcacaaccacuaccaggcucaccaccaagaagagcuuauuacauauacuccggaggagaaaaaauaccacuaguucuaucaagacccuuaucaucaaacguagccacacuacaacaccuaugcagaaaaacaguaaacggacacuuagacucauacgaaaaaguaacacaacuuccaggaccaauaagagaauucuuagaucaauacgacgcaccauuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2483 - RNA, 700 nt, Artificial Sequence
  mRNA product Design1 comprising derived and/or modified sequence from Homo sapiens__NP_003227.1__HsTGFA (opt12)
gggagaaagcuuaccaugguaccaucagcaggacaauuagcauuauucgcauuaggaauaguauuagcagcaugucaagcauuagaaaauucaacaucaccauuaucagcagacccaccaguagcagcagcaguaguaucacauuuuaaugauugcccagauucacauacacaauucugcuuucauggaacauguagauuuuuaguacaagaagauaaaccagcauguguaugucauucaggauauguaggagcaagaugugaacaugcagauuuauuagccguaguagcagcaucacaaaaaaaacaagcaauaacagcauuaguaguaguaaguauaguagcauuagcagucuuaauaauaacauguguauuaauacauuguugucaaguaagaaaacauugugaauggugcagagcauuaauauguagacaugaaaaaccaucagcacuauuaaaaggaagaacagcauguugucacucagaaacaguaguauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2484 - RNA, 1390 nt, Artificial Sequence
  mRNA product Design1 comprising derived and/or modified sequence from Homo sapiens__NP_000651.3__HsTGFB1 (opt12)
gggagaaagcuuaccaugccaccaaguggauuaagacuacuaccauuacuauuaccacuauuauggcuacuaguauuaacaccuggaagaccagcugcaggccuaucaaccugcaaaacaauagacauggaacuaguaaaacgaaaaagaauagaagcaauaagaggccaaauacuaucaaaacuaagauuagcaucaccaccuucccaaggagaaguaccaccaggcccacuaccagaagcaguacuagcacuauacaacuccacaagagacagaguagcaggcgaaucagccgaaccagaaccagaaccagaagcugacuacuacgcaaaagaaguaacuagaguauuaaugguagaaacacacaacgaaaucuaugacaaauuuaaacaaucuacacauucuauauauauguucuucaauacaagcgaauuacgagaagcaguacccgaaccaguacuauuaucaagagcugaacuccgauuacuaagauuaaaacuaaaaguagaacaacacguagaacuauaccaaaaauauucuaauaauucauggagauaucuuagcaauagauuacuagcaccauccgacucaccugaauggcuaucauuugauguaacaggaguaguacgucaauggcuaucacgaggcggagaaauagaaggauuuagauuaagcgcucacugcagcugugacucaagagacaacacauuacaaguagacaucaacggauucacaacaggaagaagaggagaucuagccacaauacacggaaugaacagaccauuucuacuauuaauggcaacaccacuagaaagagcacaacaucuacaaucuucaagacacagaagagcauuagacacaaacuacugcuuuucaagcacagaaaaaaauugcugcgucagacaauuauauauagauuucagaaaagauuuaggcuggaaauggauacaugaaccaaaaggauaccacgcaaacuucugccuaggaccaugcccauacauuuggucauuagauacccaauacucaaaaguucuugcauuauacaaccaacacaacccuggagcaagugcagcaccauguugcguaccccaagcauuagaaccacuaccaauaguauauuacguuggccgaaaacccaaaguagaacaacuaucaaacaugauagucagaucauguaaauguucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2485 - RNA, 1462 nt, Artificial Sequence
  mRNA product Design1 comprising derived and/or modified sequence from Homo sapiens__NP_003229.1__HsTGFB2 (opt12)
gggagaaagcuuaccaugcacuacugcguacucucagccuuccuaauacuacaccuaguaacaguagcauuaagcuuaucaacaugcucaacacuagacauggaucaauucaugagaaaaagaauagaagcaauaagaggccaaauacuaucaaaacuuaaauuaacaucaccaccagaagacuaucccgaaccagaagaaguaccaccagaaguaauaucaauauauaacucaacaagagaccuauuacaagaaaaagcaagccgaagagcagcagcaugcgaacgagaaaggucagacgaagaauacuacgccaaagaaguauacaaaauagacaugccacccuucuucccaucagaaaaugccauaccccccacauuuuacagaccauacuucagaaucguaagauucgacguaucagcaauggaaaaaaacgcaucaaaucuaguuaaagcagaauucagaguauucagacuacaaaacccaaaagcaagaguaccagaacaaagaauagaacuauaccaaauacuuaaauccaaagaucuaacaucaccuacacaaagauauauagacucaaaaguaguaaaaacuagagcagaaggcgaauggcuauccuucgacguaacagacgccguucacgaauggcuucaccacaaagaccgaaacuuaggauucaaaauaucacuucacuguccauguugcacauuuguccccucaaauaacuacauaauccccaauaaaucagaagaacucgaagcaagauucgccggaauagacggaacuagcacauauaccuccggagaccaaaaaaccauaaaaucuacaagaaaaaaaaacucuggaaaaacaccacacuuacuauuaaugcuacuacccucauaccgacucgaaucucaacaaacaaacagacgaaaaaaaagagcauuagacgccgcuuauuguuucagaaauguacaagauaacugcugccuacgaccacuauacauagauuucaaaagagaucuaggcuggaaauggauccaugaaccaaaaggcuauaacgcaaacuucugcgcuggagcaugcccauaccuauggucaucagacacacaacauucaagaguauuaucacuuuacaacaccauaaaucccgaagcaucagcaagccccuguugcguaucacaagaccuagaaccacuaaccauccuauacuauauaggaaaaacuccaaaaauagaacaacuaucuaauaugauaguaaaaucaugcaaaugcucuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2486 - RNA, 1456 nt, Artificial Sequence
  mRNA product Design1 comprising derived and/or modified sequence from Homo sapiens__NP_003230.1__HsTGFB3 (opt12)
gggagaaagcuuaccaugaaaaugcacuuacaaagagcccuaguaguccuagcuuuacuuaacuucgcaaccguaucccuaagccuaucaacuuguacaacccuagacuuuggacacauaaaaaaaaaacgcguagaagcaauuagaggacaaauauuaucuaaacuaagauuaaccucaccaccagaaccaacaguaaugacacauguaccauaccagguauuagcacuauacaauucaacacgcgaacuacuagaggaaaugcauggagaaagagaagaaggaugcacacaagaaaacacagaaucagaauacuacgcaaaagaaauccauaaauucgacaugauacaaggauuagcagaacacaacgaacuagcaguaugcccaaaaggaauaacaucaaaaguauuuagauucaauguaucuucaguugaaaaaaauagaacuaaccucuuuagagccgaauuccgcguauuaagaguccccaacccaagcagcaaacgaaacgaacaaagaauagaacuauuccaaauacuaaggccagacgaacacauagcaaaacaaagauauauaggaggcaaaaauuuacccacaagagguacagcagaauggcuaucauucgauguaacagauaccguaagagaauggcuacuaagaagagaaaguaaucuaggccuagaaauaucaauacauuguccaugucacacauuccaaccaaacggagacauauuagaaaacauacacgaaguaauggaaauaaaauucaaaggaguagacaacgaagaugaucacggacgaggcgaucuaggcagauuaaaaaaacaaaaagaccaccacaauccacaccuaauauuaaugaugauaccaccacacagacuagacaauccaggccagggaggccaaagaaaaaaaagggcacuagacaccaacuacugcuucagaaaccuagaagaaaacugcugcguaagaccacuauacauugacuucagacaagaccuaggcuggaaauggguccaugaaccaaaaggauacuacgccaacuuuugcucaggaccaugcccauaccucagaucagcagacacaacccacucaacaguauuagguuuauacaacacauuaaacccagaagcaagugccuccccuuguugcguaccacaagaccuagaaccauuaaccauauuauauuauguaggacgaacaccaaaaguagaacaacuaucaaauaugguaguaaaaucaugcaaauguagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2487 - RNA, 1603 nt, Artificial Sequence
  mRNA product Design1 comprising derived and/or modified sequence from Homo sapiens__NP_001057.1__HsTNFRSF1B (opt12)
gggagaaagcuuaccauggcuccuguagccguaugggcagcucuagccguaggauuagaauuaugggcugcugcccaugcacuaccugcccaaguugcuuuuacaccauacgcaccagaaccugguucaacauguagauuaagagaauauuaugaucaaacugcucaaauguguuguucaaaauguagcccuggucaacaugccaaaguauucuguacuaaaacuucugauaccguaugugauucaugugaggauucaacauauacacaauuauggaauuggguaccagaauguuuaucauguggaucucgauguucaucagaucaaguagaaacacaagcuuguacaagagaacaaaauagaauauguacuuguagaccagguugguacugcgccuuaucaaaacaagaaggauguagacuaugcgccccacuacgaaaauguagaccaggauuugguguugcacguccaggaacagaaacaucagacguaguauguaaaccaugcgcucccgguacauucucaaauacaacaucauccaccgauauaugucgaccacaucaaauauguaauguaguagcaauaccaggaaaugcaucuauggacgcaguauguacaucaacaucacccacaagaucaauggcaccaggugcuguccaucuaccacaaccuguuucaacaagaucacaacauacacaaccuacacccgaaccauccacagcaccaaguaccucauuucuuuuaccuaugggaccaucaccaccugcagaaggaucaacaggagauuuugcacuuccaguaggacuaauaguuggaguaacugcacuaggauuauuaauaauuggagucguaaauuguguaauaaugacacaaguaaaaaaaaaaccauuaugcuuacaacgagaagccaaagucccucauuuaccagcagacaaagcuagaggaacccaaggaccagaacaacaacaccuacucauaaccgcaccuucaucaucuucaucaucuuuagaaucaucugcaucugcauuagauagaagagcacccacaagaaaucaaccacaagcaccuggaguugaagcuuccggggcaggugaagcucgagcuucaacaggaucuucagauucaucuccagguggucauggaacccaaguuaauguaacuugcaucguaaauguauguucaucaucagaucacucaucacaauguucaucacaagcaaguucaacuaugggagauacugacucaagcccaucggaaucaccuaaagaugaacaaguaccauuuaguaaagaagaaugugcauuuagaucucaacuugaaacaccagaaacuuuauuaggaaguacagaagaaaaaccacuaccauuaggaguacccgaugcagggaugaaaccuuccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2488 - RNA, 730 nt, Artificial Sequence
  mRNA product Design1 comprising derived and/or modified sequence from Homo sapiens__NP_002623.2__HsPGF (opt12)
gggagaaagcuuaccaugccaguaaugaggcuauuuccauguuuuuuacaauuacuagcaggauuagcauuaccagcaguaccaccacaacaaugggcauuaagugcaggaaauggaaguucagaaguagaaguaguaccauuucaagaaguauggggaagaucauauuguagagcacuugaaagauuaguagauguaguaagugaauauccaagcgaaguagaacauauguuuucaccaucauguguaaguuuauuaagauguacaggauguuguggagaugaaaaucuacauuguguaccaguagaaacagcaaauguaacaaugcaauuacuaaaaauaagaaguggagauagaccaucauauguagaauuaacauucagucaacauguaagaugugaauguagaccauuaagagaaaaaaugaaaccagaaagaagaagaccaaaaggaagaggaaaaagaagaagagaaaaacaaagaccaacagauugccauuuauguggagaugcaguaccaagaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2489 - RNA, 1456 nt, Artificial Sequence
  mRNA product Design1 comprising derived and/or modified sequence from Homo sapiens__NP_001020537.2__HsVEGFA (opt12)
gggagaaagcuuaccaugacagacagacaaacagauacagcaccuucaccaagcuaucacuuauuaccugguagaagaagaacaguagaugcagcagcuaguaggggacaaggaccagaaccagcuccaggaggagguguagaaggaguaggggcaagaggaguagcuuuaaaauuauuuguacaacuuuuaggauguagcagguuuggaggagcgguuguaagagccggugaagcagaaccgucaggagcagcaagaucagcaagcucaggaagggaagaaccacaaccagaagaaggugaagaagaagaagaaaaggaagaagaaaggggaccacaauggcgacugggagcaagaaagccagguaguuggacaggagaagcagcaguaugcgcagacucugcaccagcagcaagagcaccgcaagcauuagcucgagcaaguggaaggggaggaagaguagcucgaagaggagcagaagaaucaggaccuccacacaguccaaguaggagaggaagugcaagcagggcaggaccagggagagcaagcgaaacaaugaauuuucuauugaguuggguacauuggagccuagcccuauuauuauauuuacaucaugcuaaauggucacaagcagcaccaauggcagaaggaggaggacaaaaucaucaugagguagugaaauuuauggauguauaucaaagaucauauugucauccaauagaaacauuaguugacauauuucaagaauauccagaugaaauagaauauaucuuuaaaccuagcugugucccauugaugagauguggaggauguuguaaugaugagggauuagaaugcguaccaacagaagaaaguaacauaacaaugcaaauaaugcgaauaaaaccacaucaaggacaacauauaggagaaaugucauuuuugcaacauaacaaaugcgaaugcaggccaaaaaaagacagagcaagacaagaaaaaaaaaguguuagaggaaaaggaaaaggucaaaaaaggaaaagaaaaaaaaguagauauaaaaguuggaguguauauguaggagcaagauguuguuuaaugccauggagucuaccgggaccacauccauguggaccuugcagugagaggagaaaacacuuauuuguucaagacccacaaacauguaaauguucuuguaaaaacacugauagcagauguaaagcucgacaauuggaauuaaaugaaaggacauguagaugugauaaaccaagaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2490 - RNA, 916 nt, Artificial Sequence
  mRNA product Design1 comprising derived and/or modified sequence from Homo sapiens__NP_001165094.1__HsVEGFA (opt12)
gggagaaagcuuaccaugaacuuccuauuaagcuggguacacuggucacuagcauuauuauuauauuuacaucacgccaaauggucacaagcagcaccaauggcagaaggaggaggacaaaaccaccacgaaguaguaaaauuuauggauguauaccaaagaagcuauugccauccaauagaaacacuaguagacauauuccaagaauauccagaugaaauagaauauauauuuaaaccauccugcguaccauuaaugagaugcggaggaugcugcaacgacgaaggacuagaaugcguaccaacagaagaaaguaauauaacaaugcaaauaaugagaauaaaaccacaccaaggacaacacauaggcgaaaugaguuucuuacaacauaacaaaugcgaaugcagaccaaaaaaagacagagcaagacaagaaaaaaaaagcguaagaggaaaaggaaaaggacaaaaaagaaaaagaaaaaaaagcagauacaaaagcuggagcguauacguaggagcaagaugcugcuuaaugccauggucacuaccaggaccacacccaugcggaccauguucagaaagaagaaaacaucuauuuguacaagacccacaaacauguaaaugcucaugcaaaaacaccgacaguagauguaaagcaagacaacuagaacuaaaugaaagaaccuguagaugugacaaaccaagaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2491 - RNA, 841 nt, Artificial Sequence
  mRNA product Design1 comprising derived and/or modified sequence from Homo sapiens__NP_003368.1__HsVEGFB (opt12)
gggagaaagcuuaccaugucaccacuauuaagaagacuacuauuagcagcauuacuacaacuagcaccagcacaagcuccaguaagccaaccagacgcacccggacaucaaagaaaaguaguaucauggauagauguauacacaagagcaacaugucaaccaagagaaguuguagucccacuaacaguagaauuaaugggaacaguagcaaaacaauuaguaccaucaugcguaaccguacaaagaugcggaggauguugcccagacgauggcuuagaaugcguaccaacuggacaacaucaaguaagaaugcaaauacuaaugauaagauacccaucaucacaauuaggagaaaugucauuagaagaacauucacaaugcgaaugcagaccaaaaaaaaaagacucagcaguaaaaccagacagagcagcaacaccacaucauagaccacaaccaagaucaguaccaggaugggacucagcaccaggagcaccaucuccagcagacauaacacauccaacaccagcaccaggaccaucagcacaugcagcacccucaacaacaagugcacuaacaccaggaccagcagcagcagcagcugacgcagcagcaucaucagucgcaaaaggaggagccuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2492 - RNA, 1477 nt, Artificial Sequence
  mRNA product Design1 comprising derived and/or modified sequence from Homo sapiens__NP_005420.1__HsVEGFC (opt12)
gggagaaagcuuaccaugcaccuauuaggauucuuuagcguagcgugcaguuuauuggcagcagcacuauuaccagguccacgugaagcaccagccgcagccgcagcuuucgaaucaggauuagacuuaagcgacgcugaacccgacgcaggcgaagcaacagcauacgcuucaaaagaucuagaagaacaacuaagaucuguaucuucaguagacgaauuaaugacaguacuauacccagaauauuggaaaauguauaaaugccaacuaagaaaaggagguuggcaacacaauagagaacaagcaaacuuaaacuccagaacagaagagacuauaaaauuugcagcagcacauuacaacacagaaauucuaaaaucaauagacaaugaauggagaaaaacucaauguaugccaagagaaguaugcauagacguagguaaagaauucgguguagccaccaacacauuuuuuaaaccaccaugcguaucaguauauagaugcggaggcuguugcaauucagaaggauuacaauguaugaauaccucuacaagcuaccuaucaaaaacacuauucgaaauaacuguaccauuaucacaaggaccaaaaccaguaacaauaucauuugcaaaccacacaucaugucgaugcaugucaaaauuagacguauaccgacaaguacacaguauaauaagaagaucacuacccgcaacacuaccacaaugccaagcagcaaauaaaacaugcccaacuaacuacauguggaauaaucauauuuguagaugccuagcacaagaagauuucauguucucaagugaugcaggugacgacucuacugacggauuucaugacauauguggaccaaauaaagaacuagacgaagaaacaugucaaugcguaugcagagcaggacuucgaccagcauccugugguccacauaaagaacuagauagaaauucaugccaauguguuuguaaaaauaaauuauuccccagccaaugcggagcaaauagagaauuugaugaaaauacaugccaauguguauguaaaagaaccugcccaagaaaucaaccacuaaacccaggaaaaugcgccugcgaaugcacagaaaguccacaaaaaugucuauuaaaagguaaaaaauuccaucaccaaacauguucaugcuacagaagaccaugcacaaacagacaaaaagcaugugaaccuggauuuucauauucagaagaaguuuguagauguguuccaucauacuggaaacgaccacaaaugagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2493 - RNA, 1282 nt, Artificial Sequence
  mRNA product Design1 comprising derived and/or modified sequence from Homo sapiens__NP_004460.1__HsVEGFD (opt12)
gggagaaagcuuaccauguacagagaauggguaguaguaaacguauucaugaugcuauauguacaacuuguacaaggaagcucaaaugaacacggaccaguaaaaagaucaucacaguccacacuagaaagaucagaacaacaaauaagagcagcauccucucuagaagaauuacuaagaaucacacauuccgaagacuggaaauuauggcgaugucgacuacgcuuaaaaagcuuuacuaguauggacucacgcucagcaucacauagaaguacaagauuugcagcaacauucuacgacauagaaacacuaaaaguaauagaugaagaauggcaaagaacacaaugcucaccaagagaaacaugcgucgaaguagcaucugaacucggaaaauccaccaauacauucuucaaaccaccaugcguuaacguauuuagaugcggaggauguugcaacgaagaaucacuaauaugcaugaauacauccacaucauacauaucaaaacaacuauucgaaauauccguaccauuaacaucaguaccagaacuaguaccaguaaaaguagcaaaucacacaggaugcaaaugccuaccaacagcaccaagacacccuuacagcauaauaagaagaucaauacaaauacccgaagaagacagaugcucccacagcaaaaaauuaugcccaaucgacaugcuaugggacucaaacaaaugcaaaugcguacuacaagaagaaaacccacuagcagguacagaagaccacucacaccuacaagaaccagcauuaugcgguccucacaugauguucgacgaagauagaugcgaaugcguaugcaaaacaccauguccaaaagacuuaauacaacacccaaaaaauugcuccuguuuugaauguaaagaaucacuagaaacaugcugccaaaaacacaaauuauuucaucccgauacaugcucaugcgaagacagaugcccauuccacacaagaccaugcgcaaguggaaaaacagccugcgccaagcacugccgauucccaaaagaaaaaagagcagcucaaggaccacacucacgaaaaaauccauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2494 - RNA, 847 nt, Artificial Sequence
  mRNA product Design1 comprising derived and/or modified sequence from Homo sapiens__NP_061986.1__HsFGF21 (opt13)
gggagaaagcuuaccauggacucagacgaaacagguuucgaacacuccggauuauggguaucaguauuagcaggauuacuauuaggagcaugccaagcacauccaauaccagacucaucaccacuucuacaauucggaggacaaguaagacaaagauacuuauacacagaugacgcccaacaaacagaagcacacuuagaaauaagagaagacggcacagucggaggagcagcagaccaaucaccagaaucuuuauuacaauuaaaagcauuaaaaccaggaguaauacaaauauuaggaguaaaaacaucaagauuucuaugccaaagaccagacggagcauuauacggaucauuacauuucgacccagaagcauguucauucagagaauuauuacuagaagaugguuauaauguauaucaaucugaagcacacggauuaccacuacaucuaccaggaaauaaaucaccacauagagacccagcaccaagaggaccagcaagauucuuaccauuacccggauuaccuccagcacuaccugaaccaccaggaauacuagcaccacaaccaccagauguaggaucauccgacccauuaucaaugguaggaccaucacaaggaagaaguccaucauacgcaucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2495 - RNA, 1627 nt, Artificial Sequence
  mRNA product Design1 comprising derived and/or modified sequence from Homo sapiens__NP_002412.1__HsMMP1 (opt13)
gggagaaagcuuaccaugcacucauucccuccacuauuauuauuacuauuuuggggaguaguaucacacaguuucccugcaaccuuagaaacacaagaacaagacguagaccuaguucaaaaauacuuggaaaaauacuacaaccuuaaaaaugacggaagacaaguagaaaaacgaagaaauucaggaccagucguagaaaaacuaaaacaaaugcaagaauuuuucggacuaaaaguuacaggaaaaccagaugcagaaacacuaaaaguaaugaaacaaccuagauguggaguacccgacguagcccaauuuguauuaacagaaggcaacccaagaugggaacaaacccacuuaaccuacagaauagaaaauuacacaccagaucuaccuagagccgacguagaucaugcgauagaaaaagcauuucaauuauggaguaauguaacuccacuaacauuuacaaaagucucagaaggacaagcggacauaaugauauccuucguaagaggagaucacagagacaauaguccauucgacggaccaggcggaaaccuagcacacgcuuuccaaccaggacccggcauaggaggagaugcacacuucgacgaagacgaaagauggacaaacaacuucagagaauauaaccuccacagaguagcugcacaugaacuaggacauucauuaggacuuagccacagcacagacauaggagcacuaauguacccuucauauacauuuucaggagacguacaauuagcacaagacgauauagacggaauacaagcaauauauggaagaucacaaaauccuguacaaccgaucggaccucagacaccaaaagcaugcgauagcaaacuuaccuucgacgcuauaacaacaauuagaggcgaaguaauguucuucaaagaccgauuuuacaugagaacaaauccauucuaucccgaaguagaauuaaacuuuauauccguauuuuggccacaacucccuaacggauuagaagccgcauacgaauuugcagauagagacgaaguaagauuuuucaaaggaaacaaauacugggcuguacaaggacaaaacguacuacacggauauccaaaagacauauacucaucauucggcuuuccccgaacaguaaaacauauagaugcagcauuaucagaagaaaacacaggaaaaacauauuucuuuguagccaacaaauacuggagauaugaugaauacaaaagaucaauggacccagguuacccaaaaaugauagcacaugauuuuccaggaauuggacauaaagucgacgccgucuucaugaaagacggauucuucuauuucuuucauggaacuagacaauauaaauucgacccaaaaacaaaaagaauauuaacacuacaaaaagcaaacucuugguucaacuguaggaaaaauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2496 - RNA, 1387 nt, Artificial Sequence
  mRNA product Design1 comprising derived and/or modified sequence from Homo sapiens__NP_002412.1__HsMMP1(1-19,100-469) (opt13)
gggagaaagcuuaccaugcacucauuuccaccauuacuacucuuauuauuuuggggaguaguaucacacucauucguacuaacagaaggaaauccaagaugggaacaaacacaccuuaccuacagaauagaaaauuacacaccagaucuaccaagagcagacguagaccacgcaauagaaaaagcauuucaauuauggucaaacguaacaccauuaacauucacaaaaguaucagaaggacaagcagacauaaugauaucauucguaagaggagaccacagagacaauucaccauuugauggaccaggagguaaucuggcacacgcauuccaaccaggaccaggaauaggaggagacgcacacuucgacgaagacgaaagauggacaaacaacuucagagaauacaaccuacacagaguagcagcccaugaacuaggacacucacuaggacuaucacacucaacagacauaggagcccuaauguauccauccuacacauucucaggagacguacaacucgcgcaagacgacauugacggaauccaagcuauauacggaagaucacaaaacccaguacaaccaauaggcccccaaacaccaaaagcaugugacucaaaacuaacauuugaugcaauaacaacaauaagaggcgaaguaauguucuucaaagacagauucuacaugcgcacaaauccauucuacccagaagucgaauuaaacuucauaucaguauucuggccccaauuaccaaacggauuagaagccgccuacgaauuugcagaccgagacgaaguaagauucuucaaaggaaacaaauauugggcaguacaaggacaaaacguauuacacggauauccaaaagacauauacuccucauuuggcuuuccaagaacaguaaaacauaucgacgcagcacucuccgaagaaaacacaggaaaaacauacuucuuuguagcaaacaaauacuggagauaugacgaauauaaaagaucaauggacccgggauacccaaaaaugauagcacaugacuucccaggaauaggacacaaaguagacgccguauucaugaaagacggauuuuucuacuucuuucacggaacuagacaauacaaauucgacccaaaaacaaaaaggauacuaacauuacaaaaagcaaacucaugguuuaacugccgcaaaaacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2497 - RNA, 3574 nt, Artificial Sequence
  mRNA product Design1 comprising derived and/or modified sequence from Clostridium histolyticum__BAA77453.1__ColG (opt13)
gggagaaagcuuaccaugaagaaaaauauacuuaaaauacucauggacucauacaguaaagaaagcaaaauucaaacgguucgaagaguaaccagugucagccuauuagcaguauaucuaacuaugaauacuagcagcuuaguacucgcgaaaccaauugaaaauacaaaugacacaaguauuaaaaauguagaaaaauugagaaaugcaccaaaugaagaaaacucgaagaaaguagaagauagcaaaaaugauaaaguugagcauguuaaaaacauagaagaagcaaaagucgaacagguggcuccagaaguaaaaucaaaaagcacacucagaucagcaaguaucgcaaacacgaacagugagaaauaugauuuugaauaccugaauggccucucauauacagaauuaacaaacuuaauuaaaaauauaaaauggaaucaaaucaacggcuuauucaauuacaguaccggaagucagaaauucuuuggggacaaaaaccgaguacaagcaauaauuaaugcauuacaagaaucagggcgaacauauacagccaacgauaugaaaggaauugaaacauucaccgagguuuuacgagcuggcuucuauuugggcuacuacaacgauggacuauccuauuugaacgauagaaacuuucaggauaaauguauaccagcaaugaucgcaauacagaagaacccaaacuucaaauuaggaacagcaguacaagaugaaguaauuaccagucuugguaaauuaauuggaaacgcaagcgcgaaugcugaaguuguaaauaacugugucccagucuuaaaacaauuuagagagaauuuaaaucaauaugcaccagauuacguuaaaggaacagcgguuaaugaauuaauaaaaggaauagaguucgacuuuagcggagcagcuuacgaaaaagacguaaaaacuaugccuugguacggaaagauugauccauucauaaacgaauuaaaagcauugggccucuacggaaauauaacaucagcuacagaaugggccagcgauguggguauauacuaucuuaguaaauucggucuuuauaguacaaacaggaaugauaucguucaaucacuagaaaaagcaguagauauguauaaauacggaaaaauagcauuuguggcaauggaaagaauaacaugggacuaugauggaauaggaucuaacggcaagaaaguagaccaugacaaauuucucgacgaugccgaaaaacacuacuuaccaaaaacguauacauuugacaauggaacauuuaucauaagagcgggugacaaaguaagugaagagaaaauaaaaagacuauacugggcaucuagagaaguaaaaucucaauuucacagggucgucgggaaugacaaagcacuagaaguaggaaacgccgacgauguccucacaaugaaaauauucaacagccccgaagaauauaaauucaauacuaauauaaauggaguuagcacagacaauggcggauuauauauagaaccacgagggacuuucuacacguaugaaagaacaccacaacaaucaauauucagcuuagaagaacuguuuagacaugaauauacucauuacuuacaagcucgauauuuaguggauggauuauggggacaaggccccuucuacgagaaaaacagacuaacuugguucgacgaaggaacagcagaguucuucgccggcucaaccaggacaucaggagugcuuccgagaaaaucaauacuaggcuaucuugcaaaagauaaaguagaccacagauacagccucaagaaaacauuaaauucaggauaugaugauagcgauuggauguuuuauaauuauggguuugcuguagcccacuauuuauaugaaaaagauaugccaacauuuauaaaaaugaauaaagcaauucuaaauaccgacguuaaaagcuaugaugaaauaauaaagaaauuaucagacgacgcgaacaaaaacacagaauaucaaaaucacauacaagaauuagccgacaaauaucaaggagcaggcauacccuuagugucagacgacuauuuaaaagaucauggauauaagaaagcguccgaaguauauucugaaauaucuaaagcggcaagccuaacaaauacauccguaacagcggaaaaaucacaauacuuuaauacauuuacacuaagaggaacauauacaggagaaacaaguaaaggcgaauuuaaagacugggacgaaaugagcaagaaacuggacggaacacuagaaagccuagcuaaaaacucauggagcggauauaaaacauuaacggcauauuuuaccaauuaccgaguaacguccgacaacaaaguacaauaugacguuguauuucacggcguuuuaacagauaacgcagauauaaguaauaacaaagcaccaauagcaaaaguuacaggcccaucgacaggugccguagguagaaacauugaauuuucuggaaaagauucaaaagaugaagauggaaaaaucguaucauacgacugggacuuuggagacggagcaacaucaagagggaaaaauucaguccaugcauacaagaaagcuggaacauauaacguaacauuaaaaguuaccgaugauaaaggugcgacagcaacugaaucuuuuacaaucgaaaucaaaaacgaagauacaacaacaccaauaacgaaagaaauggaacccaaugacgauauaaaagaagcuaauggaccaauagucgaaggaguaaccgucaaaggugaccuaaacggcuccgacgacgcugauacauucuauuuugauguuaaagaagauggagaugugacaauagaacuaccauauucaggaucuaguaacuuuaccuggcugguauauaaagaaggcgaugaucaaaaucauaucgcuagugguauagacaaaaauaacagcaaaguuggaacauuuaaaagcacaaaagguagacauuacguauucauuuacaaacacgauucagcaucaaauaucucauacucuuuaaauauaaaaggcuuagguaaugaaaaacugaaagagaaagaaaauaaugauucgucagacaaagcuacagugauaccaaauuucaauacaacuaugcaaggaucacugcuaggagaugacagccgugauuauuacagcuucgaaguaaaagaagaaggagagguaaacaucgaauuagauaagaaagaugaauuuggaguaacauggacauuacauccagaauccaacauaaacgacagaauaacauacggacaaguugaugguaacaaaguaaguaauaaaguaaaauugaggccuggaaaauacuaccuguuaguauauaaauacagugggucaggaaacuacgaacuacgaguuaacaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2498 - RNA, 3298 nt, Artificial Sequence
  mRNA product Design1 comprising derived and/or modified sequence from Clostridium histolyticum__BAA77453.1__HsALB(1-18)_ColG(111-1118) (opt13)
gggagaaagcuuaccaugaaauggguaacuuuuauaagucuucuauuucuauuuucaucggcauauaguauagcaaacacaaacucagaaaaauaugacuuugaauaucuaaauggauuaucauauacagaauuaacaaaccugaucaaaaacauaaaauggaaucaaauaaacggauuauuuaacuauagcacgggaucacagaaauuuuucggcgauaaaaauagaguacaagcaauuauaaaugcucuccaagaaucuggcagaacguauacagcaaacgauaugaaaggaaucgaaacuuuuacagaaguccugagagcagguuuuuacuuagguuauuacaacgacgggcuaagcuaucuaaaugauagaaacuuccaagacaaauguauaccagcaaugauugcaauacagaaaaaccccaauuuuaaauuaggaacagcaguucaagacgaaguuauaacaucucuuggcaaacuuauagggaacgcaagcgcaaacgcagaaguaguaaacaacuguguaccgguauuaaaacaauucagagaaaauuuaaaucaauacgcaccagacuauguaaaaggaacagcaguaaacgaacuaauaaaaggaauagaauuugauuucagcggagccgcauaugaaaaggaugucaaaacuaugccgugguacggaaaaauagacccauuuauaaaugaacuuaaagcacuagguuuauacggaaacaucacaagcgcaacugaaugggcaucagauguuggaauuuauuaccuaucuaaauuuggacuauacucaaccaacaggaacgauauagugcaaucucuggaaaaagcuguagacauguauaaauauggaaaaauagcuuucgucgcaauggaaagaauaacuugggauuaugaugguauuggaucaaacggcaaaaagguagaucacgauaaauucuuagaugacgcagaaaagcacuacuuaccaaaaacguauacauucgacaacgggacuuuuauaaucagagcaggcgauaaaguauccgaagagaaaauaaaaagauuauacugggcuucaagggaaguaaaaucucaauuccaccgaguaguaggaaaugauaaagcauuagaaguggguaacgcugaugauguauuaacaaugaaaauauucaacagcccugaagaauacaaguucaauacaaauauaaacggagucucuaccgauaacggaggcuuauacauugaaccaagaggaacauuuuacacauaugaaagaacuccacaacaaagcauauucagccuugaggaacuauuccgacacgaauauacacauuacuuacaagccagguaucuuguagauggacuuuggggacagggaccuuucuaugaaaagaauagacuaaccugguucgacgaaggaacagcagaguucuuugcagguucaacaagaacaucuggaguauuaccacgaaaaucaauucucgguuauuuagcaaaagauaaaguagaucauagauauucacuaaagaaaaccuugaacucaggauacgacgacagugacuggauguucuacaauuacggauuugcaguagcacacuauuuauaugaaaaagauaugccuacauucauuaaaaugaacaaagcaauacuaaauaccgaugugaaaagcuaugacgaaauaauaaagaaacuuucagacgaugcgaacaaaaauacagaauaccaaaaccauauucaagaacucgccgacaaauaccaaggugcaggcauuccucuaguaagugacgacuauuuaaaagaccauggauacaagaaagcaucagaagucuauucagaaaucagcaaagccgcauccuuaacuaauacaagcgucacagcagagaaaucacaauacuuuaauacauucacgcuucgaggaacuuauacaggugaaacgucaaaaggagaguuuaaagauugggaugaaaugucaaagaaauuagauggaacacuagaaucguuagcuaaaaacucauggucuggauauaaaacacuaaccgcauacuuuacuaacuacagaguuaccagugauaacaaaguacaauacgauguaguauuucauggaguacuaacagacaaugcagacauuagcaauaacaaagcaccaauagcaaaaguuaccggccccucaacaggggcaguagguagaaauauugaguucucuggaaaagauagcaaagaugaagauggaaaaauaguuucauaugauugggacuuuggugauggagcaacuagcaggggcaaaaacucaguucacgcauacaagaaagcaggaacauauaacguaaccuuaaaaguaaccgaugauaaaggagcaaccgccaccgaaaguuuuacuauagaaaucaaaaacgaagacacaacgacaccaauaacaaaagaaauggaaccaaaugacgacauaaaagaagcaaacggaccaauaguagaaggaguaacaguaaaaggagaccuaaauggcucggacgaugcagauacauuuuacuuugaugucaaagaggauggugacguaaccauagaacuacccuauagcggaucaaguaauuucacuuggcuaguuuacaaagaaggagaugaccaaaaccauauugcaucaggaauugauaaaaacaacucaaaaguaggcacauucaaaucaacaaaaggacgacauuacguuuucauauauaaacacgacagcgcuucaaacauaucauauucucucaacauaaaagguuuaggcaaugaaaaauuaaaagaaaaagaaaauaacgacucaucagauaaagcaaccguaaucccaaauuucaauacaacgaugcaaggaucgcuccucggagaugacagucgugauuacuacucauuugaaguaaaagaagaaggagaaguuaauauagaacuagauaagaaagacgaguucggaguaacauggacauuacacccagagaguaauaucaacgauagaauuacauauggccaaguugacggaaauaaaguuaguaauaaaguaaaacuuaggccaggaaaauauuaccugcucgucuacaaauacucagguagcgguaacuaugaacuaagaguaaacaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2499 - RNA, 3646 nt, Artificial Sequence
  mRNA product Design1 comprising derived and/or modified sequence from Clostridium histolyticum__BAA77453.1__HsALB(1-18)_ColG(1-110)_CS-F_ColG(111-1 118) (opt13)
gggagaaagcuuaccaugaaauggguaacauucauuagccucuuauuucuauuuucaucagcauacaguaugaagaaaaauauacuaaaaauauugauggacuccuauaguaaagagagcaaaauacaaacaguaaggcgaguaaccagcgugaguuuacuugcuguauaucuaacaaugaacacaaguagccuaguuuuagcaaaaccaauagaaaauacgaaugauaccuccaucaaaaacguagaaaaacuaagaaaugcaccaaacgaagaaaauucaaagaaaguagaagauaguaaaaacgacaaaguagaacaugugaaaaacauagaagaagccaaaguagaacaaguagcaccagaagucaaaucuaaauccacuuuaagaagugcgucaaggagaagaagaaaaagaauagcaaacacaaauagugaaaaauacgauuucgaauaccuaaacggacuauccuauacugaacuaacaaaucuaauuaaaaacauaaaauggaaucaaauaaacgguuuauuuaacuauuccacaggcucacaaaaauuuuucggagauaaaaaucgcguucaagcaauaauaaaugcccuacaagaaagcgggagaaccuacaccgcaaaugauaugaaaggaauagaaacauucacagaaguacuuagagccgguuucuaucuagguuacuauaacgacggauuaaguuaucuaaaugauaggaacuuccaagauaaaugcauaccagcaaugaucgcaauacagaaaaauccaaauuucaaauugggaacagcaguccaagacgaagugauaacaucacuaggaaaacuaauaggcaacgcaagugcaaacgccgaaguaguaaacaacuguguuccaguacuaaaacaauucagagaaaaccuaaaccaauacgcaccugauuauguuaaagguacagccgucaacgaacucauaaaagguauagaguucgacuucucaggagcagcguacgaaaaagauguaaaaacaaugccaugguauggaaaaauugauccauuuauuaaugaauuaaaggcauuaggauuguacggaaacauaaccucggcuacagaaugggcaucagauguaggaauauacuaccuuucaaaauuuggucuauauagcacaaaccggaacgauauaguacaaucauuagaaaaagccguagacauguauaaauauggaaaaauagcauuugucgcaauggaaagaauaaccugggacuacgacggaauagggucuaacgggaagaaaguagaccaugauaaauuucucgaugaugccgaaaaacauuaucuaccuaaaacuuacacuuucgacaauggcacauucauaaucagagcuggcgacaaaguauccgaagagaaaauaaaaagauuauauugggcaucuagagagguaaaaagucaguuucacagagucguaggaaaugauaaagcucuugagguaggaaacgcagaugacguguuaacaaugaaaauauuuaauucaccggaagaauacaaguucaauacaaacauuaauggcguauccacagacaauggaggacuauauaucgaaccacgaggaacauucuauacauaugaaagaaccccacaacagaguauuuucagucuagaagaauuauuuaggcacgaauacacccauuauuuacaagcacguuaucuaguagacggacuauggggucagggacccuucuacgaaaagaaccgcuuaacaugguucgaugaagguacugcggaauuuuucgcuggaucaacacgaaccaguggaguacucccaagaaaaucaauuuuagguuaccuugcaaaagauaaagucgaucacagauacucacucaaaaagacacuaaauucaggauaugaugacucagacuggauguuuuauaauuauggauucgcagucgcacacuaccucuacgaaaaagauaugccaacguucauuaagaugaauaaggcaauacuaaauacagauguaaaaucauacgacgaaaucauaaagaaacuauccgacgacgcaaauaaaaauacagaauaccaaaaccauauacaagaacuagcagacaaauaucagggagcaggcaucccacuuguaagcgacgacuacuugaaagaccacggauacaagaaagcauccgaagucuacucagaaauauccaaagcagccucauuaacaaauacguccguaacugcugagaaaagucaauauuucaacacauucacacuacguggaacauacaccggcgaaacgaguaaaggagaguucaaagauugggacgaaaugucaaagaaauuagacgguacacuagaaucauuagccaaaaauucauggagcggauacaaaacucuuacggcauacuuuacaaacuauaggguuacaagugauaacaaaguacaauaugacguaguauuucauggaguccucacagacaaugcugauaucagcaacaacaaagcuccuaucgcuaaaguaacugggcccaguacgggagcaguaggcagaaacauugaguucucaggaaaagacucaaaagacgaagauggcaaaauaguauccuaugauugggacuuuggagauggagcaacaucaagaggcaaaaacucaguccacgcauacaagaaagcaggaacauauaauguaacacuuaaaguaacagacgauaaaggcgcaacagcaacagaaucauucacaauagaaauuaaaaacgaagauacaacaacaccaauaacaaaagaaauggaaccaaacgaugauauaaaagaggcaaacgguccaauaguggaaggaguaacaguaaaaggcgacuugaaugggagcgacgacgccgacacauuuuauuucgacguuaaagaggacggcgacguaacaauagaauuaccauacaguggaucaagcaacuuuacguggcuaguuuauaaagaaggagacgaccaaaaccauauagcaagugguauagacaaaaacaauaguaaaguagguacauuuaaaaguaccaaaggcagacauuacguauuuauauacaaacacgauucagcaucaaacauaucauauucucuaaauauaaaaggauuagggaaugaaaaacuuaaagaaaaagagaauaaugacagcagcgacaaagcaacugucauacccaacuuuaacacaacaaugcaagguucacuauuaggagacgacagucgagauuauuauagcuucgaaguaaaagaggaaggagaagucaauauagaauuagauaagaaagacgaauuuggaguaacauggacacuucauccugaaaguaauauaaacgauagaauaacauacggacaaguagacggaaacaaagucucaaauaaaguaaaacuuagaccagggaaauauuaucuacuuguauauaaauacaguggaucagguaacuaugaacuaagagucaauaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2500 - RNA, 3322 nt, Artificial Sequence
  mRNA product Design1 comprising derived and/or modified sequence from Clostridium histolyticum__BAA34542.1__ColH (opt13)
gggagaaagcuuaccaugaacuucuugaaaauaauccucaacagaggaaaaaccaugaaacgaaaaugucugucaaaaagauuaaugcuagcuauaacaauggccaccauauucacagucaacucaacacuaccaaucuaugcagcaguagauaaaaauaaugcuacagcugcaguacaaaacgaaucaaaacguuauacaguuucguacuuaaaaacauuaaauuauuaugaccucgucgaucuauugguaaaaacagaaaucgaaaauuuaccagauuuauuccaauacagcucagaugcuaaagaguucuaugguaacaaaacaagaaugagcuucauuauggacgaaauagguagaagggcuccacaauauacagaaauagaccauaaaggaauaccaacccuaguagaaguagucagagccggauuuuaucuuggauuccacaacaaagaauuaaaugaaaucaacaaaagaucauucaaagaacgaguaaucccaagcauauuagcaauacaaaagaauccaaauuucaaauuaggaacagaaguucaggacaaaauaguuagcgcaacaggacuucuagccggaaaugaaacagcaccuccugaaguaguaaauaacuuuacaccaauauugcaggauugcauaaagaacauagauagauacgcguuagaugaccuaaaaucuaaagccuuauucaaugugcuugcagccccaacauacgacaucacugaauaucuccgagccacaaaagaaaaaccagaaaacacaccaugguacgggaaaauagacggauucauaaacgaacucaagaaacuagcauuauaugguaaaauaaacgacaacaacucauggaucauagacaaugguauauaccauauagccccauuaggaaaacuucacagcaauaauaaaauaggaauagagacauuaacagaaguaaugaaaguauacccuuauuuaaguaugcaacauuuacaaucagcagaccaaaucaaaagacauuacgacaguaaagacgcggaaggaaacaaaauuccauuagacaaauuuaaaaaggaaggaaaagaaaaauauuguccaaaaaccuacacauuugacgauggaaaagucauuauaaaagccggagcacguguagaggaagaaaaagugaaaagacuuuacugggcauccaaagaaguaaauucacaauucuuucgaguuuacggaauugacaaaccccuggaagaaggaaacccagacgacauuuuaacgaugguaauauacaacaguccugaagaauacaaacuaaacaguguacuauauggcuacgauacgaacaacggaggaauguacaucgaaccagaaggaacauucuuuacguacgaaagagaagcacaggaaucaacuuauacacuagaggaacuauuucgacacgaauacacacacuaucuccaagguagauaugcaguuccgggacaauggggaagaacuaaguuauacgauaaugacagacuaacaugguaugaagaaggaggggccgaguuauucgcgggcaguaccagaacaagugggauauuacccagaaaaagcauuguauccaacauacacaacaccacgaggaauaaccgauauaaacuuucagauacaguccauucaaaauauggagcaucguuugaguucuacaauuaugcaugcauguuuauggauuauauguauaauaaagacaugggaauacucaacaaauuaaaugaccuagcaaagaacaaugacguggacggauacgacaacuacauaagagaccuaucaagcaacuacgcacuaaaugacaaauaucaagaccacaugcaagaaagaauagauaacuaugaaaaucucacaguaccuuucguugcagaugacuaccuaguccgucaugcauacaaaaauccgaacgaaauauauucagaaauuucagaaguugcuaaacuuaaagaugccaaaucagaaguaaagaaaagucaauacuucaguacuuuuacacuacgcggaagcuacacuggaggagcuucaaaaggaaaauuagaagaccaaaaagccaugaacaaauucauagacgauagccucaagaaauuagauacguauaguuggucuggauauaaaacacuaacagcguauuuuacaaauuauaaagucgauaguagcaacagaguaacauacgauguaguauuucauggauauuuaccaaaugaaggagauuccaaaaauucacucccguauggaaaaauaaacgguacauauaaagggacagaaaaagagaaaauaaaauucagcucagaaggaaguuuugacccggacgguaaaauaguaaguuacgaaugggacuucggugacggcaauaaaucaaacgaagaaaauccagaacacucuuaugauaaaguaggaaccuacacagugaaauuaaaaguaacagaugauaaaggugaaucauccgucaguacgacaacagcagaaauaaaagaucugucagaaaacaagcucccgguuauauauaugcauguaccaaaaagcggcgcccuaaaucaaaaaguagucuuuuacggaaaaggaacguaugacccagacggaaguauagcaggauaccaaugggauuuuggggaugguagugacuuuagcagcgaacaaaacccaucacaugucuacacuaagaaaggcgaguacacaguuacacucagaguaauggacucaaguggacaaaugucagagaaaacaaugaaaauaaaaauaacagauccaguauauccaauuggaacugaaaaagaaccaaacaauucuaaagaaacagccucaggucccauugucccuggcauaccuguaaguggaacaauagaaaacaccagugaccaagacuauuucuauuuugacguuauaacacccggcgaaguaaaaauagacaucaacaaacuuggauacggaggagcuacauggguuguauaugaugaaaacaauaaugcaguaaguuaugcaacugaugauggacaaaaccuaagcggaaaauuuaaagcagauaaacccggacgauauuauauacacuuauauauguucaacggaaguuauaugccauaucgaauaaauauagaaggaagcguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2501 - RNA, 3283 nt, Artificial Sequence
  mRNA product Design1 comprising derived and/or modified sequence from Clostridium histolyticum__BAA34542.1__ColH (opt13)
gggagaaagcuuaccaugaaaagaaaauguuuaagcaaaagauuaaugcuagccauuacaauggcaacaauuuucacaguaaauaguacauuaccaauuuacgcagcugucgacaaaaacaacgcaacugcagcaguacagaacgaaucaaaacgguauacagugagcuaccucaaaacacuaaauuauuaugaccuaguagaucuacuuguaaaaacagaaauugaaaaucuaccagaccuauuccaauacuccucagaugcaaaggaauuuuauggaaacaaaacgcgcaugaguuucauuauggacgaaauaggaaggagggccccacaguacacagaaauagaucauaaaggcauaccaacgcuaguagaagucguaagagcaggauuuuaccuagguuuucacaacaaagaacucaacgaaauaaacaagcgcaguuuuaaagaaagagucauuccaucaauauuagcgauccagaaaaacccuaacuucaaacuaggaacagaaguacaagacaaaauuguaucagcgacaggacuacuagcaggaaaugagacagcaccaccagaaguaguaaauaauuucacaccaauauuacaagacugcaucaaaaauauagaccgauacgcauuggaugacuugaaaagcaaagcauuauuuaauguacuugcggcaccaacauaugacauaacagaauaccuaagagcuacaaaggaaaaaccagaaaacacaccaugguauggaaaaauagacggauuuauaaaugaacugaaaaaguuagcacuauacgguaaaaucaaugacaacaacagcuggauaauagacaaugggaucuaccauauagccccauuagguaaacuacauucaaacaacaaaauaggaaucgaaacccuaacagaaguaaugaaaguauauccauaccuaagcaugcaacacuugcaaagcgcagaccaaauaaaaaggcacuaugacagcaaagaugcagaaggaaacaaaauaccacucgacaaguucaagaaagaagguaaagaaaaauauugucccaaaacguauacguucgaugacggaaaaguaaucauaaaagcaggagccagaguagaagaagaaaaaguaaaaagacuuuauugggcuucgaaagaagucaacagccaauucuucagaguauaugguaucgacaaaccucuagaagaaggaaauccagaugacauucuaacaaugguaauauacaacucaccggaggaauacaaauuaaacaguguccuguacggauacgauacaaacaacgguggcauguauauagaaccagaagguacauucuucacuuaugaaagagaagcucaagaaagcaccuacacauuagaggaauuauuuagacaugaauauacucacuauuuacaaggccgauaugcaguaccaggccaaugggggcguacaaaauuauacgauaacgauagauuaacaugguaugaagaagguggagccgaacuauucgcagguuccaccaggacuucaggaauacuaccaaggaaaucaauuguaaguaauauacacaauaccacacguaacaacagauacaaauuauccgacacaguacacucaaaauacggagcaucauucgaguucuacaauuacgcauguauguuuauggauuauauguauaauaaagauaugggaauccuaaacaaacuaaaugacuuagcuaaaaauaaugacguugacggauacgacaauuacauaagggacuuaaguagcaacuacgcauuaaacgacaaauaccaagaccauaugcaagaaagaauagauaacuaugaaaaucuaacgguaccauuuguugcagacgauuauuuagucagacaugcauacaaaaacccuaaugaaauauacagugaaauaucagaaguggcaaaacuaaaagacgcuaaaucugaaguaaagaaaagccaauacuuuaguacauucacacuucgaggcucauacacaggaggagcaagcaaggguaaacucgaagaccaaaaagcaaugaacaaauuuauagaugauucacuaaagaaauuagacacauauaguuggagcggcuauaaaacacuaaccgcauacuuuacuaacuauaaaguagacucaucaaaccgcguaacauacgacguaguauuucacggauaccuccccaaugaaggugacagcaaaaacucacuacccuaugggaaaauaaaugggacauacaaagguaccgaaaaggagaaaauaaaauuuucuucugaaggcagcuucgacccagacggaaaaauagucuccuacgaaugggacuucggugauggaaacaaaagcaaugaagaaaauccagaacacaguuacgacaaaguagggacuuacacuguaaaacugaaaguuacagaugacaagggcgaaagcucuguaaguacaaccacugccgaaauaaaagaccuaucagaaaacaaacuuccaguaauauauaugcacguuccuaaaucuggagcuuugaaccaaaaaguaguuuucuacggaaaaggcacguaugacccggauggaucaaucgcaggcuaucaaugggacuuuggcgauggaagugacuuuuccagcgaacaaaacccuagccacgucuauacuaagaaaggagaauauaccgugacauuacgaguaauggauucaucaggacaaaugucagagaaaaccaugaaaauaaaaaucacugacccaguauauccaauaggaacagaaaaagaaccaaacaacaguaaagaaacagccucagguccaauaguaccuggaauaccagucucaggcacaauagaaaacacaucagaccaagacuacuucuauuuugauguuauaacaccaggugaagucaaaauagauauaaauaaauuaggauaugguggugcaacaugggucguauacgaugaaaacaauaacgccguuaguuacgcaacagacgauggucaaaaccuaucugggaaauucaaagcagauaaaccuggaagauacuauauacaucuauauauguuuaacggcagcuacaugccauauagaauaaauauagaagggucaguaggaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2502 - RNA, 3217 nt, Artificial Sequence
  mRNA product Design1 comprising derived and/or modified sequence from Clostridium histolyticum__BAA34542.1__HsALB(1-18)_ColH(41-1021) (opt13)
gggagaaagcuuaccaugaaauggguaacuuuuauaucauuauuauuccuauucaguucagcauauaguguacaaaaugaaucaaaaagguacacaguauccuaucuaaaaacguuaaauuauuacgauuuaguagaucuccuagucaaaacugaaauagaaaacuuaccagaccuauuccaauauucguccgaugcaaaagaauuuuauggaaauaaaacccgaaugucauucaucauggacgaaauuggacgaagggcaccgcaauacacagaaauagaucacaaagguauuccaacccucguagaagucguaagagcuggcuucuaccuaggauuucauaauaaagaauuaaaugaaauaaacaaaaggucauucaaagaaagaguaauacccuccauauuagcaauacaaaaaaauccuaacuuuaaacuuggaacagaaguucaagacaaaaucguuucagcgaccgguuuacuggcaggcaacgaaacagcaccucccgaagucguaaacaacuucacaccaauuuuacaagauuguauaaaaaauauugaucgauacgcuuuagacgaccuuaaaagcaaagcgcuauucaacguacucgcagcaccuacauacgauaucaccgaauaccuucgagcuacaaaagaaaaaccagaaaauacuccuugguauggcaaaauagacggauucauaaacgaauuaaaaaaauuagcuuuauauggaaaaauuaaugauaauaacucauggauaauagacaauggaauauaucacauugcaccauuaggaaaauuacauucuaauaauaaaauaggaauagaaacauugacagaaguaaugaaaguguaccccuaccuaagcaugcaacauuuacagucagcugaucaaauuaaacgacacuacgauucaaaagacgcagaaggcaauaaaaucccacuugacaaauucaaaaaagaaggaaaagaaaaauacuguccaaaaacauauacauuugacgacggaaaaguaauaauaaaagcuggugcaagaguagaagaagaaaaagucaaaagacuauauugggcaagcaaagaaguaaauucacaauucuuucgaguauauggaauugacaaaccccuagaagagggaaacccagacgauauacuaacaauggugauauacaacucaccagaagaauauaaacuaaacaguguacuauacggauacgauacaaacaauggcgggauguacauagaaccagaagguacauucuucacguaugaaagggaagcacaagaauccaccuacacacucgaagaacuauucagacaugaauacacucauuaucuacaaggcagauaugccguaccgggacaauggggaagaacaaaauuauaugacaacgacagauuaacaugguaugaagaaggaggagcagaacuauuugcuggcaguaccagaacaagugggauccuucccagaaaaucaauugugaguaacauacacaacacaacgagaaauaauagauauaaacuaagcgauaccguacauaguaaauauggagccucguucgaauuuuauaauuaugccuguauguucauggauuacauguauaacaaagauauggguauauuaaauaaauuaaacgaccucgcuaaaaauaaugauguagacggauacgacaacuacauaagagauuuauccagcaacuaugcauuaaaugacaaauaucaagaccacaugcaagaaagaaucgacaacuaugaaaaucuuacuguaccauucguagcagacgauuaccuaguuagacacgccuauaaaaaucccaacgaaauauauagcgaaauaucugaaguagcaaagcuaaaagacgcaaaaagcgaagugaaaaaaucacaauacuuuucaacuuucacauugagaggcucauacacaggaggugcaagcaaaggaaaauuagaagaucaaaaagcaaugaauaaauuuauagacgacagucuaaaaaaauuagauacauacucauggucagguuacaaaacacuaacggcauacuucacaaacuauaaaguagauuccucaaauagaguaacauacgaugucguuuuucauggauaucuaccuaacgaaggagacagcaagaauagucuaccauauggaaaaauaaauggaacguacaaaggaacugaaaaagaaaaaaucaaauucucaucagaaggcaguuucgaucccgacgggaaaauaguaucauacgaaugggauuuuggagauggcaacaaaucaaacgaagaaaacccagaacauucauaugauaaagucggaaccuacacaguaaaacuaaaaguaaccgaugacaagggagaaucaucgguuuccaccacgacagcugaaauaaaagacuuaucagaaaacaaauuacccguaauauacaugcacguaccaaaaucaggcgcgcuuaaccaaaaagugguuuucuauggaaaaggcacauacgauccagauggaagcaucgcaggauaccagugggauuucggagaugguucagauuuuaguucugaacaaaauccuagccauguauacaccaaaaaaggugaauacacaguuacacuuaggguuauggacuccucaggacaaaugagcgaaaaaacaaugaaaauaaaaauaaccgacccaguauacccaauaggaaccgaaaaggaaccaaacaauucuaaagaaacagcaucagguccaauaguaccaggaaucccagugucagggacaauagaaaacacaucagaccaagacuauuucuauuucgacguaauaacacccggagaaguaaaaauagacauaaacaaauuaggauacgguggcgccacuuggguuguauaugacgaaaacaacaacgcaguaucuuaugcaacugacgacggccaaaacuuaaguggaaaguuuaaagccgauaaaccuggacgauacuacauacaccuauacauguucaacggcaguuacaugccauacagaauaaacauagaagguagcguuggucgauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2503 - RNA, 3355 nt, Artificial Sequence
  mRNA product Design1 comprising derived and/or modified sequence from Clostridium histolyticum__BAA34542.1__HsALB(1-18)_ColH(1-40)_CS-F_ColH(41-102 1) (opt13)
gggagaaagcuuaccaugaaauggguaacauucaucagcuuacuauuuuuauuuucaucugccuauuccaugaaaagaaaaugucuaucaaaaagauuaauguuagcaauaacaauggcuacaauauucacggucaacaguacacucccaauauacgcugcagucgacaaaaacaacgcgacugcagcacgcaggcgcagaaaaagaguacagaaugaaucaaaacgauacaccgugucguaccuaaaaacccuaaauuacuacgaccucguugaccuauuaguaaaaacagaaauagaaaauuuaccagaccuuuuucaauacucaagcgaugccaaggaauuuuacggaaauaaaacaaggaugaguuucauaauggaugagaucggccgccgagcaccacaauauaccgaaauagaucauaaaggaaucccgacguugguugaaguuguuagagcaggauucuauuuggguuuucacaacaaagaacuaaaugaaauaaauaaacgcagcuucaaagaaagaguaauaccaagcaucuuagcgauucagaaaaauccuaauuucaaacuaggaacggaaguacaagacaaaaucgucucagcaacgggauuguuagcgggaaacgaaaccgcuccaccagaagucguaaacaacuuuacccccauacuacaagacugcaucaaaaauauagauagauacgcauuagaugauuuaaaaucuaaagcauuauucaacguauuggcggcaccaacauaugauauaacagaauauuuaagagcgacaaaagaaaaaccagaaaacacuccaugguauggcaaaauugacggauuuauaaaugaauuaaagaaauuggcccuauacggaaaaauaaaugacaauaacagcuggaucauugacaacggaauauaccacauagcucccuuaggaaaacuacauaguaacaauaaaaucgguauagaaacauuaacugaaguaaugaaaguuuacccauaucuaaguaugcaacauuuacaaucagcagaucaaauaaaaaggcacuaugauagcaaagacgcagagggaaacaaaauaccacuagacaaauuuaagaaagagggaaaagaaaaauacuguccaaaaaccuacacauucgaugacggaaaaguaaucauaaaagcaggagcaagaguagaagaggaaaaaguaaaacgauuauauugggcaucuaaagaaguuaauucucaauucuucagaguauacggaauagacaaaccacuagaagaaggcaauccagacgacauauuaacaaugguaauuuacaacaguccugaagaauauaaauuaaauucaguauuauauggauacgacacaaacaauggaggaauguacaucgaacccgaaggcacauucuuuaccuacgaaagagaggcucaagaaucuacuuauacucucgaagaacuuuuuaggcaugaauauacacacuaucuccaagguagauaugccguaccaggacaaugggguagaacaaaacuauacgauaaugacagacuuacuugguaugaagaaggaggcgcagaacuauuugcgggcagcacacguacuucaggcauccuaccacgaaaauccauaguuuccaacauccacaauacaacaagaaacaaccgauauaaauuaucagauacuguccacucaaaauacggugcguccuucgaauuuuacaacuacgcauguauguuuauggacuacauguauaauaaagauauggguauacuuaacaaauugaaugacuuagccaaaaauaaugauguagacggauacgauaacuacauaagagaccuaucaucaaacuaugcauuaaaugacaaauaucaagaccauaugcaagaaagaauugauaacuacgaaaacuuaacuguaccauucguagcagaugauuacuuaguaagacaugcauauaaaaauccaaacgaaaucuacagcgaaaucagcgaaguagccaaacucaaagaugccaaauccgaagugaagaaaucacaauacuucucaacauucacuuuaagagguaguuacacaggaggugcauccaaaggaaaauuagaagaccaaaaagccaugaauaaauuuauagacgacagucuaaagaaauuagauaccuacucauggaguggauacaaaacauuaacagccuacuucacaaacuacaaaguagauucaucuaaccgagucaccuacgacguaguauuucauggcuacuuaccaaacgaaggcgauagcaaaaacucacuaccguacggcaaaauuaacggcacauacaaaggaacagaaaaagagaaaaucaaauucuccuccgaagguagcuucgacccagacgguaaaaucguaaguuaugaaugggauuucggugacggcaacaaaucgaacgaagaaaacccagaacacagcuaugauaaaguagguacauauacagucaaacuaaaaguaaccgaugauaaaggugaaucgucugucucaacgaccacagccgaaauaaaagauuuguccgaaaauaaauuaccagucaucuauaugcaugucccaaaaucaggagcccuaaaccaaaaagugguuuucuauggaaaaggaacauacgacccugauggaucaauagcaggcuaucaaugggauuucggugacggcucagacuuuagcagugaacaaaauccaucgcauguguacacaaagaaaggagaauacacaguaacacuacgagucauggauucuuccggacaaaugagugagaaaacgaugaaaauuaaaauaacagacccaguauacccaauaggaacagaaaaagaaccaaauaacuccaaagaaaccgcaucuggaccaauaguccccggaauaccaguaagcggcacuaucgaaaauacaucagaccaagacuauuuuuacuuugacguaauaaccccaggagaaguaaaaauagacauaaauaaauuaggauacggcggcgcuacauggguaguuuacgacgaaaacaacaaugcaguaucauacgcaacagaugacggacaaaacuuaaguggaaaauuuaaagcugacaaaccaggaagauauuacauacauuuauauauguucaauggauccuauaugccauacagaaucaacauagaaggaagcguaggaagguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2504 - RNA, 793 nt, Artificial Sequence
  mRNA product Design1 comprising derived and/or modified sequence from Homo sapiens__NP_001133.1__HsAMELX (opt13)
gggagaaagcuuaccaugggaacauggauauuauucgcaugccuacuaggagcagcauucgcaaugccacuaccaccacacccaggacacccaggauacauaaacuucucauacgaaguacuaacaccacuaaaaugguaccaaucaauacgacccccauacccaucauacggauaugaacccaugggaggauggcuacaccaccaaauaauaccaguacuaucacaacaacaucccccaacacacacauuacaaccucaccaccacauaccaguaguaccagcacaacaaccaguaauaccacaacaaccaaugaugccaguaccaggacaacacucaaugacaccaauacaacaccaccaaccaaaccuaccaccaccagcccaacaaccauaccaaccacaaccaguacaaccacaaccacaccaaccaaugcaaccacaaccaccaguacacccaaugcaaccacuaccaccacaaccaccacuaccaccaauguucccaaugcaaccacuaccaccaaugcuaccagaccuaacacucgaagcauggccaucaaccgauaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2505 - RNA, 352 nt, Artificial Sequence; identical to SEQ ID NO: 1953
  mRNA product Design1 comprising derived and/or modified sequence from Homo sapiens__NP_001133.1__HsAMELX-TRAP (opt13)

SEQ ID NO: 2506 - RNA, 385 nt, Artificial Sequence; identical to SEQ ID NO: 1954
  mRNA product Design1 comprising derived and/or modified sequence from Homo sapiens__NP_001133.1__HsAMELX-LRAP (opt13)

SEQ ID NO: 2507 - RNA, 424 nt, Artificial Sequence; identical to SEQ ID NO: 1955
  mRNA product Design1 comprising derived and/or modified sequence from Homo sapiens__NP_001133.1__HLA-A2-SP_HsAMELX(17-60) (opt13)

SEQ ID NO: 2508 - RNA, 457 nt, Artificial Sequence; identical to SEQ ID NO: 2416
  mRNA product Design1 comprising derived and/or modified sequence from Homo sapiens__NP_001133.1__HLA-A2-SP_HsAMELX(17-47,168-191) (opt13)

SEQ ID NO: 2509 - RNA, 796 nt, Artificial Sequence
  mRNA product Design1 comprising derived and/or modified sequence from Homo sapiens__NP_001134.1__HsAMELY (opt13)
gggagaaagcuuaccaugggaacauggauacuauucgcaugccuaguaggagccgcauucgcaaugccacuaccaccacauccaggacacccaggauauauaaacuucucauacgaaguauuaacaccacucaaaugguaccaauccaugauaagacccccauacucaucauacggauacgaaccaaugggcggauggcuacaccaccaaauaaucccaguaguaucccaacaacacccacuaacacacacauuacaaucacaccaccacauaccaguaguaccagcacaacaaccaagaguaagacaacaagcauuaaugccaguaccaggacaacaaucaaugacaccaacacaacaccaccaaccaaaccuaccacuaccagcacaacaacccuuccaaccucaaccaguacaaccacaaccacaccaaccaaugcaaccacaaccaccaguacaaccaaugcaaccacuauuaccacaaccaccacuaccacccauguucccacuaagaccauuaccaccaauacuaccagaccuacaccuagaagccuggccagcaacagacaaaacaaaacaagaagaagucgacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2510 - RNA, 355 nt, Artificial Sequence; identical to SEQ ID NO: 1958
  mRNA product Design1 comprising derived and/or modified sequence from Homo sapiens__NP_001134.1__HsAMELY-TRAP (opt13)

SEQ ID NO: 2511 - RNA, 388 nt, Artificial Sequence; identical to SEQ ID NO: 2419
  mRNA product Design1 comprising derived and/or modified sequence from Homo sapiens__NP_001134.1__HsAMELY-LRAP (opt13)

SEQ ID NO: 2512 - RNA, 427 nt, Artificial Sequence
  mRNA product Design1 comprising derived and/or modified sequence from Homo sapiens__NP_001134.1__HLA-A2-SP_HsAMELY(17-61) (opt13)
gggagaaagcuuaccauggcaguaauggcaccaagaacacuaguacuacuacuaucaggagcacuagcacuaacacaaacaugggcaaugccacuaccaccacacccaggacacccaggauauauaaauuucucauacgaaguacuaacaccacuaaaaugguaucaaucaaugauaagaccaccauacucaucauacggauacgaaccaaugggaggaugguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2513 - RNA, 460 nt, Artificial Sequence
  mRNA product Design1 comprising derived and/or modified sequence from Homo sapiens__NP_001134.1__HLA-A2-SP_HsAMELY(17-48,169-192) (opt13)
gggagaaagcuuaccauggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaucaaucaaugauaagaccaccaccaauacuaccagaccuacaccuagaagcauggccagcaacagacaaaacaaaacaagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2514 - RNA, 787 nt, Artificial Sequence
  mRNA product Design1 comprising derived and/or modified sequence from Sus scrofa__NP_999071.1__SsAMELX-001-1 (opt13)
gggagaaagcuuaccaugggaacauggauacuauucgcaugccuacuaggagcagcauucucaaugccacuaccaccacacccaggacauccaggauacauaaacuucucauacgaaguacucacaccauuaaaaugguaccaaaacaugauaagacacccauacacaucauacggauacgaaccaaugggcggauggcuacaccaccaaauaauaccaguaguaucacaacaaaccccacaaucacacgcauuacaaccacaccaccauauaccaaugguaccagcacaacaaccaggaauaccacaacaaccaaugaugccacuaccaggacaacacucaaugacaccaacccaacaccaccaaccaaaccuaccccuacccgcacaacaaccauuccaaccacaaccaguacaaccccaaccacaccaacccuuacaaccacaaucaccaaugcacccaauacaaccacuacucccacaaccaccacuaccaccaauguucucaaugcaaucacuacuaccagaccuaccauuagaagcauggccagcaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2515 - RNA, 355 nt, Artificial Sequence; identical to SEQ ID NO: 1963
  mRNA product Design1 comprising derived and/or modified sequence from Sus scrofa__NP_999071.1__SsAMELX-TRAP (opt13)

SEQ ID NO: 2516 - RNA, 388 nt, Artificial Sequence
  mRNA product Design1 comprising derived and/or modified sequence from Sus scrofa__NP_999071.1__SsAMELX-LRAP (opt13)
gggagaaagcuuaccaugccacuaccaccacacccaggacacccaggauacauaaacuucucauacgaaguacuaacaccacuaaaaugguaccaaaacaugauaagacacccaucacuacuaccagaccuaccauuagaagcauggccagcaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2517 - RNA, 427 nt, Artificial Sequence; identical to SEQ ID NO: 1965
  mRNA product Design1 comprising derived and/or modified sequence from Sus scrofa__NP_999071.1__HLA-A2-SP_SsAMEL(17-61) (opt13)

SEQ ID NO: 2518 - RNA, 460 nt, Artificial Sequence
  mRNA product Design1 comprising derived and/or modified sequence from Sus scrofa__NP_999071.1__HLA-A2-SP_SsAMEL(17-49,167-189) (opt13)
gggagaaagcuuaccauggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2519 - RNA, 751 nt, Artificial Sequence
  mRNA product Design1 comprising derived and/or modified sequence from Sus scrofa__P45561-2__SsAMELX-001-2 (opt13)
gggagaaagcuuaccaugggaacauggauacuauucgcaugccuauuaggagcagcauucucaaugccacuaccaccacacccaggacacccaggauauauaaacuucucauacauaagacacccauacacaucauacggauacgaaccaaugggaggauggcuacaccaccaaauaauuccaguaguaucacaacaaacaccacaaucacacgcacuacaaccacaccaccacauaccaaugguaccagcacaacaaccaggaauaccacaacaaccaaugaugccacuacccggacaacacucaaugacacccacacaacaccaccaaccaaaccuaccacuaccagcacaacaaccauuccaaccacaaccaguacaaccacaaccacaccaaccauuacaaccacaaucaccaaugcacccaauacaaccacuacuaccacaaccaccacuaccacccauguucucaaugcaaucacuacuaccagaccuaccacuagaagcauggccagcaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2520 - RNA, 787 nt, Artificial Sequence
  mRNA product Design1 comprising derived and/or modified sequence from Sus scrofa__NP_998965.1__SsAMELX-001-3 (opt13)
gggagaaagcuuaccaugggaacauggauauucuucgcaugccuauuaggagcaucccuagcaaugccacuaccaccacacccaggacacccaggauacauaaacuucucauacgaaguacucacaccauuaaaaugguaccaaaacaugauaagacacccauacacaucauacggauacgaaccaaugggaggcuggcuacaccaccaaauaauaccaguaguaucacaacaaacaccacaaucacacgcacuacaaccacaucaccacauaccaaugguaccagcccaacaaccaggaauaccacaacaaccaaugaugccacuaccaggacaacacucaaugacaccaacacaacaccaccaaccaaaccuaccacuaccagcacaacaaccauuccaaccacaaccaguacaaccacaaccccaccaaccacuacaaccacaaucaccaaugcacccaauccaaccacuacuaccacaaccaccacuaccaccaauguucucaaugcaaucccuacuacccgaccuaccacuagaagccuggccagcaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2521 - RNA, 436 nt, Artificial Sequence; identical to SEQ ID NO: 1969
  mRNA product Design1 comprising derived and/or modified sequence from Sus scrofa__K7GPB2__SsAMELX-002 (opt13)

SEQ ID NO: 2522 - RNA, 829 nt, Artificial Sequence
  mRNA product Design1 comprising derived and/or modified sequence from Sus scrofa__K7GLD0__SsAMELX-003 (opt13)
gggagaaagcuuaccaugggaacauggauacuauucgcaugccuauuaggagcagcauucucaaugccacuaccaccacacccaggacacccaggauacauaaacuucucauacgaagaccuauacuuagaagcaauaagaauagacagaacagcauucguacuaacaccacuaaaaugguaccaaaacaugauaagacacccauacacaucauacggcuacgaaccaaugggaggauggcuacaccaccaaauaauaccagucguaucccaacaaacaccccaaucacacgcauuacaaccacaccaccacauaccaauggucccagcacaacaaccagguauaccccaacaaccaaugaugccacuaccaggacaacacucaaugacaccaacacaacaccaccaaccaaaccuaccacuaccagcacaacaaccauuccaaccacaaccaguacaaccacaaccacaccaaccacuacaaccacaaucaccaaugcacccaauacaaccacuacuaccacaaccaccauuaccacccauguucucaaugcaaucacuauuacccgaccuuccacuagaagcauggccagcaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2523 - RNA, 715 nt, Artificial Sequence
  mRNA product Design1 comprising derived and/or modified sequence from Sus scrofa__K7GPE9__SsAMELX-004 (opt13)
gggagaaagcuuaccaugggaacauggauacucuucgcaugccuacuaggcgcagcauucuccaugccacuaccaccacacccaggacaccccggauacauaaacuucucauacgaaguacucacaccacuaaaaugguaccaaaacaugauaagacacccaacaccacaaucacacgcacuacaaccacaccaccacauaccaaugguaccugcacaacaaccaggaauaccacaacaaccaaugaugccacuaccaggccaacacuccaugacacccacacaacaccaccaaccaaaccuaccacuaccagcccaacaaccauuccaaccacaacccguacaaccacaaccacaccaaccauuacaaccccaaucaccaaugcacccaauacaaccacuacucccacaaccaccacuaccaccaauguucucaaugcaaucacuacuaccagaccuaccacuagaagcauggccagcaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2524 - RNA, 739 nt, Artificial Sequence
  mRNA product Design1 comprising derived and/or modified sequence from Sus scrofa__J9JIM4__SsAMELX-201 (opt13)
gggagaaagcuuaccaugccacuaccaccacacccaggacacccaggauacauaaacuucucauacgaaguacuaacaccacuaaaaugguaccaaaacaugauaagacaccccuacacaucauacggauacgaaccaaugggaggauggcuacaccaccaaauaauaccaguaguaucacaacaaacaccacaaucacacgcacuacaaccacaccaccacauaccaaugguaccagcccaacaaccaggcauaccacaacaaccaaugaugccacuaccaggacaacacucaaugacaccaacacaacaccaccaaccaaaccuaccacuaccagcacaacaaccauuccaaccacaaccaguacaaccacaaccacaccaaccacuccaaccacaaucacccaugcaccccauacaaccauuacuaccacaaccaccacucccaccaauguucuccaugcaaucacuacuaccagaccuaccacuagaagcauggccagcaacagacaaaacaaaaagagaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2525 - RNA, 3178 nt, Artificial Sequence
  mRNA product Design1 comprising derived and/or modified sequence from Homo sapiens__NP_006120.1__HsBMP1 (opt13)
gggagaaagcuuaccaugccagguguagcacgucuaccauuauugcuagguuuauugcuacuaccccgaccgggacgaccacuagacuuagccgauuacacauaugaccuagcagaagaggacgauagugaaccauuaaacuacaaagauccauguaaagcugccgcauucuuaggugauauagcuuuagacgaagaagauuuacgugcauuucaaguccagcaagcaguagauuuacguagacauacugcacgcaaaaguucaauaaaagcagcuguaccaggaaacacaucaacaccuuccugucaaucaacaaauggucaaccucaaagaggggcuugcggacguuggagggggagaaguagaaguagacgugcagcaacaagucgaccagaacgaguauggccagauggaguaauuccauuuguaauugguggaaacuuuacuggaucacaaagagcuguauucaggcaagcuaugagacauugggaaaaacauacuugcguuacauucuuagaacgaacagaugaagauuccuauauaguauuuacuuauagaccuugugggugcuguaguuauguggguagaagaggggguggaccacaagcaauaucaauugguaaaaauugugacaaauuuggaauaguuguacaugaacuaggacauguaguaggauuuuggcacgaacauacaagaccagauagagacagacauguauccauaguuagagaaaauauacaaccaggacaagaauauaauuuccuaaaaauggagccacaggaaguagagaguuugggagaaacuuacgacuucgacaguauaaugcauuaugcaagaaauacuuuuucacgaggaauauuccuagauacuauugugccuaaauacgaagugaaugguguaaaaccuccaauuggucaaaggacuagguuaagcaaaggagauauagcacaagcgcgcaaacuuuauaaauguccagcauguggugaaacauuacaggacucaacaggaaauuuuucaucaccugaauacccuaacggguauagugcacauaugcacuguguauggagaauaucaguaacaccaggagagaaaauaauauuaaacuucacuagccuggaucuuuauagaucgagacucuguugguaugauuauguagaaguuagagauggcuucuggagaaaagcaccauugagagggcguuuuuguggcaguaaacuaccagaaccaauaguaucuacagauuccagauuaugggucgaguucagaaguucauccaauuggguaggaaaagguuucuucgccguauaugaagcgauaugcggaggggauguaaagaaagacuauggucauauacaaagcccuaauuauccugaugacuauaggccaaguaaaguuuguauuuggagaauacaagugucagaagguuuucacguuggacucacauuucaaucuuuugaaauagagcgccaugacucaugugcguaugacuauuuagagguaagagacggacauucagaaucuucuacucuuauaggaagauauuguggauaugagaaaccagaugauauaaaaaguacaaguucucgacuaugguuaaaauuuguaagcgauggaagcauaaauaaagcaggauuugcaguaaauuucuuuaaagaaguugaugaaugcucgagaccuaauagagggggaugcgaacaacgaugucuaaauacacucggaagcuacaaauguagcugugauccaggauaugaacuugcaccggacaaaagaagaugugaagcugcaugcggcggauuucuaaccaaacucaauggaucaauuacuuccccaggauggccuaaagaauauccaccgaauaaaaacugcauauggcaauuaguagcuccaacacaauaucgcaucagcuuacaauuugacuucuuugaaacugagggaaaugauguuuguaaauaugacuuugucgaagucagaucaggccucacagcagauucuaaauuacacggcaaauuuuguggaagcgaaaaaccggaaguaauaacaucacaauacaauaacaugagaguagaguuuaaaagcgauaauacaguaaguaagaaaggauuuaaagcacacuucuucucagauaaagacgaauguucaaaagacaaugggggaugucaacaagacuguguaaauacguuuggaucauaugaaugucaaugccgaaguggauucguacuucaugauaauaaacaugauuguaaagaagcagguugcgaucacaaaguuacaucaacuucaggcacaauaacuucaccuaacuggccagauaaauauccaucaaagaaagaauguacaugggcaauaucuucaaccccaggucaucgcguaaaauuaacauuuauggaaauggauauugaaucacaaccagaaugugcauaugaucacuuagaaguauucgacggaagggaugcaaaagcaccaguauuagguagauuuuguggcaguaagaaaccagaaccaguucuugcgacaggaagccguauguuuuuaagauuuuacucagauaauuccguacaaagaaaaggauuucaagccucccaugcgacggaauguggaggacaaguacgagcagauguuaaaaccaaagaccuauacucacacgcacaauuuggugauaauaauuacccaggugggguagacugcgaauggguaauaguagcagaagaaggguacggaguugaauuaguauuccaaacauuugaaguagaagaagaaaccgauuguggcuaugauuauauggaacuauucgacggauacgacuccacagcaccgagauuaggacgauacuguggaaguggaccaccagaagaaguuuauucagcaggagacucagucuuagugaaauuucauucggacgacacaauaaccaagaaaggauuccacuuaagauacacuucaacuaaauuccaagauacacuacacaguagaaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2526 - RNA, 1408 nt, Artificial Sequence
  mRNA product Design1 comprising derived and/or modified sequence from Homo sapiens__NP_001191.1__HsBMP2 (opt13)
gggagaaagcuuaccauggucgccggaaccagaugccuauuagcccuacuauuaccacaaguucuacuagguggagcugcaggauuaguaccagaacuaggaagacgaaaauucgcggcagcauccucaggaagaccaucaucacagccaucagacgaaguacuauccgaauucgaacuaagguuauuaucuauguuuggauuaaaacaaagaccaacgccaucuagagacgcagucguuccaccauacaugcuagaucuauauagaagacacuccggacaaccaggauccccagcacccgaucauagauuagaacgagccgcaucacgugcaaacaccguaagauccuuccaccacgaagaaucucuagaagaacuaccagaaacaucaggaaaaacuacaagaagauucuucuuuaaccuaucaucuaucccaacagaagaauucaucacaucagcagaauuacaagucuuuagagaacaaaugcaagacgcauuaggaaauaacucaucauuucaccacagaauuaacauauacgaaauaaucaaaccagcaaccgcaaacagcaaauucccagucacucgauuacuagauacaagacuaguuaaccaaaacgcaucaagaugggaaucauuugacguaacucccgcaguuaugagauggacagcacaaggacacgcaaaucacggauuugucguugaaguagcccauuuagaagaaaaacaaggaguuucaaaaagacacguccgcauaagcagaucacuacaucaagacgaacauucuuggagucaaauaagaccacuacuuguaacauucggccacgacggaaaaggacacccauuacacaaaagagaaaaaagacaagcaaaacacaaacaaagaaaaagacuaaaaucaucaugcaaaagacauccauuauacguagauuucucagauguaggauggaacgacuggauaguagcaccaccaggauaccacgcauuuuacugccauggagaaugcccauuuccacuagcagaccaccucaacucaaccaaccacgcaauaguucaaacccuaguaaauucaguaaauucaaaaauaccaaaagcaugcugugucccaacagaacuuucugcaauaucaaugcuauauuuagaugaaaacgaaaaaguaguucuaaaaaauuaccaagacauggucguagaaggaugcggauguagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2527 - RNA, 1444 nt, Artificial Sequence
  mRNA product Design1 comprising derived and/or modified sequence from Homo sapiens__NP_001193.2__HsBMP4 (opt13)
gggagaaagcuuaccaugauaccaggaaauagaaugcucaugguaguauuauuaugccaaguacuucuagguggagcuucacaugcaucacuuauaccagaaaccggaaaaaaaaaaguagcagaaauacaaggacaugccggaggaagaagauccggacaaucacaugaauuacuacgagauuuugaggccacuuuauuacagauguucggauuaagaagacgaccucaaccaucaaaaucagcaguaauuccagacuacaugcgagaucuauacagauuacaaucaggagaagaagaagaagaacaaauacacaguaccggacuagaauacccagaaagaccagcaucaagagccaauaccguuagaucauuccaccaugaagaacauuuagaaaauauaccaggaacaucagaaaauucagcuuucagauuuuuauucaauuuaagcagcauaccagaaaacgaagucauaucaucagcagaacuaagacuauuuagagaacaaguugaccaaggaccugacugggaacgcggauuccacagaauaaauauauacgaaguaaugaaaccaccugcugaaguaguaccaggacaccuaauaacuagauuacuagauacaagacuaguacaccauaauguaacaaggugggaaacauuugacguaucaccggcaguauuacgguggacaagagaaaaacaaccaaauuacggacuagcaauagaagucacacacuuacaucaaacaagaacacaucagggucaacacguaagaauaucacgaucacuuccacaagguucagguaacugggcccaauuaagaccauuacuaguaacauuuggacaugacggaagaggacacgccuuaacacgaaggcgaagagccaaaagaaguccaaaacaccauucacaaagagcacgaaaaaaaaacaaaaauugccgaagacauucacuauacguagacuuuucagaugucggauggaaugacuggaucguagcaccaccaggcuaccaagcauuuuacugucacggagauugcccauuuccacuagcagaucacuuaaacucaaccaaucacgcaauaguacaaacacuaguaaauucuguaaacagcucuauaccaaaagcuuguuguguaccaacagaacuaucagccauaucuauguuauaucuagaugaauaugauaaaguaguauuaaaaaacuaucaagaaauggucguagaaggaugcggauguagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2528 - RNA, 1759 nt, Artificial Sequence
  mRNA product Design1 comprising derived and/or modified sequence from Homo sapiens__NP_001709.1__HsBMP6 (opt13)
gggagaaagcuuaccaugcccggauuaggaagacgagcacaauggcuaugcugguggugggguuuauuauguagcuguugcgguccaccaccuuuaagaccaccauuaccagccgcagcugcugcugcagcaggcggucaacuauuaggagaugggggaucacccgggagaacagaacaacccccaccaucaccccaaagcucaucaggguucuuauacagaagauuaaaaacacaagaaaaacgcgaaaugcaaaaagaaauacuaaguguauuaggauugccacauagaccuagaccauuacauggauuacaacaaccacaaccuccagcuuuaagacaacaagaagaacaacaacaacaacaacaauuacccagaggagaaccacccccaggaagacuaaaaucugcuccauuauucaugcuagaccuauacaaugcacuaagcgcagacaaugacgaagauggagcuucugaaggagaaagacaacaaucauggccucaugaagcagcuucaagcagucaaaggagacaaccaccaccaggagcagcacacccacuuaaucgaaaaagccuacuagcacccggcucuggaucaggaggcgcaaguccauuaacaucagcacaagauagcgcguuuuuaaaugacgcagacaugguaaugucauucgugaauuuaguagaauacgauaaagaauuuucuccaagacaaagacaccacaaagaguucaaauucaaucuaucccaaauaccugaaggagaaguaguaacugcagcagaauuuagaaucuacaaagacuguguaaugggaucauucaaaaaucaaacuuucuuaauaucuaucuaccaaguauuacaagaacaucaacauagagacucugauuuauuccucuuagacacaagaguuguaugggcaucagaagaagguuggcuagaauuugacauuacugcaacaucaaacuuauggguaguaacaccacaacauaacaugggacuacaauuaucagucguaaccagagaugguguucauguacacccuagagcugcaggacuuguaggcagagacggaccauacgauaaacaaccauucaugguagcauucuucaaaguaucagaaguacauguaagaacaacacgaucugcuagcucaagaagaagacaacaaagucgcaacagaucuacacaaucacaagauguagcacgaguaucaucugcuucagacuauaacuccuccgaacuaaaaacagcaugcaggaaacacgaauuauacguuuccuuccaagauuuaggauggcaagacuggauaauagcacccaaaggauacgcugcaaacuacugcgacggugaauguucauuuccauuaaaugcacauaugaacgcaacaaaccaugcaaucguacaaacucuaguacaccuaaugaauccagaauauguccccaaaccauguugcgcacccacaaaacuuaacgcaauaucagucuuauacuuugacgacaauucaaauguaauccuaaagaaauauagaaacaugguagucagagccugcgguugccauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2529 - RNA, 1513 nt, Artificial Sequence
  mRNA product Design1 comprising derived and/or modified sequence from Homo sapiens__NP_001710.1__HsBMP7 (opt13)
gggagaaagcuuaccaugcauguaagaucacuaagagcagcugccccacacucauuuguagcacugugggcaccacuuuuuuuacuaagaagcgcauuagcagacuuuucacuagacaaugaaguacauucaagcuuuauucauaggagacuucggucacaagaaagacgugaaaugcaaagagaaauauuaucuauucuaggacuaccacaccgcccaagaccacaucuacaaggaaaacacaauucagcuccaauguucaugcuagaucuuuauaacgcaauggcagucgaagaaggaggaggccccggaggacaaggauuuuccuauccauauaaagcaguauuuucaacacaaggaccuccucuagcaagucuacaagauucacauuucuuaacagaugcagauaugguaaugucauuuguaaauuuaguagaacaugauaaagaauuuuuucacccacguuaccaccauagagaauucagauucgaucuaucuaaaauaccagaaggugaagcaguaacagcagcugaauucagaauauacaaagauuacauacgagaaagauuugacaacgaaacauucagaauaucaguauaucaaguacuacaagaacacuuagguagagaaagcgaucuauuucuauuagacuccagaacacucugggcaucagaagaaggcuggcuaguauucgauauaacagcaaccaguaaucacugggucguaaacccaagacacaaccucggacuacaauuaucaguagaaacauuagacggccaaaguauuaacccaaaacucgcaggacuaauaggaagacacggaccacaaaacaaacaaccauucaugguagcauucuuuaaagcaaccgaaguacacuucagaucaauacgaucaacaggauccaaacaaagaagccaaaauagaucaaaaacuccaaaaaaucaagaagcauuaagaauggcaaauguagcugaaaauucaucaagugaucaaagacaagccugcaaaaaacacgaauuauacguauccuuccgagauuuaggauggcaagacuggauaauagcaccugaaggcuacgccgcauacuacugugaaggagaaugugcauuucccuuaaacucauauaugaacgcaacuaaucacgcuauaguacaaacacuaguacacuuuauaaaucccgaaacaguacccaaaccaugcugcgcaccaacacaacucaacgcuauaucaguauuauauuuugacgacucuucuaacguuauccuaaaaaaauaucgaaauaugguagucagagcauguggcugccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2530 - RNA, 517 nt, Artificial Sequence; identical to SEQ ID NO: 1978
  mRNA product Design1 comprising derived and/or modified sequence from Homo sapiens__NP_006264.2__HsCCL7 (opt13)

SEQ ID NO: 2531 - RNA, 3841 nt, Artificial Sequence
  mRNA product Design1 comprising derived and/or modified sequence from Homo sapiens__NP_001954.2__HsEGF (opt13)
gggagaaagcuuaccauguugcuuacuuuaauaauauuacuuccaguugucaguaaauuuucguuugugucauuaucugcaccacaacauuggaguuguccagaagguacgcuagcaggcaacgguaauucuacgugugucgguccagcgccauuucuaaucuuuucucaugguaacuccauuuuuagaauagauacagaagguacaaauuacgaacaauuaguaguugacgcaggagucagcguaauaauggacuuucauuauaaugagaaaagaaucuauuggguagacuuggaaagacaauuacuucagcguguauucuugaauggauccagacaagaaagaguauguaauauagagaaaaauguaucagguauggcuauaaacuggauaaaugaagaagugauuuggucaaaucaacaagaagggaucauuaccguuacagacaugaaaggaaauaauucccacauacuacuaucagcacuaaaauaucccgccaauguugcaguagauccaguggaaagauuuauauuuugguccucagaaguagcaggaucauuauauagagcagacuuagacgguguggguguuaaggcuuuacuagaaacuucugagaaaauuaccgcaguaaguuuagacguuuuagacaaaagauuauuuuggauucaauauaauagggaagguucaaauucacuuauauguucuugcgacuaugaugguggaucagugcauauaaguaaacauccaacgcaacacaaucucuuugcaaugucuuuauuuggugauagaauauuuuacagcacuuggaaaaugaaaacaauauggauagccaacaaacauaccggaaaagauaugguaaggauaaaucuacacaguuccuucguuccuuuaggugaacuaaaaguaguacauccacuagcgcaaccuaaagcggaagaugacacuugggaaccagaacaaaaacuauguaaguuacgaaaaggcaacuguucaucuacagugugcgggcaagacuuacaaagucacuuauguaugugcgcggaaggcuaugcgcucaguagagauagaaaauauugugaagauguaaaugaaugugcauuuuggaaccauggauguacacuaggaugcaaaaauacaccagguucauauuauuguacuugucccguuggauuuguccuguuaccagacggcaaaaggugccaucagcuaguaaguuguccacguaauguuucagaauguagccacgauuguguuuugacaagugaaggaccacuaugcuuuugcccagaaggaucaguauuagaaagggauggaaaaacauguagugguuguaguucaccagauaauggagguuguagucaacuuuguguuccauuaucuccuguaucuugggaaugcgauuguuucccagguuaugauuuacaauuagaugagaaaaguugugcagcgucuggcccacaaccauucuuacucuuugcaaauucacaagauauaagacacaugcauuucgauggcaccgacuacggcacccuauuaagucaacaaauggggaugguauaugcacuugaccaugauccaguagaaaacaaaauauacuucgcacauaccgcacucaaauggaucgaaagagcaaauauggacggaagucaaagggaacgguugauugaagaaggaguagauguaccugaggguuuagcaguugauuggauagggaggagauuuuauuggacggacagggggaaaaguuuaauaggacgaagcgaccucaacgggaaaagaagcaaaauaaucacuaaagaaaauauuucacaaccaagaggaauugcuguacauccaauggcaaaacgucuauuuuggacagacacaggaauaaauccuagaauagaguccaguucacugcaaggauuggggagauuagugaucgccaguuccgaccuaauauggccaucgggaauuacaauagacuuuuuaaccgauaaacuauauuggugcgaugcaaaacagucaguaauugaaauggccaaucuagauggaucuaaaagaagaagacuaacacaaaaugaugugggacacccauuugcuguugccguuuucgaggacuacgucugguuuucagauugggcaaugccaagugucaugagagucaauaagagaacugguaaggauagagucagauuacaaggcucaauguuaaaaccaucgagucuagucguaguccacccauuagcaaaaccaggugcagaucccugcuuauaucaaaauggagggugcgaacacauauguaagaaaagacuuggcacagcaugguguucauguagagaaggauuuaugaaggcuucagauggaaaaaccuguuuagcauuagauggccaucaacuucucgccggaggagaaguugacuugaaaaaccaaguaacaccccuagauauauuaagcaaaacaagaguuagcgaagauaacauaacagaaucucaacauauguuaguagcagaaauuauggucucagaucaagaugacugcgcaccuguaggauguucuauguaugcuagaugcauaucagagggggaagaugcgacaugucaaugcuuaaaaggauuugcaggcgacggaaaauuaugcucagacauagacgaaugugaaaugggaguuccuguuuguccuccagcaucuuccaaauguauaaauaccgaaggugguuauguauguagauguagugaaggauaccaaggggacgguauccauuguuuagauauagaugaaugccaauugggagaacacuccuguggagagaacgcauccuguacaaauacugaaggagguuauacguguaugugcgcaggaaggcuuuccgaaccugguuuaauuugcccagauucaacaccucccccacaccuucgugaagaugaccaccauuauaguguacgaaauucagauucugagugcccacuaagccaugauggauauuguuuacacgauggaguaugcauguacauagaagcguuggauaaauacgcuuguaauugugugguuggauacauaggugaaagaugucaauaccgagaccuaaaauggugggaacuaagacaugccgggcacggacaacaacaaaaaguaauagucguugcaguguguguaguagucuuagucaugcuauuacuauugagccucuggggugcacacuauuauaggacacaaaaacuacuaucuaaaaaccccaaaaauccauaugaagaaucaagucgugaugucagaucaagaagaccagcagacacagaagacggaaugucaucguguccacaaccaugguuugugguaauuaaagaacaucaagaucucaaaaacggaggccaacccguugcuggugaagauggacaagcagcagaugguaguaugcagcccacaucauggcgacaagagccacaauuaugcggcaugggaacagaacaagguuguuggauuccaguuaguucugacaaaggaagcuguccgcaagugauggagaggucauuucauaugccaagcuacggaacacagacacucgaaggcggaguagagaaaccacauucgcuucuuucugcaaacccauuauggcaacaaagagcucuagauccaccucaccaaauggaauugacucaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2532 - RNA, 727 nt, Artificial Sequence
  mRNA product Design1 comprising derived and/or modified sequence from Homo sapiens__NP_001423.1__HsEREG (opt13)
gggagaaagcuuaccaugacagcaggcagaagaauggaaaugcuaugugcaggacgaguaccagcauuauuacuaugucuaggauuccauuuauuacaagcaguacuaagcacaacaguaauaccaagcuguauaccaggagaaagcucagacaauugcacagccuuaguacaaacagaagacaauccaagaguagcacaaguaaguauaacaaaaugcucaagcgauaugaauggauauugcuuacacggacaauguauauaucuaguagacaugagccaaaacuauugcagaugcgaagucggauacacaggaguaagaugugaacauuucuucuuaacaguacaucaaccacuaucaaaagaauacguagcauuaacaguaauauuaauaauacuauuucuaauaacaguaguaggaagcacauacuauuucuguagaugguacagaaacagaaaaucgaaagaaccaaaaaaagaauacgaacgaguaacaucaggagauccagaacuaccacaaguauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2533 - RNA, 685 nt, Artificial Sequence
  mRNA product Design1 comprising derived and/or modified sequence from Homo sapiens__NP_000791.1__HsFGF1 (opt13)
gggagaaagcuuaccauggcagaaggagaaauaacaacauucacagcacuaacagaaaaauucaaccuaccaccaggaaacuacaaaaaaccaaaacuacuauacugcucaaacggaggacacuuccuaagaauacuaccagacggcacaguagacggaacaagagacagauccgaccaacacauacaacuacaacuaucagcagaaucaguaggagaaguauacauaaaaucaacagaaacaggacaauaccuagcaauggacacagacggacuacuauacggaucacaaacaccaaacgaagaaugccuauuccuagaaagacuagaagaaaaccacuacaacacauacauaucaaaaaaacacgcagaaaaaaacugguucguaggacuaaaaaaaaacggaagcugcaaaagaggaccaagaacacacuacggacaaaaagccauacuauuccuaccacuaccaguaucaucagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2534 - RNA, 1084 nt, Artificial Sequence
  mRNA product Design1 comprising derived and/or modified sequence from Homo sapiens__NP_001997.5__HsFGF2 (opt13)
gggagaaagcuuaccaugguaggaguaggagggggagauguagaagauguaacaccaagaccagguggaugucaaauuagcggaagaggugcaagaggauguaauggaauaccaggagcagcagcuugggaagcagcauuaccgagaagacgaccgagaagacauccgagugugaauccaagaucaagagcagcuggaagcccaagaacaagaggaagaagaacagaagaaagaccaaguggaagcagauuaggagauagaggaagaggacgagcauuaccaggaggaagauuaggaggaagaggaagaggaagagcaccagagagaguaggagggagaggaagaggaagaggaacagcagcgccaagagcagcaccagcagcaagaggaucaagaccaggaccagcaggaacaauggcagcgggaaguauaacaacauuaccagcucuaccagaagauggaggaaguggggcguuuccaccaggacauuuuaaagauccaaaaagauuauauuguaaaaauggaggauuuuuuuuaagaauacauccagauggaagaguagaugggguaagagaaaaaucagauccacauauaaaauuacaauuacaagcggaagaaagaggagugguaaguauuaaaggaguuugugcaaauagauauuuggcgaugaaagaagaugggagguuauuagcaaguaaauguguaacggaugaauguuuuuuuuuugaaagacuagaaagcaauaacuauaacacauauagaucgagaaaauacacaucaugguauguagcauuaaaaagaacaggacaauauaaacuaggaaguaaaacaggaccaggacaaaaagcaauauuauuuuuaccaaugagugcaaagaguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2535 - RNA, 802 nt, Artificial Sequence
  mRNA product Design1 comprising derived and/or modified sequence from Homo sapiens__NP_002000.1__HsFGF7 (opt13)
gggagaaagcuuaccaugcacaaauggauacuaacauggauacuaccaacacuacuauacagaagcugcuuccacauaauaugccuaguaggaacaauaucacuagcaugcaacgacaugacaccagaacaaauggcaacaaacguaaacugcucaucuccagaaagacacacaagaucauacgacuacauggaaggaggagacauaagaguaagaagacuauucugcagaacacaaugguaccuaagaauagacaaaagaggaaaaguaaaaggaacacaagaaaugaaaaacaacuacaacauaauggaaauaagaacaguagcaguaggaauaguagcaaucaaaggaguagaaucagaauucuaccuagcaaugaacaaagaaggcaaacuauacgcaaaaaaagaaugcaacgaagacugcaacuucaaagaacuaauacuagaaaaccacuacaacacauaugcaagcgcaaaauggacacacaacggaggagaaauguucguagcauuaaaccaaaaaggaauaccaguaagaggaaaaaaaacaaaaaaagaacaaaaaacagcacacuuccuaccaauggcaauaacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2536 - RNA, 844 nt, Artificial Sequence
  mRNA product Design1 comprising derived and/or modified sequence from Homo sapiens__NP_001936.1__HsHBEGF (opt13)
gggagaaagcuuaccaugaaauuauuaccaucaguaguacuaaaacuauuucuagcagcaguacuaucagcauuaguaacaggagaaagccuagaaagacuaagaagaggacuagcagcaggaaccucaaacccagacccaccaacaguaucaacagaucaauuacuaccacuaggcggaggaagagauagaaaaguaagagacuuacaagaagcagaccuagauuuacuaagaguaacauuaucaucaaaaccacaagcacuagcaacaccaaacaaagaagaacacggaaaaagaaaaaaaaaaggaaaaggauuaggaaaaaaacgagauccaugccuaagaaaauauaaagacuucugcauacauggagaaugcaaauacgucaaagaacucagagcaccaagcugcauaugucacccuggauaccacggagaaagaugccacggacuaagucuuccaguagaaaacagauuauacacauacgaccacacaacaauacuagcaguaguagcaguaguauuaagcucaguaugucuauuaguaauaguaggucuacuaauguucagauaucaccgaagaggaggauacgauguagaaaaugaagaaaaaguaaaacuaggaaugacaaauagccacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2537 - RNA, 2404 nt, Artificial Sequence
  mRNA product Design1 comprising derived and/or modified sequence from Homo sapiens__NP_000592.3__HsHGF (opt13)
gggagaaagcuuaccauguggguaacuaaacuauuaccagcauuacuauuacaacauguccuacuacaccuacuauuacuaccuauugcaauaccauacgccgaaggucaaagaaaacgaagaaauacaauacaugaguucaaaaagucagcaaaaacaacauuaaucaaaauagacccagcacuaaaaauaaaaacaaagaaaguaaauacagcagaucaaugugcaaacagaugcacuagaaacaaaggacuaccauuuacauguaaagcauucguauuugauaaagcaagaaaacaaugucuaugguuuccauuuaauagcaugaguucaggaguaaagaaagaguucggacaugaauuugaccuauaugaaaauaaagacuauauaagaaauugcauaauagguaaaggaagaucauauaaaggaacaguuuccaucacaaaaucaggaauaaaaugucaacccuggucaucaaugauaccacacgaacauagcuuucuaccaagcucauacagagguaaagaucuacaagaaaauuauuguagaaauccgagaggugaagaaggcggaccaugguguuuuacuucuaauccagaaguacgauaugaaguaugugauauaccgcaaugcucagaaguagaauguaugacauguaacggagaaucauauagagguuugauggaucauacagaaucaggcaaaauaugucaaaggugggaccaccaaacuccacaucgacauaaauuucuaccagaacguuauccagauaaaggcuuugaugauaauuacugucgaaacccagacggacaaccaagaccuuggugcuacacauuagauccccauacucgaugggaauacugugcaauaaaaacaugcgcagauaacacaaugaaugacacagauguuccucuagaaacuacugaaugcauacaaggacaaggagaaggauaccgaggaacuguaaauacaauauggaauggaauaccuugucaaagaugggauucacaauauccucaugaacaugacaugaccccagaaaauuuuaaaugcaaagaucuaagagaaaauuauugcagaaacccagacggaucugaaucgccaugguguuuuacaacugauccuaacauaagaguaggcuauugcucucagauaccgaauugcgacaugagccauggacaagacuguuauagaggaaauggcaaaaauuacaugggaaaucucagucaaacaagaucaggauuaacuuguucaaugugggacaaaaauauggaagauuuacauagacacauauucugggaaccagacgcaucaaaauuaaaugaaaacuauugcagaaauccagaugacgacgcacacgggccaugguguuauacaggaaauccauuaauaccaugggacuacuguccuauaagccgaugugaaggagauacaacucccacaauuguaaacuuagaucauccaguaaucucaugugccaaaacaaaacaauuaagagucguaaacgguauaccuacuaggacaaacauaggcuggauggugucacuuagauauagaaauaaacacauaugcggaggcagucuuauaaaagaaucauggguccucacagcaagacaauguuuucccagcagagauuuaaaggacuaugaagcaugguuaggaauacacgauguacacggacgaggagacgaaaaauguaaacaaguacuaaauguuucucagcuagucuauggaccagaagggagcgauuuagucuuaaugaaacuagcaagaccggcagucuuagacgacuucguaucuacaauugauuuaccuaacuacggaugcacgauaccagaaaagacuagcuguucuguuuauggaugggguuauacuggacuaaucaacuacgacggacuauuaaggguggcacauuuauauauuaugggaaacgaaaaauguucucaacaccacagaggaaaaguaacauuaaacgaaucagaaauaugcgcaggagcagagaaaaucggaucaggcccgugugaaggagacuauggugggccgcuagugugcgaacaacacaaaaugcgaaugguauuagggguaauaguaccuggacggggaugcgccauaccaaauagaccaggaauauucguaagaguagcauauuaugccaaauggauacauaaaauaauacuaacauauaaaguaccacaaucuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2538 - RNA, 2143 nt, Artificial Sequence
  mRNA product Design1 comprising derived and/or modified sequence from Homo sapiens__NP_005336.3 __HsHSPA1A (opt13)
gggagaaagcuuaccauggccaaagcagcugcaauaggaauagaucuaggaacaacauacuccuguguaggaguauuccaacacggaaaaguagaaauaaucgcaaaugaucaagguaacagaacaacaccaucauacguugcauuuacagacacagaaagauuaauaggagaugcagccaaaaaccaagucgcacuaaauccacaaaacacaguauuugaugcaaaacgcuuaauaggaagaaaauuuggcgauccaguaguacaaucagacaugaaacauuggccauuucagguaauaaacgauggagauaaaccaaaaguucaaguuaguuacaaaggcgaaacuaaagcauuuuacccggaagagauaucaagcaugguauuaacaaaaaugaaagaaaucgcagaggcuuauuuaggauacccaguaacaaacgcaguaauaacaguaccagcuuacuuuaaugauagucagagacaagcaacuaaagaugccggaguaauugccggacuaaacguacuaagaauaauaaacgaaccaacugcagcagcaauagcauauggauuagauagaacaggcaaaggagaaagaaauguauuaauauucgaccuaggaggagguacauucgacgugucaauauuaacaauugaugauggaauauucgaaguaaaagcaacagccggggacacacauuuagggggagaagauuuugacaacagacugguaaaccauuuuguagaagaauuuaaaagaaaacacaagaaagacauuucacaaaauaaaagggcaguuagaagacuaagaacugcaugugagagggcaaaaaggacguuaagcaguaguacccaagcaucacuagagauagacucauuauuugaaggaauugauuuuuauacuucaaucacgagagcgagauuugaagaauuauguagugaucucuuuagaucgacauuagaaccugucgaaaaagcacuaagagaugcgaaacuagacaaagcacaaauacaugacuuaguucuaguaggaggaucaaccagaauaccaaaaguacaaaaacuacuacaagauuucuucaacggaagggacuuaaauaaaucaauaaacccagaugaagcugucgcuuacggugcagcuguccaagcagcaauacuaaugggagauaaaagcgagaaugugcaagacuuauuauuauuagacguugcaccucuaucgcuaggacuagaaacagcaggaggaguaaugacagcacuuauaaaaagaaacagcacaauaccgacuaaacaaacgcaaauauuuacaaccuauucagauaaccaaccuggcguccuuauacagguuuaugaaggugaaagagcaaugacaaaagauaacaaucuacuaggaagauuugagcuaaguggaauaccaccagcaccucgaggaguaccacaaauagaaguuacauucgacauagacgcuaauggcauucuaaaugugacagcuacugacaaaaguaccggaaaagcaaauaaaauaacuauuacaaacgauaaaggaagacuaagcaaggaagagauagaacgcaugguacaggaagcagaaaaauacaaagcggaagacgagguccagcgagaaagaguaagcgcuaaaaacgcauuagaaucauaugcauucaacaugaaaagcgcaguagaagaugaaggacuaaaagguaaaauaagcgaagcagauaaaaagaaaguacuagauaaaugucaagaaguuauaaguugguuagaugcaaauacuuuagcggaaaaagaugaauuugaacauaaaagaaaagaacuagaacagguaugcaauccuauuauaucaggauuauaccaaggagcuggaggaccaggaccaggaggcuucggagcacaaggaccgaaaggaggauccggaucagggccaacaauagaagaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2539 - RNA, 2143 nt, Artificial Sequence
  mRNA product Design1 comprising derived and/or modified sequence from Homo sapiens__NP_005337.2 __HsHSPA1B (opt13)
gggagaaagcuuaccauggcaaaagcugcagcaauaggaauagaccuaggaacaacauacuccugcguaggaguauuucagcaugguaaaguugaaauaauagcuaacgaccaaggcaacagaacaacccccucauacgucgcauucacagauaccgaaagauuaaucggagaugcggcuaaaaaccaaguggcacucaauccacaaaacacaguauuugacgcaaaaagacugauaggaagaaaauucggcgauccagugguucaaucagauaugaaacauuggccauuccagguaauaaaugauggagauaaaccaaaaguacaaguaucauauaaaggagaaacaaaagcauuuuauccagaggaaauaaguaguaugguauuaacaaaaaugaaagaaauagcugaagcauaucucggauacccaguaacaaacgccguaauaacaguuccagcauauuucaacgacagucaaagacaagcaacaaaagaugcaggaguaauagcuggccuaaauguacuuagaauaauaaaugaaccuacugcugcugccauagcauacggacuagaucgaacaggcaaaggagaaagaaauguuuuaauauucgaccuuggaggaggaacauucgacguaagcauuuuaacaauagaugauggaauauuugaaguuaaagccacugcaggggauacucaccuaggaggagaagauuucgauaacaggcuaguuaaucauuuuguagaagaauuuaaaagaaaacauaagaaagacauaagucaaaacaaaagagcaguaagaagauugagaacagcaugugaaagagcuaaaagaacgcuaagcucaagcacacaagcaaguuuagaaauagauaguuuauuugaaggaauagauuuuuauacuucgauaacgagagcaagauuugaagaauuauguucagauuuauuuagaucaacguuagaaccaguugaaaaagcacuaagagacgcaaaauuagauaaagcucaaauacaugaccuagucuuggucggaggcucaacacgaaucccuaaaguacaaaaauuacuucaagauuucuuuaacgguagagaucuaaauaaaucaauaaaucccgacgaagcuguagcauauggagcagcuguacaagccgcaauucuuaugggagauaaaucagaaaauguacaagauuugcuacuuuuagacguggcaccacuuagccuaggacuagaaacagcuggaggaguaaugaccgcauuaauaaaacgcaacucgacuauaccaacaaaacaaacacaaaucuuuacaacauacagugauaaucaaccaggaguacuaauacaaguauaugaaggagaaagagcaaugacuaaagacaauaaucuacuaggacgguucgaacuaagcggcauuccaccagcaccucgaggaguaccacaaauugaaguaacauuugauauagacgcaaacgggauauuaaacguuacagcaaccgauaaaagcacaggcaaagcaaacaaaauaacaauuacaaaugauaaaggaagacuuucaaaagaagaaauagagagaaugguacaagaagcugagaaauacaaagccgaagacgaaguccaaagagaaagaguuagcgcuaaaaacgcacuggaaucauaugcuuucaauaugaaaucagcaguagaggacgaaggacuaaaaggcaaaauuucagaagcagacaaaaagaaaguacuagauaaaugucaagaaguaauuagcugguuagaugcaaauacccuggcagagaaagaugaauuugaacauaaaagaaaagaauuagaacaaguaugcaaucccauaauaucaggucuguaucaaggagcaggcgggccaggaccaggaggauuuggagcacagggaccaaaagguggauccgguagcggcccaacaaucgaagaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2540 - RNA, 2143 nt, Artificial Sequence
  mRNA product Design1 comprising derived and/or modified sequence from Homo sapiens__NP_005518.3 __HsHSPA1L (opt13)
gggagaaagcuuaccauggcaacagcaaaaggaauagcaauaggaauagacuuagggacaacuuacaguuguguuggaguauuucagcacgggaaagucgaaauaauagcaaacgaucaagguaauaggaccaccccuucguacguagcauuuacagauacugaaagacuaauaggugaugcagcgaaaaaccaagucgcaaugaacccgcaaaauacaguauuugacgcaaaacgguuaauuggaagaaaguuuaacgacccaguuguacaagcagauaugaaauuauggccauuccaaguaauaaacgaaggaggaaaaccuaaaguguugguauccuauaaaggcgaaaacaaagcauuuuauccggaagaaauaucaucaaugguacuaacaaaacuuaaagaaacggcagaagcauuucuaggacauccagucacaaacgcaguaauaacaguuccagcauacuuuaacgauagucaaagacaagcaacgaaagaugcaggaguuauagcaggucuaaauguacuuaggauaaucaacgaaccaacggcagcagcaauagcauacggacuagauaaaggaggacaaggagaaagacauguacuaauauuugauuuaggcggaggaacauucgacguaaguauauuaaccauagaugauggaauauucgaaguaaaagcaacagcaggggacacacacuuaggaggcgaagacuucgauaacaggcuaguaagccauuuuguagaagaguucaaaagaaaacacaagaaagauauaucacaaaauaaacgcgcaguacgaagacucagaacagcuugcgaaagggcaaaaagaaccuuaagcucuaguacacaagcaaaccuggaaaucgauaguuuauacgaaggaauagauuucuauacaucaaucacuagagcuagauuugaagaacucugugcagaucuauuuagaggaacauuagaacccguagaaaaagcgcuuagagacgccaaaauggacaaagcaaaaauacaugacauaguccuaguagguggaaguacgcguauaccaaaaguacaaagauuauuacaggauuauuucaacggaagagaucuuaacaaaaguauaaaucccgaugaagcaguagcauacggugcagcaguacaggcagcaauacuaaugggagauaaaucugaaaaaguacaagacuuacuacuguuagacguagcaccacuuucacuaggacuagaaacagcuggagguguaaugacagcauuaauaaaaagaaauucaacuauaccaacuaaacaaacacaaauauuuacaaccuauagugacaaucaaccaggaguacuaauacaaguauaugaaggagaaagagcaaugacaaaagauaacaaucugcuaggaagauuugaucuaacgggaauaccaccagcaccaagaggaguaccacaaauagaaguaacguuugacauugaugcaaauggaauacuaaacgugaccgccacagauaaaaguacuggaaaagucaauaaaauaacuaucacaaacgauaaagggagacuaagcaaagaagagauagaaagaaugguuuuagaugcagaaaaauacaaagcagaagacgagguacaaagagagaaaauagcagcuaaaaaugcauuagaaucauaugcauuuaauaugaaaagcguaguaucagacgaaggauuaaaaggaaaaauaagcgaaagugauaaaaacaaaauacuagacaaaugcaaugaacuauuaucaugguuagaaguaaaucagcuagcagaaaaagaugaauuugaccauaaaagaaaggaacuagaacaaauguguaauccaauaauaacaaaauuauaccaaggggguugcacaggaccugcauguggaacaggauaugucccaggcagaccagcaacaggaccaacgaucgaagaaguggauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2541 - RNA, 2137 nt, Artificial Sequence
  mRNA product Design1 comprising derived and/or modified sequence from Homo sapiens__NP_068814.2 __HsHSPA2 (opt13)
gggagaaagcuuaccaugucagcacgugggcccgcgauagguauagaucuagggacaacauacagcugcguugggguguuucaacacggaaaaguagaaauaauagcaaaugaucaagguaacagaaccacaccaaguuacguugcauuuacagauacugaaagguuaauaggagacgcagcgaaaaaccaaguagccaugaacccaacaaauacgaucuuugacgcaaaacgucuuauaggacguaaauuugaggacgcgaccguccaaagcgauaugaaacacuggccauuuagaguaguaagcgaaggaggaaaacccaagguacaaguagaauacaaaggagaaacaaaaaccuuuuucccugaagaaauaucaucaaugguauuaacaaaaaugaaagaaauagcagaagccuaccuugggggaaaaguccacucagcaguaauaacgguaccagcauacuuuaacgauagccagagacaagccacaaaagaugcagggacaauaacaggacucaauguauuaagaauaauuaaugagccuacagcagcagcaauagcauauggauuagauaagaaaggaugugcggguggggaaaagaacguauuaauauuugaccuagguggaggaacauucgacguaaguauacuaacaauagaagauggaaucuucgaagugaaaaguacagcaggagauacucaccugggcggagaagauuuugauaaucgaaugguuucacauuuagcagaagaguucaaacgaaagcacaagaaagauauaggaccaaacaaaagagcaguacgaagauugcgaacagcgugcgaaagagcgaaaagaacacugaguucaucaacacaagcgagcauagaaauagacucacuuuaugaaggaguagauuuuuauacaaguauaacacgcgcaagauuugaagaguuaaaugcagauuuauucagaggaacguuagaaccgguugagaaagcacuaagagacgcaaaacuugacaaaggccaaauacaagaaauaguauuagucggcggaucaacuagaauaccaaaaauacaaaaacuacugcaagacuucuuuaauggaaaagaacucaacaaaagcauaaauccagacgaagcagucgcauauggugcagcaguacaagcagcaauauuaauaggggauaaaucagaaaacgugcaagaucuacuguuacuagaugucacaccacuaucacuagguauagaaacagcaggggguguaaugacaccucuaauaaaaagaaauacaaccauuccaacaaaacaaacacaaacauuuacaaccuacucagauaaucaaucaagcguucuaguacaaguauaugaaggugaaagagcaaugacgaaggauaauaauuuauuaggaaaauucgaucucacagguauaccaccagcgccccgaggaguaccacaaauugaaguaacuuuugacauagaugcaaacggaaucuuaaauguuacagcagcagauaaaagcaccggaaaagaaaauaaaaucacuauaacgaaugauaaaggaagauuaagcaaagaugauauagauagaaugguacaagaagcggaaagauacaaaagugaagacgaagcaaauagagauagaguggcagccaaaaaugcacuagaaagcuauacauauaauaucaaacaaacagucgaagaugaaaaacuaagaggaaagauaucagaacaagauaaaaacaaaauauuggacaaaugucaagagguaauaaacugguuagauagaaaucaaauggcugaaaaggaugaauaugaacauaaacaaaaagaauuagaaagaguaugcaauccuauaauaucaaaacuauaucaaggaggaccaggaggaggaagcggaggaggaggaagcggcgcaucagguggaccaaccauagaggaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2542 - RNA, 2740 nt, Artificial Sequence
  mRNA product Design1 comprising derived and/or modified sequence from Homo sapiens__NP_002145.3 __HsHSPA4 (opt13)
gggagaaagcuuaccaugaguguuguugguauugauuuaggcuuccaaagcugcuauguggcaguugcacgagcgggaggcauagaaacaauagcaaaugaauacagcgaucgaugcacccccgcauguaucucauucggaccuaaaaacagaucaaucggagcagcggcaaaaucacaaguaauuucaaaugcgaaaaacacuguacagggauucaaaagauuucauggaagggcauucagugacccauuuguagaagcugaaaagaguaacuuggcuuaugauauagugcaacuaccaaccggcuuaacaggaauaaaaguaacauacauggaagaagaaagaaacuuuacaacagaacaaguuaccgcaauguuacuuaguaaauuaaaagaaacugcagaaagcguguuaaagaaaccaguaguagauuguguugugaguguacccugcuuuuacacagaugcggaaaggagaucuguaauggacgcuacacaaauagcgggacuaaacugcuuaagacuaaugaaugaaacaacagcagucgcauuagccuacggcauuuauaaacaagacuuacccgcauuagaagaaaaaccaagaaacguaguuuuuguggacaugggacacucagcauaucaaguaucagugugugcauuuaauagaggcaaacuaaaaguauuagcaacagcauuugacaccacacuaggaggaaggaaauucgaugaaguacuuguaaaccauuucugugaagaguucggcaagaaauauaaacuagauauaaaaucaaaaauaagagccuuauuacgacuuucacaagaaugugaaaaauuaaagaaacugaugucagcaaaugccuccgaucugccacuaaguauagaaugcuucaugaaugauguagaugucucaggaacgaugaaccgcgguaaauuuuuagaaaugugcaaugaucuauuggcaaggguagaaccaccgcuuagaagcguccuagaacaaaccaaacuaaagaaagaagauauauaugcuguagaaauugucggaggagcaacaagaaucccagcaguaaaagagaaaauaaguaaauucuuuggaaaagaauuaucaacaacgcuaaaugcagacgaagccguaacacgaggaugcgcauuacagugugccauacuaaguccagcauucaaaguaagagaguucaguauaaccgacguuguaccauacccuauaaguuuaagguggaauagucccgcagaagaagguagcucagauugugaaguauuuucuaaaaaucacgcagcaccauuuucaaaaguauuaacauucuacagaaaagagccuuuuacacuagaggcuuauuauucaucaccccaagaccuaccauacccugauccagcuauagcacaauucagcguacaaaaagugacaccacaaagcgaugggaguagcucaaaaguaaaaguaaaaguaagagucaacguacauggaauauuuucaguaaguagugcaagccuaguagaaguacauaaaucagaagaaaaugaagaaccuauggaaacagaucaaaacgcgaaagaagaagagaaaaugcaaguugaucaagaagaaccccaugucgaagaacaacaacaacaaacaccagcugaaaauaaagcagaaagcgaggaaauggaaaccagccaagcuggauccaaagacaagaaaauggaucaaccaccccaagcaaagaaagcaaaaguaaaaacuagcacagucgacuuaccaauagaaaaccaacuccuauggcagaucgacagggaaaugcuaaaucucuauauagaaaaugagggaaaaaugauaaugcaggacaaacuagaaaaagagaggaacgacgcuaaaaacgcaguagaagaauacguauacgaaaugagagauaaacuaucaggggaauaugaaaaauuuguaucugaagaugauagaaacaguuuuacauuaaaauuggaagauacugaaaacugguuauacgaagauggcgaagaccaaccaaaacaaguauacgucgacaaacuagcugaacuaaagaaucuaggucaaccaauaaaaauaagauuccaagaaucagaagaaagaccaaaauuauucgaagaacuaggaaaacaaauacaacaauauaugaaaauaaucucaucauuuaaaaauaaagaagaccaauacgaccaucuagaugcagcagauaugacaaaaguagaaaaaucuacuaacgaagcaauggaauggaugaauaauaaauuaaaccuccaaaauaaacaaucacugacgauggaucccguuguuaaaagcaaagaaauagaggcaaaaauaaaagaacuaacaagcacguguagucccauaauaucaaaaccaaaaccaaaaguagaacccccaaaagaagaacagaaaaaugccgaacaaaaugguccaguagauggacaaggagacaauccaggcccacaagcagcagaacaaggaacagauacagccgugccaucagauagugacaagaaauuaccagaaauggauauugauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2543 - RNA, 2737 nt, Artificial Sequence
  mRNA product Design1 comprising derived and/or modified sequence from Homo sapiens__NP_055093.2 __HsHSPA4L (opt13)
gggagaaagcuuaccaugagcguuguuggcauagaucucggauuccuaaacugcuauauagccguagcuagaagcgguggaauagaaacaauagcgaacgaauacucggaccgcugcacaccagcuuguaucagcuuaggaucccgcaccagagcaauaggcaaugcagcgaaaagccaaauagugacaaacguacgaaauacuauacauggauuuaaaaaacuacacggaaggaguuucgaugacccuauaguacaaacggaaagaauacgacucccauaugaacuacaaaagaugccgaauggaagugcaggaguaaaaguaagauaccucgaagaagaaagacccuuugcaauugaacaaguaacuggaauguuacuagcaaaauuaaaagaaacaucggaaaacgcauuaaaaaaaccgguugccgacugcguaauauccaucccaaguuuuuuuacggaugcagaaagaagaaguguaauggcggcagcacaaguagcaggauuaaauugccuaaggcucaugaacgaaacgacagcaguagcuuuagcauacggaauuuauaaacaagauuugccaccauuagaugagaaacccagaaauguaguauucauagacaugggacacucugccuaucaaguacucguuugugcauucaauaaaggcaaauuaaaaguuuuagccacaacauucgaucccuaccucggcggaaggaauuucgacgaagcauuaguagauuauuuuugcgaugaauucaaaacaaaauacaaaauaaaugugaaagaaaacuccagagcauuacucagacuauaccaagaaugugaaaaacuaaaaaaacuaaugagcgcaaaugcaagcgaccucccccuaaacauagaaugcuuuaugaaugacuuggacguaucuucaaaaaugaacagagcccaauucgagcaauuaugcgcgucauuacuagcccgaguagaaccuccacuuaaagcaguaauggaacaagcaaacuuacaacgagaagauauaucaucuauagagauuguaggaggagcaacaagaauccccgcaguaaaagaacagaucacuaaguuuuuuuuaaaagacauuucuacaacacucaaugccgaugaagccguugcacgaggaugugcauuacaaugcgccauauuauccccagcauuuaagguaagagaauucagcauuacagaccugguuccauauucaauaacauuaagauggaaaacaaguuuugaagacggaucaggugaaugcgaaguauucugcaaaaaccauccagcaccauucucuaaaguaauuacauuccauaaaaaagaaccauuugaacuagaagcuuuuuauacuaaccuacacgaaguaccauacccagaugcaaggaucgguucauuuacaauacaaaacguguucccgcaaagcgacggagacucuaguaaagugaaaguuaaaguaagagucaauauacauggaauauuuucagucgccucagccucagugauagaaaaacagaacuuagaaggagaccauagugacgcuccuauggaaacugaaacauccuucaaaaaugaaaauaaagacaauauggauaaaaugcaaguagaccaggaagaaggacaucagaaaugccaugccgaacauacuccugaggaagaaauagaucauacaggagcaaaaacaaaaucggcaguaucagauaaacaagacagauuaaaucaaacucuaaaaaaagggaaaguuaaaucaauagacuuaccaauacaaucgagcuuaugcagacaguuaggacaagaccuacuuaacucauauauugaaaaugaaggcaaaaugauuaugcaagacaaauuagaaaaggagaggaacgaugccaaaaacgcagucgaagaauacguauaugacuucagagauagacuaggaacuguauaugaaaaauuuauuaccccagaagacuuaucgaaacuaagcgccguucuagaagauacagaaaacuggcuguaugaggauggagaagaucaacccaaacaaguauacguugacaaacuacaagaauugaaaaaauacggacaaccaauccaaaugaaauacauggaacacgaagaaagaccaaaagcauuaaaugaucucggaaaaaaaauccaauuaguaaugaaaguaauagaagccuaucguaauaaagaugaaagauacgaucaucuagacccuacagaaauggaaaaaguagaaaaauguauaucagaugcaaugaguugguuaaauucaaaaaugaacgcacaaaauaaacuaaguuuaacgcaagacccuguaguaaaagucucugaaaucguagcaaaaagcaaagaacuggacaacuucugcaaccccauaauauacaaacccaaaccuaaagcagaggugccagaagacaaacccaaagcaaauucugaacauaacgguccaauggacggacaaagcggaacagaaacaaaaucagacucaacaaaagauaguucacaacauacaaagucaucuggcgaaauggaaguugacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2544 - RNA, 2182 nt, Artificial Sequence
  mRNA product Design1 comprising derived and/or modified sequence from Homo sapiens__NP_005338.1__HsHSPA5 (opt13)
gggagaaagcuuaccaugaaauuaucuuuaguagcggcaaugcuauuacuacuaagcgcagcaagggcagaggaagaagauaaaaaagaagacgucggaacaguagucgguauagaccuaggaaccacauauucaugcgucggaguuuuuaaaaacggaagaguugaaaucauagcaaacgaucaaggaaacagaaucacaccaucauacguagcguucacaccugaaggagaacgacucauaggagaugcagcaaaaaaucaauuaacaucuaacccugaaaacacagucuuugacgcaaaaagauugauaggaagaaccuggaacgacccuucaguucaacaagacauaaaauuucuaccauuuaaaguaguagaaaaaaaaacaaaaccauauauacaaguugauauuggaggcggucaaacaaaaacauucgcaccagaagaaauauccgcaaugguacuuacaaaaaugaaagaaacagcugaagcauaccuaggaaaaaaaguaacacaugccguaguaacaguaccagcauauuuuaaugacgcccaaagacaagcaacaaaggaugcaggaacaauagcuggucuaaacgucaugagaauaauaaacgaaccaacagcagcagcuaucgcauacggacuagauaaaagagaaggagaaaaaaauauacuaguauuugaucuaggaggaggaacauucgauguaagcuuauuaacaauagacaacggagucuuugaaguaguagcuacaaacggugacacacauuuaggaggagaagacuuugaucaaagaguuauggaacacuuuauaaaacuauauaaaaaaaaaaccgggaaagacguaaggaaagauaacagggccguacagaaacucagaagagaagucgaaaaagcaaaacgagcauuaucaucacaacaccaagcaagaauagaaauagaaaguuucuaugaaggagaagauuuuagcgaaacucuaacgcgagcaaaauuugaagagcugaacauggauuuauuuagaaguaccaugaaaccaguacaaaaaguacucgaagacagugauuuaaaaaaaagugacauagacgaaauaguccuaguaggagguucaacccgaauccccaaaauacaacaacucgucaaagaauuuuucaacggaaaagaaccgagccgaggaauaaacccugacgaagcaguagcauauggcgcagcaguucaagcaggcguauuaagcggagaucaagauacaggagauuuaguacuacuagacguauguccacuaacucuaggaauagaaacagucggaggaguaaugaccaaauuaauaccuagaaacacaguaguaccgacaaaaaaaucacaaauuuucuccacagcaagcgacaaucaaccaacaguaaccauaaaaguauacgaaggcgaaagaccauuaacaaaagauaaccauuuauuaggaacauuugauuuaacagguaucccaccugccccacgaggagucccacaaauagaaguuacauuugaaauagauguaaaugguauccucagagucacagcggaagauaaaggcacuggaaauaagaauaaaauuacuauaacaaacgaccaaaauagauuaacucccgaagaaauagaaagaaugguaaaugaugcggaaaaauucgccgaagaggacaaaaaacuaaaagagagaauagauaccagaaacgaguuagaaucauacgcauacucccuuaagaaucaaauuggagauaaagaaaaauuaggcggcaaauugagcucagaagacaaagaaaccauggaaaaagcaguagaagaaaaaauagaauggcuugaaagccaccaggaugcagauauagaagauuucaaagcaaaaaaaaaagagcuagaggaaaucguacaaccaauaauuucaaaacuauacggaagugcagggccaccaccaacaggagaagaagacaccgcagaaaaagaugaacuuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2545 - RNA, 2149 nt, Artificial Sequence
  mRNA product Design1 comprising derived and/or modified sequence from Homo sapiens__NP_002146.2__HsHSPA6 (opt13)
gggagaaagcuuaccaugcaagcaccacgugaacuugcagucgguauagaucuaggaacaacauauuccuguguaggaguauuucaacaagggagaguagaaauauuagcaaacgaucaaggcaauagaacaacaccaucauauguagcauuuacugacacagaaagauugguaggagaugcagccaaaagucaagcagcauuaaauccacauaacacaguguucgacgcgaaaagacuaauugguagaaaauuugcggauacaacaguccaaagugacaugaagcauuggccauuuaggguagugucugaagguggaaaaccaaaaguaagaguaugcuauagaggugaagauaaaacauuuuauccagaagaaauuucaucaaugguauuaagcaaaaugaaagagacagcagaagcauaccuuggacaaccaguaaaacaugcuguaauaacaguucccgcauacuucaaugauagccaaagacaagcaacaaaagaugcuggagcaauagcuggauuaaacgugcuaagaauuauaaaugaaccaaccgccgcggcaauugcauauggauuagauagaagaggagcaggagaaagaaacguauuaauauucgaucuaggaggaggaacauuugacguaucagucuuaucaauagacgcaggcguauucgaaguaaaagcaacagcuggugauacucacuuaggaggagaagauuucgauaacagauuaguuaaucacuucauggaagaauuucgacgaaaacauggcaaagaucuauccggcaauaaaagagcauuaagaagacuacgaacagcgugugaaagagcaaaaagaacauuauccucaucuacccaagcuacauuagaaauagauagccuauucgaagggguagauuuuuacacuuccauaacaagagcucgcuucgaggaacuaugcucagauuuauuuagaucuacuuuagaaccuguagaaaaagccuuacgugacgcaaaauuagauaaagcacaaauacaugacgucguauuaguagguggaaguacccgaauaccaaaaguacaaaaacuauuacaagauuucuuuaacggaaaagaacuaaacaaaucaauuaauccagaugaagcaguugcuuacggcgcagcaguacaggcagcaguauuaaugggagauaaaugugaaaaaguacaagauuuguuacuucuagacguggcaccccuaagccuaggauuagaaacagcaggaggaguaaugaccacauuaauacaaagaaaugcaacaauaccuacuaaacaaacacaaacauuuacaacauauagugacaaucaaccugggguauucauacaaguauaugaaggugaaagagcaaugacaaaagauaauaauuuacuagguagauuugaauuaucagggauuccaccagcaccacgaggaguaccgcaaauagaggugacuuuugacauagacgcaaauggcaucuuaagcguaacagcaacagauagaagcacaggaaaagcaaacaaaauaacaauaacaaaugacaaaggaagguuaagcaaagaggaggucgaaaggaugguacaugaagcagagcaauauaaggccgaagaugaagcccaaagagacagaguagcagcuaaaaauucacuagaagcacauguguuucacguaaaagggagcuuacaagaagagaguuuaagagauaaaauaccagaagaagauagacgaaaaaugcaagauaaaugcagagaaguauuagcauggcuagaacauaaucaacuggcagaaaaagaagaauaugaacaucaaaaacgagaauuagaacaaauaugcagaccaauauucucaaggcuauauggcggaccaggaguaccaggaggaaguucuuguggaacucaagcuagacaaggagacccuucuacaggaccaauaauugaagaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2546 - RNA, 1321 nt, Artificial Sequence
  mRNA product Design1 comprising derived and/or modified sequence from Homo sapiens__P48741__HsHSPA7 (opt13)
gggagaaagcuuaccaugcaagcacccagagaauuagccguaggaauagaccuaggaacuacauauagcugugucggaguauuucaacaaggaagaguugaaauauuagcaaaugaccaaggaaauagaacaacaccuucauauguagcauucacagacacagaaagguuaguaggagaugccgcgaaaagccaagcagcauuaaacccacacaauacaguauucgaugcaaaaagacucaucggaagaaaauuugcagauacaacaguacaaucagauaugaaacauuggccauuucaaguagucucagaaggcggaaaaccaaaaguaagaguauguuacagaggagaagauaaaacauuuuauccagaagaaauaucaaguaugguauuaucaaagaugaaagaaacagcagaagcauaucuaggccaaccaguaaaacaugcaguaauaacaguaccaacuuauuucucaaauucacaaagacaagcaacaaaagaugcuggagcaauugcaggucuaaaaguauuaccaaucauaaaugaagcuacagcugcagcaauagcauauggccuagauagaagaggagcaggaaaaagaaauguauuaauauuugauuuaggaggaggaaccuuugacguaucaguauuaucaauagaugcaggaguauuugaaguaaaagcaacagccggagauacacaucuaggaggagaagauuucgacaacagauuaguuaaucacuucauggaagaauuuagaagaaaacacggaaaagacuuaucagguaauaaaagagcacuuagaagauuaagaacagcaugugaaagagccaaaagaacaccaucaagcucaacacaagcgacauuagaaaucgauucacuauucgaaggaguagauuuuuauaaaucaauaacuagagcccgauuugaagaauuauguucagacuuauuucgaagcacacuagaaccaguagaaaaagcacuaagagaugcaaaacuagacaaagcacaaauacacgacuucguauuaggaggaggacuacacagucauccacaaggagcugaaguagcugcaggauuauuacaaagacaaggagcagaacaagaacaccaaccuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2547 - RNA, 2158 nt, Artificial Sequence
  mRNA product Design1 comprising derived and/or modified sequence from Homo sapiens__NP_006588.1 __HsHSPA8 (opt13)
gggagaaagcuuaccaugucaaaagguccugcuguaggaauugacuuaggaacgacauauucguguguuggugucuuccaacaugggaaaguagaaauuauagcaaacgaucaaggaaaccgaacaacaccaucauacguagcuuuuacagauacagaaagauuaaucggagacgcggcuaaaaaucaaguagcaaugaauccaacaaacacagucuuugacgcaaaacgacuaauaggaagaagauuugaugaugcaguaguucaaagcgauaugaaacacuggccauuuaugguaguaaaugacgcaggaaggccaaaaguacaaguagaauacaaaggagaaacaaagagcuucuauccggaagaaguaucaagcaugguauuaacaaaaaugaaagagauagcagaggcauacuuaggaaaaacaguaacaaacgcaguagucacaguuccagcauauuucaacgauagccaaagacaagcaacaaaagacgcagguacaauagcaggauuaaauguacuccggauaauaaacgaaccaacagcugcugcaaucgcguauggacuagauaagaaaguaggcgcagaaagaaauguauuaaucuucgacuuaggaggaggaacauucgauguaucuauucuaacaauagaagacggcauauucgaaguaaaaagcacagccggcgacacacacuuaggaggagaagauuucgauaaccgaaugguaaaccauuucauagccgaguucaaaaggaaacacaagaaagacauaagugaaaauaaaagagcaguacgccgauuaagaaccgcaugugaaagagcaaaaagaacucuaaguucaagcacacaagcgaguauagaaauagacaguuuauaugaagguauagauuuuuauacaucaauaacaagagcaagauucgaagaacuuaacgcagaccuauuuagaggaacacuagacccaguagaaaaagcacuaagagaugcaaaauuagacaaaagccaaauacaugauauaguauuggucggaggaucgacuagaaucccaaaaauacaaaaacuauuacaagacuucuuuaacggaaaagaacucaauaaaucgauuaauccagaugaagcagucgcauauggagcugcgguacaagccgcgauauuaagcggagacaaauccgaaaacguccaagaucuauuacucuuagacguaacaccucugucgcuaggaauugaaacagccggugggguaaugacaguacuaauaaaaagaaacaccacaauaccaacuaaacaaacacaaacauuuacuacauacucagauaaucaaccaggaguccuaauucaaguuuacgaaggggaacgugcaaugacaaaagacaauaauuuacucggaaaauuugaacuaacaggaauaccaccagcaccaagaggaguaccacaaauagaaguaacauuugauauagaugcaaauggaauacuaaacguaagugcgguagauaaaagcacagguaaagaaaacaaaauaacaauaacuaacgacaaaggcagauuaucaaaagaagauauagaaagaauggugcaagaagcagaaaaauauaaagcagaagacgaaaaacaaagagauaaaguaaguaguaaaaauucauuagaaucauacgcauuuaauaugaaagcaacgguagaagaugaaaaauugcaaggaaaaauaaacgaugaagauaagcagaaaauuuuagacaaauguaacgaaauuauaaauugguuagauaaaaaucaaacagcagagaaagaggaauuugaacaucaacaaaaagaauuggaaaaggucugcaauccuauaauaaccaaauuauaccaaucugcgggaggaaugccaggcggaaugccaggaggauucccagguggaggagcuccaccaagcggaggagcaagcaguggaccaacaauagaagaagucgauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2548 - RNA, 2257 nt, Artificial Sequence
  mRNA product Design1 comprising derived and/or modified sequence from Homo sapiens__NP_004125.3 __HsHSPA9 (opt13)
gggagaaagcuuaccaugaucagugcaagcagagcugccgcagcaagauuaguaggagcggcagcaagcagaggaccaaccgcugcuagacaucaagauaguuggaauggauuaucacacgaagcauuuagacucguaaguagacgagacuaugcaagcgaggcaauaaaaggcgcaguaguagggaucgauuuagggacgacaaacucaugcguagcagucauggaaggaaaacaagcaaaaguacuagaaaaugcagaaggagcgagaacaacaccaucaguaguagcguuuacugcagauggagaaaggcuaguaggcaugcccgcuaaaagacaagcaguaacaaauccaaauaauacauuuuaugcaacaaaaagauuaauaggaagaagauaugaugacccagagguacagaaagacaucaaaaauguaccuuuuaaaauaguaagagcaaguaacggagacgcauggguagaagcacaugguaaacuauauaguccgucgcaaauaggagcauuuguucuuaugaaaaugaaagaaacggcagaaaauuaucuagggcauacagccaagaacgcaguaauaacaguacccgcauauuucaacgauucacagcgucaagcaacgaaagaugcgggacaaauuagugggcugaauguauuaagaguaauaaacgaacccacagcugcagcccuagcguauggacucgauaaaucagaagacaaaguaaucgcaguauaugauuuaggugggggaaccuuugacauuucaauauuagaaauacaaaaaggcguauuugaaguaaaaaguacaaauggagauacauucuuaggaggagaagacuucgaucaagcucuauuacgacauauagugaaagaguucaaaagagaaacaggaguugacuuaacaaaagauaacauggcacuacaaagaguaagagaagcagcugaaaaagcgaaaugcgaacuaaguaguaguguacaaacagacauaaacuuaccauacuuaacaauggacucaucagggccaaaacaucuuaacaugaaacugacuagagcacaauucgaaggaauagucaccgaucuaauacguaggaccauugcaccaugccagaaagcaaugcaggacgcagaaguaucgaaaagcgauauaggagaaguaauauuaguugggggaaugacaagaaugccuaaaguacaacaaacaguacaagauuuauuuggaagggcaccaucaaaagcaguaaacccagacgaagcaguggcgauaggagccgcaauacaaggaggaguacuagcaggagacguaacugauguuuuauuacuagauguaaccccacuaaguuugggaauagaaacauuaggaggaguauuuacaaaacuaauaaauagaaauaccacaauaccuacaaagaaaucucaaguauuuucaacagcagcagacggccaaacacaaguggaaauaaaaguaugucaaggcgaaagagaaauggcaggagacaauaaacuguuaggacaauuuacuuuaauagguauaccaccagcaccaaggggaguaccucaaauugaaguaacauucgacauagacgcaaauggaauaguccauguaucagcgaaagauaagggcacagggagggaacaacaaauaguaauacaaaguagcggaggacugaguaaagacgauauagaaaauauggucaaaaaugcugaaaaauaugcugaagaggauaggaggaagaaagaaaggguagaagcgguaaauauggcagaaggaauaauacaugacacagaaacaaaaauggaagaauuuaaagaucaauuaccagcggaugaauguaauaaacucaaagaagaaauaaguaaaaugagagaguuacuugcaagaaaagauucagaaacgggagaaaauauacgacaagcagcaaguucacuacaacaagcuagucuaaaauuauucgaaauggccuauaagaaaauggcaucggaacgagaaggaucaggaucaucugguacaggggaacaaaaagaagaucaaaaagaagaaaaacaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2549 - RNA, 2245 nt, Artificial Sequence
  mRNA product Design1 comprising derived and/or modified sequence from Homo sapiens__NP_079291.2__HsHSPA12A (opt13)
gggagaaagcuuaccauggcugauaaagaagccggaggaucugauggcccuagagaaaccgcaccaacuucagcauauagcagccccgccagaucauuaggagauacaggcauaacucccuuaucaccaucccauauaguaaacgauacagauaguaaugucuccgaacaacaaucauuuuugguuguuguagcagucgauuucgguacaacaagcuccggauacgcauauuccuucacaaaagaaccggaauguauacauguuaugagaagaugggaaggcggcgacccaggaguuaguaaccaaaagacuccaacuacaauccucuuaacaccggaaaggaaauuccauucauucggauaugccgcacgcgauuuuuaccacgauuuagacccaaacgaagcgaaacaaugguuauaucuagaaaaauuuaaaaugaaacuacauaccacaggagaccuuacuauggauacagaccuaacagcugcaaauggaaagaaaguaaaagcauuagaaaucuuugcauacgcguuacaauacuuuaaagaacaagccuuaaaagaauuaagcgaccaagcuggaucagaauuugaaaauuccgacguacgaugggucauaacgguaccugcaauauggaaacaaccagcaaaacaauucaugagacaagccgccuaucaagcuggacuagcgucaccagaaaacagcgaacaacuaauaauagcacuagaaccagaagcagcaucaaucuauuguagaaaacuaagauuacaucaaaugauagaacuaucaucaaaagcugcaguaaauggauauucaggaagugacaccguaggugcaggauuuacucaagccaaagaacacauaagaagaaauagacaaucuagaaccuuucuagucgaaaauguaauuggcgaaauauggucugaauuagaagaaggagacaaauaugucguaguugacuccgguggaggaacaguggaucucaccguccaucaaauacgacuaccagaaggacaucuuaaagaacucuacaaagcuacaggaggaccauauggcucauuaggcguagauuaugaauuugaaaaacugcuauacaaaaucuucggagaagacuuuauagaacaauuuaaaaucaaaagaccagcagcauggguagauuuaaugauagcauucgaaucaagaaaaagagcugcagcaccagaucgaacuaauccguuaaauauaacguuaccauucucauucauugacuacuauaaaaaguuuagaggucauaguguugaacaugcacuaagaaaaucgaauguagauuuuguaaaauggucaagucaaggcauguuaagaaugucaccagaugccaugaaugcauuauuuaaaccaacuauagauucaauaauagaacauuuaagagacuuauuccaaaaaccagaaguaucuacaguuaaauucuuauuccuaguagggggauuugcagaagcuccacuucuacaacaagcagugcaagcagcauucggcgaccaaugucgaauaauaauaccucaagacguaggccucacaauacuaaaaggagcgguauuauuuggauuagauccugcagucauaaaaguaagaagaucaccucuaacauacgguguaggaguacuaaacagguacguagaaggaaaacacccaccugaaaaacuuuuagucaaagacggaacuagauggugcacagauguauuugauaaauucauaucagcagaucaaucaguagcauuaggagaacugguaaaacgaucauacacuccugcuaaacccagccaauuaguaaucguaauaaauauauauucaagugaacaugauaaugucucauuuauaacagauccaggaguaaagaaaugcggaacauugagauuggaccucacaggaacaucaggaacagcuguaccagcaagacgagaaauucaaacacuaaugcaauuuggagauaccgaaauaaaagcaacugcaauagauauagccaccagcaaaaguguaaaagugggaaucgauuucuuaaauuauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2550 - RNA, 2278 nt, Artificial Sequence
  mRNA product Design1 comprising derived and/or modified sequence from Homo sapiens__NP_443202.3 __HsHSPA12B (opt13)
gggagaaagcuuaccaugcuagcaguaccugaaaugggauuacaaggucuauauauagguagcucgccagaacgaucaccaguaccaaguccgccgggaucaccucgcacacaagaaagcuguggaauugcaccacuaaccccuucucaaucaccaaagccagaaguuagagcaccccaacaggcuucauuuucuguaguaguagcaauagacuuuggcaccacauccucaggcuaugccuucagcuuugcaucagacccagaagcgauacauaugaugaggaaaugggaaggaggagauccagggguagcacaucagaaaacaccuacuugcuuauuacuaacaccagaaggcgcauuucauaguuuuggauauacagcaagagacuauuaucaugaucuggauccugaagaagcgcgugauugguuauauuuugaaaaauuuaaaaugaaaauccauucagcaacagaucuaacuuuaaaaacacaauuagaagcugucaauggcaaaacaaugccagcauuagaaguauuugcccaugcacuaagauuuuuccgagaacaugcacuacaagaacuuagagaacaauccccaaguuuaccugagaaagauacaguaagauggguauuaacagugccggcaauauggaaacaaccugcuaaacaauucaugagggaagccgccuauuuagcaggauugguuucacgagaaaacgcagaacaacuauugauagcuuuagagccagaggcggcaaguguauauuguagaaaacuaagauuacaucaacuacuagauuuaucaggcagagcuccaggaggagguagauuaggagaaagacgauccauugauucuaguuuuagacaagcuagagaacaacuaagaagaagcagacauucaagaacauuccuuguagaaaguggaguaggagaauuaugggcagaaaugcaagcaggagauagauauguaguugcagacuguggaggaggaacuguagaccucacaguucaucaacuagaacaaccacaugguacccuaaaagaauuauauaaagcgaguggcggcccauacggagcaguaggcguagauuuagcauuugaacaauuacucugucgaauauuuggagaagauuucauagcuacuuuuaaaagacaaagaccagcugcauggguagaucuaacuauagcuuucgaagcaagaaaaagaacagccggaccucauagagcaggagcauuaaauauaucucuaccauuuaguuuuauagauuuuuacagaaaacaacggggacauaacguagaaacggcauuacgaagaucaagugucaacuucguaaaauggucaucacaagguauguuaagaauguccugugaagcaaugaaugaacuauuucaacccacuguaagcggaauaauacaacacauagaagcauuauuagcaagacccgaaguucaaggaguaaaauuacuauuucuaguaggaggguuugccgaaucggcaguucuacaacaugcaguacaagcugcguuaggcgcacgaggauuacgaguaguaguaccccacgauguugggcuuacaauucugaaaggagcuguauuauuuggacaggcaccaggaguagucagaguuagaagaagcccacuaacauaugggguaggaguacuuaacagauuuguaccaggcaggcauccuccagaaaaauuauuaguacgagacggaagacguugguguacagauguauucgaaagauucguugcagcugaacaaagcguugcauuaggagaagaaguaagacgaucauauugcccagcuagaccaggucaaagaagaguucuaauaaacuuauauuguugcgccgcagaagaugcaagguuuauuacugauccuggaguucgaaaauguggugcacuuagccuagaacuagaaccggccgauuguggacaagauacagccggagcaccaccagguagaagagaaauaagagcugcuaugcaauucggagacaccgaaauaaaagucacagcaguagaugucagcacaaauagaucagugcgagcuaguauagacuuucuaucaaauugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2551 - RNA, 1633 nt, Artificial Sequence
  mRNA product Design1 comprising derived and/or modified sequence from Homo sapiens__NP_008879.3__HsHSPA13 (opt13)
gggagaaagcuuaccauggcacgagaaaugaccauauuaggaagcgccguauuaacauuauuacuagcgggauauuuagcacaacaauaucuaccccuacccacaccaaaaguaaucggaauagacuuaggaacaacauauuguaguguaggaguuuucuucccaggaaccggaaaagucaaaguaauaccagacgaaaacggacacauaucaauuccaucaaugguaucauuuacugauaacgacguauauguaggauacgaaucaguagaauuagccgauagcaauccacaaaacacuauauaugacgcaaaaagauucauaggcaaaauauuuacagcagaagaacuugaagcugaaauaggaagauaucccuuuaaaguacuaaauaaaaacggaaugguagaauucucaguuacaucaaaugaaacaauaacagucaguccagaauacguagguagcagauuacuacuaaaacuaaaagaaauggcagaagcauacuuaggaaugccaguagcaaaugccguaauaucuguaccagcagaauucgauuuaaaacaacgaaauucaacaauagaagcagcuaaucuagcaggacuaaaaauauuaagaguuauaaacgaacccacagcagcagcaauggccuauggauuacacaaagcugacguauuucauguacuaguaauagaucuagguggagguacauuagacguaagcuuacuaaauaaacaaggaggcauguuucuuacacgagcaaugucaggcaacaacaaauuaggaggucaagacuuuaaccaaagacuacuacaauaucucuacaaacaaauuuaccaaacuuauggauuuguuccuucaagaaaagaagaaauacaucgauuacgacaagcaguagagaugguaaaacuaaauuuaacacuacaucagagugcacaacuuuccgucuuauuaacaguugaagaacaagaucgaaaagaaccacacaguucagacaccgaacuuccaaaagauaaauuaagcucagcagaugaccauagaguuaacagcggcuuuggaagaggauuaucagacaaaaaaagcggagaaagccaagugcuguuugaaaccgaaauaagcagaaaauuauucgauacacuuaacgaagaccuauuccaaaaaauauuaguaccaauccaacaaguacuaaaagaaggucaucuagaaaaaacagaaauagaugagguaguauuaguaggaggaucaacacguauacccagaauaagacaaguaauacaggaauuuuucggaaaagauccaaauacaucaguagacccagauuuagcgguuguuacaggagucgcaauacaagcaggaauagauggcggaagcuggccauuacaaguauccgcacuagagaucccaaacaaacaucuacaaaaaaccaauuucaauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2552 - RNA, 1747 nt, Artificial Sequence
  mRNA product Design1 comprising derived and/or modified sequence from Homo sapiens__NP_057383.2__HsHSPA14 (opt13)
gggagaaagcuuaccauggcagcaauaggaguacauuuaggauguacaagugcauguguagcaguauauaaagauggaagagcaggaguaguagccaaugaugcaggggauagaguaacaccagcgguaguagcuuauucagaaaaugaagaaauaguaggauuagcugcaaaacaaucaagaauaagaaauauuaguaacaccguaaugaaagugaaacaaauacuaggaagaucuucaucagauccccaagcacaaaaauauauagcagaaucaaaaugucuaguaauagaaaaaaauggcaaacuaagauaugaaauagauacaggcgaagaaacaaaauuuguaaacccugaagaugucgcuagacuaauauucucaaaaaugaaagaaacagcacauucaguacuaggaucagaugcaaaugacguaguaauaaccguaccauuugauuuuggagaaaaacaaaaaaaugcauuaggagaagcagcaagagcagcaggauuuaacguguuacgacuuauacaugaacccucagcagcauuauuagccuauggaauaggucaagacucaccaacaggcaaaucaaauauauuaguauuuaaauuaggaggaacuagucuaucacucucaguaauggaaguaaauucaggaauauacagaguuuuaucaacuaauacagaugauaauauuggaggagcacauuuuacagaaacauuagcucaauaccuugcaagugaauuucaaagaaguuuuaaacacgaugucagaggaaaugcaagagcaaugaugaaacuaacgaauucagcagaaguagcaaaacauucauuaucaacauuagggucugccaauuguuuccuagauagucuuuaugaagggcaagacuuugacuguaauguaagucgagcaagauuugaacuacuguguucaccccuguuuaacaagugcauagaagcaauaaggggauuacuagaucaaaauggcuucaccgcagaugacaucaauaaaguaguacuauguggaggaagcucaagaauaccaaaacuccaacaauuaauaaaagauuuauuucccgcuguagaacuacuaaauaguauacccccagaugaaguaauaccaauaggugccgcaauagaagcaggcauauuaauaggcaaagagaaucuacuaguggaagacagucuaaugauagaauguagugcaagagacauauuaguaaaagggguagaugaaaguggagcaagcagauuuacaguauuauuccccagcggaacaccucuaccagcaagaagacaacauacucuacaagcgccagguucaauaucaucaguuugccuagaacuauacgaaucagacgguaaaaacucagcaaaagaagaaacaaaauucgcucaaguaguacuacaagauuuggacaaaaaagagaauggacuaagagauauucuagccguauugacuaugaaaagagauggaucacuacacguaacauguacagaccaagaaacaggaaaaugugaagcaaucucuauagaaauagccucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2553 - RNA, 2794 nt, Artificial Sequence
  mRNA product Design1 comprising derived and/or modified sequence from Homo sapiens__NP_006635.2 __HsHSPH1 (opt13)
gggagaaagcuuaccaugaguguuguggggcuagacguagggagccaaaguugcuauauagcaguagccagagccggaggaauagaaacgauagcaaaugaauucucagauagaugcaccccaaguguaauaucauucggaucaaaaaacaggacgauaggaguggcagccaaaaaucaacagauaacgcacgcaaauaacacagucagcaacuuuaaaagauuucacggaagagcauuuaacgacccauuuauacaaaaagaaaaagagaaucuaaguuacgacuuagucccccuaaaaaauggaggagugggaauaaaaguaauguauaugggcgaagaacaccuuuuuucaguugaacaaauaacugcgaugcuauuaacaaaacuaaaagaaacagcagaaaacucauuaaaaaaaccaguaacagacugcguaauaucaguaccaucauucuuuacagacgcugaacgacgaaguguucuagacgcagcacagauaguagguuugaauugucuaagacugaugaacgacaugacagcaguagcguuaaacuacggaauauacaaacaggaccuaccaagcuuggacgagaaaccuagaauaguaguauucguagacauggggcacucugcauuccaaguuagugcaugcgcauucaauaaagguaaacucaaaguauuaggaacagcauuugacccauucuuaggaggcaaaaacuuugacgaaaaacuuguugaacauuucugcgcggaauucaaaacaaaauauaaauuggacgccaaaagcaaaauaagagcccuuuuacgacuauaccaagagugcgaaaaacuaaaaaaacuaaugaguaguaauucaacugaccuaccacucaauauugaguguuucaugaaugauaaagauguaaguggcaaaaugaacagaucucaauucgaagaauuaugcgccgaauugcuacagaaaauagagguaccacuauauagccuccuagaacaaacacaucuaaaaguagaagauguuagugcaguggaaauaguaggaggcgcuacaagaauaccugcaguuaaagaaagaaucgcuaaauucuucggaaaagauauauccacaacacuuaaugcagacgaagcaguagcucgcggcugcgcucuccaaugugccauucuaaguccagccuucaaagucagagaauucucuguaacugacgcaguuccguucccuauaucacuuauauggaaccacgacagugaagauacugaaggagugcaugaaguauucagcaggaaccaugccgcuccuuucagcaaaguauuaacuuucuuacgaaggggaccauucgaauuagaagcauuuuacucagauccacaaggaguaccauacccugaagcaaaaauaggccgauucguaguacaaaacgucagcgcacaaaaagauggagaaaaaucaagagucaaaguaaagguacguguaaauacccacgguauuuucacaauaucaacagcauccaugguagaaaaaguaccuacagaagaaaaugaaaugucaagcgaagcagauauggaaugcuuaaaucaaagaccaccagaaaacccagauacagacaaaaacguacaacaagauaacucagaagcaggaacacaaccacaaguacaaaccgaugcucaacaaaccucacaaucaccuccaagcccagaacuuacuucugaagaaaacaaaaucccagacgcagauaaagccaacgaaaaaaaagucgaccaaccaccagaagcuaaaaaaccaaaaauaaaaguaguaaacguagaacugcccauagaagcaaaccuaguauggcaacuaggaaaagauuuauuaaacauguacauagaaacugaaggcaaaaugaucaugcaagauaaacuagaaaaagaacgcaaugacgcaaaaaacgcaguagaagaauauguauaugaauuuagagacaaauuauguggaccauaugaaaaauucauaugcgaacaagaucaccaaaauuuccuacgacuacucacugaaacagaagacugguuauaugaagaaggagaagaccaagcaaaacaagcuuacguagacaaacuggaagaacuaaugaaaauagguacgccuguaaaaguacguuuccaagaagcagaagaaagaccgaaaauguuugaagaauuaggacagagacuccaacacuaugcaaaaauagcugcagacuuccgaaacaaagaugaaaaauauaaccacauagaugaaagcgaaaugaaaaaaguugaaaaaucagucaacgaaguaauggaauggaugaacaacguaaugaaugcacaagcaaaaaaaagucuagaccaagacccaguagucagggcgcaagagauaaaaacgaaaaucaaagaauuaaauaacacuugcgaacccgucguaacgcaaccaaaaccuaaaauagaaucaccaaaacuagagcgcacgccuaaugguccaaacauagacaaaaaagaagaggaccuagaagauaaaaauaacuuuggugcagaacccccccaucaaaacggagaaugcuauccaaacgaaaaaaauaguguaaauauggaucuagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2554 - RNA, 3217 nt, Artificial Sequence
  mRNA product Design1 comprising derived and/or modified sequence from Homo sapiens__NP_006380.1 __HsHYOU1 (opt13)
gggagaaagcuuaccauggcugauaaaguaagaagacaaagacccagaaggagaguuuguugggcucuaguagcaguauuacuggcagauuuauuagccuuaucagauacccuugcaguaauguccguagaccuaggaagugaaaguaugaaaguagcaauaguuaaacccggaguaccaauggaaauaguccuuaacaaagaaucuagaaggaaaacuccaguuauaguaacacuaaaagaaaaugaacgauucuucggcgacagugcagcaucaauggccaucaaaaauccaaaagcaacauuaagauacuuucaacaucuucuuggcaaacaagcugauaauccucaugucgcauuauaucaagcaagauuccccgaacacgaacuaacuuuugacccacaacgucaaacuguacacuuucaaauaaguucacaacuacaauuuaguccagaagaaguacucggaaugguccugaauuauucaagaucauuagcagaagauuucgcagaacaaccuauaaaagacgcaguaauaaccguuccuguguucuuuaaccaagccgaaaggcgagcaguauuacaagcagcucgaauggcaggauuaaaagucuuacaauugauaaaugauaauacagcaacagcacuuaguuacgggguauuuagacgaaaagauaucaauacgacagcucaaaauauaauguuuuaugacaugggaaguggcucaacagucugcacaauaguaacauaucaaauggucaaaacaaaagaagccgggaugcaaccacaacugcaaauacgagguguaggauucgauagaaccuuagggggacuagaaauggaauuaagauuacgagaaagauuagcaggauuauuuaacgaacaaaggaaaggccaacgugcaaaggauguaagagaaaauccaagagcgauggcaaaacuccugagagaggcuaauaggcuaaaaacggugcuaagcgcaaaugcggaccauauggcacaaauagaaggguuaauggaugacguagacuuuaaagccaaaguaacacgcguagaguucgaagaauuaugugcugaucuauuugaaagaguaccggguccaguucaacaagcguuacaaucggcagaaaugucacuugaugaaauagaacaaguaauuuuaguagggggcgcuaccaggguuccuaggguacaagaaguccuauugaaagccguggggaaagaagaauuagguaagaauauaaacgcagaugaagcugcugcaaugggugcaguguaucaagcagcagcacuaagcaaggcauuuaaggugaaaccguucguuguaagggaugcuguagucuauccaauauuaguagaauuuacucgcgaaguagaagaagaaccaggaauacauuccuuaaaacauaauaaaagagucuuauucagcaggaugggacccuauccucagagaaaaguaauaaccuucaaccgauacagucaugacuucaauuuccacauaaacuauggagauuuaggauuucuugguccggaagacuuaagaguauuuggaagucaaaaucuaacaaccguaaaauuaaaaggcgugggagacucauuuaagaaguaucccgauuacgaaucaaaaggaauuaaggcacauuuuaacuuagacgagagcggagucuuaagccuggacagaguggaaucaguauucgaaacguugguugaagauucagcugaagaagaaaguacacuaacgaaauugggaaacaccauaaguucucuauucggaggaggcacaacuccagaugcaaaagaaaaugguacagauacuguccaagaagaagaagaaucaccagcagaaggauccaaggacgaaccaggagagcaaguugaacuuaaagaagaagcagaagcacccguugaagauggaucacaaccuccaccacccgaaccgaaaggagacgccacgccggaaggagaaaaagcaacugaaaaagaaaauggagauaaaucagaagcacaaaaaccaucugaaaaagccgaggcaggaccagaagguguagcucccgcuccggaaggugaaaagaaacaaaaaccagcacgaaaaagacgcauggucgaagaaauaggaguagaauuaguaguuuuagacuuaccugaucucccagaagacaaacucgcacaaucaguacaaaaacuacaagaucuaacauugagagaucuggagaaacaagaaagagaaaaagcagcuaauagucuagaggcuuucauuuucgaaacccaagacaaauuauaccaaccugaauaccaggaaguuuccacagaagaacaaagggaagaaaucagugguaaauugagcgcagcuaguacaugguuagaagaugaaggaguuggagcaacgacaguaauguuaaaagaaaaauuagcagaauuaaggaaauuaugucaaggacucuucuuuagagucgaagaaagaaagaaauggcccgagagauugucagcauuagacaauuuauuaaaccauuccagcauguucuuaaaaggugccagacuuauaccagaaauggaucagauauuuacagaaguggaaaugacuacacuagaaaaaguaauuaacgaaaccugggcauggaaaaaugcaacacuagcagaacaagccaaauuaccggcgacggagaaaccaguacuauuaucgaaagauauagaagcaaaaaugauggcucuagaccgagaaguccaauaccuuuuaaacaaagccaaauuuacaaaaccaaggccaagaccuaaagacaaaaauggaacaagagcggaaccaccacuaaacgcgagcgcaagugaccaaggugaaaaaguaauuccaccagcuggacaaacagaagacgcugaacccauaagugaaccagaaaaaguagaaacaggaucagaacccggagauacugaaccacuagaguugggaggaccaggggcugagcccgaacaaaaagaacaaucaacaggccagaaaagaccgcucaaaaacgaugaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2555 - RNA, 2416 nt, Artificial Sequence
  mRNA product Design1 comprising derived and/or modified sequence from Homo sapiens__NP_005339.3 __HsHSP90AA1 (opt13)
gggagaaagcuuaccaugccagaagaaacgcaaacacaggaccaaccaauggaagaagaagaaguugaaacauuugccuuccaagcugaaaucgcucaacuaaugucccucauaauaaacacauuuuacaguaauaaggaaauauuccuacgagaauuaauaucaaauaguagugacgcauuagauaaaauacguuacgaaagccuaacagauccgaguaaacuagacucaggaaaagaacuacacauaaacuuaauaccaaacaaacaagaccgaacacucacaauaguagacacagguauaggcaugacgaaagccgauuuaauaaacaaccucggaaccauugcaaaaagcggaaccaaggcauucauggaagcucuacaagcaggagcggacaucagcaugauaggccaguucggaguggguuucuauucagcauaccucguagcagaaaaaguaaccgucauaacgaagcacaacgacgaugaacaauaugcaugggaaucauccgccggaggaaguuucacaguccgaacugacacaggugaacccaugggaagagguacuaaaguaauccuucaucugaaagaagaucaaaccgaauaccucgaagaacgacgaauaaaagaaauuguaaaaaagcauucacaauucaucggauacccuauaacacucuucguagaaaaagaaagggauaaagaaguaagcgaugaugaagcagaagaaaaggaagacaaagaagaagaaaaagaaaaagaagaaaaagaaucagaagauaaaccagaaauagaagacguaggauccgacgaagaagaagaaaaaaaagacggugacaaaaaaaaaaaaaaaaagauaaaagaaaaauacauagaccaagaagaauuaaauaaaaccaaaccgauauggacgagaaaucccgacgacauaaccaacgaagaauacggagaauucuauaaaagccugaccaacgacugggaagaccaucuggcagucaaacacuucaguguagaaggacaauuagaauucagagcacuacuauuuguaccgagacgagcaccauucgacuuauucgaaaauagaaaaaaaaaaaacaacauaaaauuguacguaagaagggucuucauaauggacaauugugaagaacuaauacccgaauaucuaaacuucauuagaggcguuguagacucagaagaccuuccacucaauauaucaagagaaauguuacaacaaaguaaaauacugaagguaauaaggaaaaauuuaguaaaaaaaugcuuggaacuauucacagaacuagcagaagacaaagaaaacuacaaaaaauuuuaugaacaauucucaaaaaacauaaaguuaggaauucacgaagauagccaaaauagaaagaaacuaucugaauuguuacgauauuauacauccgcaucaggugacgaaauggugucguuaaaagauuacugcacacgaaugaaagaaaaccaaaaacauauauauuacauaacaggagaaacaaaagaucaaguagcaaacagcgcauucgucgaacgacugagaaagcacggauuagaaguaauauacaugauagaaccaauagaugaauauuguguacaacaauuaaaagaauucgaaggaaaaacucucguaucaguaacaaaggaaggacuugaacuaccagaagaugaagaagaaaaaaaaaaacaagaagaaaaaaagacaaaauuugaaaaccucugcaaaauaaugaaagacauacuggaaaaaaaaguagaaaaaguaguagucucaaacagacuagugaccucaccuuguuguauagucacaagcacauauggauggaccgcaaacauggaaagaauaaugaaagcacaagcauuaagagauaacucaacaauggguuacauggcagcuaaaaaacaucucgaaauaaauccagaucauucuauaauagaaacucuuagacaaaaagcagaagcagauaaaaacgacaagaguguaaaagacuuagucauacuauuauacgaaacggcacuacucagcaguggauuuaguuuagaagauccacaaacacacgcgaacaggaucuacagaaugauuaaacuaggauuaggaaucgaugaagaugacccaacagcagacgacacaucagcagcaguaacagaagaaaugccaccacuagaaggggacgaugacacuagccgaauggaagaaguagacuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2556 - RNA, 556 nt, Artificial Sequence
  mRNA product Design1 comprising derived and/or modified sequence from Homo sapiens__NG_005218__HsHSP90AA3P (opt13)
gggagaaagcuuaccauggacagcucaaaacuagacucaggaaaaggacuacacauaaaccuaguaccaaacaaacaaaaccaaacacuaacaauaguagacacaagaauaggaaugacaaaaacagaccuaauaaacaaccuaggaacaguaacaaaaagcggaacaaaagcauucauggaagcacuacaagcagacgcagacauaagcaugauaggacacuucggaguaggauucuacucagcauaccuaguagcaaaaaaaguaacaguaauaucaaaacacaacaacgacgaacaauacacaugggaaucaagcgcaggaggaagcuucacaguaagaacagacgaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2557 - RNA, 2392 nt, Artificial Sequence
  mRNA product Design1 comprising derived and/or modified sequence from Homo sapiens__NP_031381.2__HsHSP90AB1 (opt13)
gggagaaagcuuaccaugccagaagaaguacaucauggagaagaagaagucgaaacguuugcuuuccaagcggaaauagcgcaacuaaugagccuaauaauaaacacauucuauaguaacaaagaaaucuucuugagggaauuaauuucaaacgccuccgaugcauuagacaaaauaagauacgaaagcuuaacagacccaucaaaauuagauagcggaaaagagcuaaaaaucgacauaauaccuaacccacaagaacguacacugacacuuguagauacaggaauaggaaugacaaaagcagaccuaauaaacaaccuaggaacuauagcuaaaucaggcacgaaagccuucauggaagccuuacaagcaggagcagauauaucaaugauaggacaauuuggagugggauucuacagcgcauaccuaguagcagaaaaaguagucguaauaaccaaacauaaugacgacgaacaauacgcaugggaaagcucggcaggaggcagcuuuacaguaagagcagaucauggcgaaccuauaggaaggggcaccaaagucauccuacaucucaaagaagaucaaacagaauauuuagaagaaagacgagugaaagagguagucaaaaagcauucccaauuuauaggcuauccaauaaccuuauaccuagaaaaagaaagagaaaaagaaauaucagacgacgaagccgaagaagaaaaaggagaaaaagaagaagaagauaaagacgaugaagaaaaaccaaaaauagaagauguaggaagcgaugaagaagacgacucaggaaaagacaaaaaaaaaaagacaaaaaaaauaaaagaaaaauauaucgaucaagaagaacucaacaaaacaaaacccauauggacaagaaauccagacgacauaacacaggaagaauacggagaauucuauaaaagccuuacgaaugacugggaagaucaucuagcaguaaaacacuucucuguagaaggacaacuagaauuccgagcccuacuauucauaccaagacgcgcaccauucgaccuauucgaaaauaaaaaaaaaaaaaacaauauaaaauuauauguacggagaguguucauaauggacaguugcgaugaacuaauaccagaauacuuaaacuuuauaagaggagugguagacucagaagaccuaccccuaaauauaagccgggagauguuacaacaaagcaaaauauuaaaaguaaucaggaagaacauuguaaaaaaaugucuggaacuauuuucagaguuagcagaagauaaagaaaacuacaaaaaauucuacgaagcauucucaaaaaauuuaaaauuagggauacaugaagacagcacaaacagaagaagacugagcgaacuacuaagauaucauacaagucaaaguggagacgaaaugacuucacuaagugaauacguaucaagaaugaaagaaacacaaaaaucuauuuacuacauaacuggagaaucaaaagaacagguagcaaacagcgcauuugucgaacgaguaagaaaacgaggauucgaaguaguuuauaugacagaaccuaucgaugaauauugcguccaacaacuaaaagaauuugacggaaaaucacuugucaguguaacaaaagaaggacuagaacugcccgaagacgaagaagaaaaaaaaaaaauggaagaaucaaaggcuaaauucgaaaaucuaugcaaauuaaugaaagaaauacucgacaaaaaaguagaaaaaguaaccauaagcaaucgacuaguaucaaguccuugcuguauagucacaucaacauauggauggacagcgaauauggaaaggauaaugaaagcccaagcacuuagagacaauaguacaaugggauacaugauggccaaaaagcaucuagaaauaaauccugaccacccaaucguagaaacacuaagacaaaaagcagaagcagauaaaaacgacaaagcaguuaaagacuuaguugucuuauuauucgaaacagcacuacucucaaguggauucucacuagaagacccccaaacacauaguaacagaauauaccgaaugauuaaauugggauuaggaaucgacgaagacgaaguggcagccgaagaaccaaaugccgcaguacccgaugaaauaccaccccuagaaggagacgaagacgcaaguagaauggaagaaguagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2558 - RNA, 2629 nt, Artificial Sequence
  mRNA product Design1 comprising derived and/or modified sequence from Homo sapiens__NP_003290.1__HsHSP90B1 (opt13)
gggagaaagcuuaccaugagggcauuauggguucuaggacuauguugcguacuacuaacguucggaucaguaagagcagacgaugaaguagaugucgauggcacaguagaggaagaccuaggaaaaucaagagaaggaagccguacagacgacgaaguagugcaaagagaagaggaagcaauccaguuggauggacuaaaugcaagucaaauaagagaacuaagagaaaaaucagaaaaauucgcauuucaagcagaagugaacagaaugaugaaacuaauaaucaauucauuauauaaaaacaaagaaauauuccugagagaacuaauaagcaacgcaagugaugcuuuagauaaaauacgacuaauuagcuuaacagacgaaaaugcauuaagcggaaaugaagaguuaacaguaaaaauaaaaugugacaaagaaaaaaacuuacuccaugugacagacacaggaguaggaaugacccgcgaggaauugguaaaaaaucuaggaacgauagcuaaaagcggaacaagugaauuucuuaauaaaaugacagaagcacaagaagacggccaaucaacaagugaacuaauaggacaauucggaguugguuuuuauagugcuuuuuuaguugcugacaaaguaauagucacgucgaaacauaauaacgacacacaacacaucugggaaagugacucgaaugaauuuucaguuauagcagauccaagaggaaauacgcuaggcagagggacaacaauaacauuaguacuuaaagaagaagcaucagauuauuuagaauuagauacaauaaaaaaccuaguaaaaaaauauagucaauucauaaauuuccccauauauguauggaguaguaaaacagaaacgguagaagaaccaauggaagaagaagaagcagcuaaagaagaaaaagaggaaagugacgaugaagcagcaguugaagaagaagaagaagaaaaaaagccgaaaacuaaaaaagucgaaaaaacgguaugggacugggaacuuaugaacgauauaaagcccauauggcagagaccgagcaaagaaguagaagaagaugaauauaaagcauuuuacaaaucauuuaguaaagaaucagacgauccaauggcuuacauacauuuuacagccgagggagaaguaacauucaaaucaauuuuguuuguaccaacaagugcucccagagggcuauucgaugaauacggaucaaaaaaaagcgacuauauaaaacucuauguaagaagaguauucaucaccgacgacuuccacgauaugaugccuaaauaccuaaauuucguaaaaggagucguagauagugaugacuuaccauuaaauguaagcagagaaacucuccaacaacauaaauuacuaaaagugauacguaaaaaauuaguaagaaaaacacucgacaugauaaaaaaaauagcggaugauaaauauaaugauacauucuggaaagaauucggaacaaauauaaaacuuggcguaauagaagaucacucuaauagaacaagacuagcaaaacucuuaagguuccaaagcucacaucacccaaccgauauaacuucauuagaucaauauguagaaaggaugaaagaaaaacaagauaaaauauauuuuauggcaggaucaucaagaaaagaagcugaaaguagcccauucgucgaaagacuucuuaaaaaaggguaugaaguuauauauuugacagaaccaguagaugaauauuguauacaggcacuaccagaauucgaugguaaaagauuccaaaacguagcaaaagaaggcguaaaauucgacgaaagugagaaaacuaaggaaucacgagaagcgguagaaaaagaauucgagcccuuacucaauuggaugaaagacaaagcacuaaaagauaaaaucgaaaaagcuguggucagucaaagauuaacagaaucaccaugcgcauuaguugcaagucaauauggguggucaggaaauauggaaagaauaaugaaagcgcaagcauaucaaacuggaaaggauauaucgacuaacuacuacgcaucgcaaaagaaaacauucgaaauaaauccuagacacccauuaauaagagacaugcuacgaagaaucaaagaagaugaagacgacaagacaguacuagaucuagcaguaguauuauuugaaacagcaacauuaagaucggguuaccuucuuccggauacaaaagcauacggcgacagaauagaaagaaugcucagacuaucacucaacaucgacccagaugcaaaaguggaagaggaaccagaagaagaaccagaagaaacagcagaagauacgacagaagacacugaacaagaugaggacgaagaaauggacgugggaacugacgaagaagaagaaacugcaaaagaaagcacugcugagaaagaugaacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2559 - RNA, 2332 nt, Artificial Sequence
  mRNA product Design1 comprising derived and/or modified sequence from Homo sapiens__NP_057376.2__HsTRAP1 (opt13)
gggagaaagcuuaccauggcaagagaacuaagagcucuauuacucuggggaagaagacuacgaccauuauuaagagccccugcauuagcagcugucccaggcgguaaaccuauccuauguccaagaaggacgacagcgcaauuaggaccuagaagaaauccagcuuggagcuuacaagcagguagauuauuuaguacacaaacagcagaagauaaagaagaaccucuacauagcauaaucaguaguacagaaucuguacaaggaaguacaaguaaacacgaauuucaagccgaaacaaagaaacuccuugacaucguagcuagaagucuauauucagaaaaagaaguauucaucagggaauuaauuucaaaugcaucagaugccuuagaaaaacuaagacacaaacugguauccgauggacaagcccuaccagaaauggagauacauuuacaaacaaacgcagaaaaagguaccaucacaauccaggauacagguauaggcaugacucaagaagaacuuguuucuaaccuaggaacuauagcaagaucuggcaguaaagcauuccuagaugcuuuacaaaaccaagcagaagcaucuucaaaaauaauaggacaauuugguguaggauucuauagugcauuuaugguggcugaucguguagaaguuuauucacggucagcagcuccaggaucauuaggauaccaauggcuaucugaugguucaggagucuucgagauugcagaagcauccggaguaagaacaggcacaaaaaucauaauacaccuaaaaucugauugcaaagaauuuucuagcgaagcaagaguaagagauguagucacaaaauacuccaacuucgucucauucccacuauacuuaaauggcagacgaaugaauacucuacaagcuauauggaugauggauccaaaagauguccgggaauggcaacaugaagaguucuauagauacguugcucaagcucacgacaaaccacgauauacacuucauuacaaaaccgaugcaccacuuaauauaagaucaauauuuuauguaccagacaugaaaccaucuauguucgauguauccagagaauuaggaucaucuguagcauuauacucaagaaaaguguuaauacaaacuaaagcaacagauaucuuaccaaaauggcuucgauucauaagaggaguuguagauucagaagacaucccacuaaacuuaucgagagaauuacuacaagaaucagcacuuauuagaaaacuaagagauguccuacaacaaagauuaauaaaauucuuuauagaucaaucaaagaaagaugcagaaaaauacgcaaaauucuucgaagacuauggacuauuuaugagggaaggcauaguaacugcaacagaacaagaaguuaaagaagacauugcaaaacuacuaagauaugaaaguuccgcguuaccuucaggccaacucacgagucuaagcgaauaugcaagccgcaugcgugcaggaacuagaaacauauacuaccuaugugcgccuaacaggcaucucgcagaacauuccccuuacuacgaagcaaugaaaaagaaagauacagaaguacucuucugcuucgaacaauuugaugaacucacauuauuacaucuacgcgaguucgacaaaaagaaauuaauauccguagaaacagacaucgucguagaccacuauaaagaagaaaaauuugaagacagaucccccgcagcagaauguuuaagugaaaaagaaacagaagaauuaauggcauggaugagaaacguacuuggcucaagaguuacuaacguuaaaguaacucuacgacuagacacacauccugccaugguaacggucuuagaaaugggagcagcaagacacuuccuuagaaugcaacaauuagcaaaaacccaagaagaaagagcacaauuacuacaaccaacauuagaaaucaauccuaggcaugcauuaauaaagaaacuaaaccagcuuagagcaagcgaacccggucuugcacaacuauuaguagaucaaaucuaugaaaacgccaugauagcagcaggucuaguugacgaccccagagcaaugguagguagacuuaacgaacuacucgucaaagcauuagaaaggcauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2560 - RNA, 679 nt, Artificial Sequence
  mRNA product Design1 comprising derived and/or modified sequence from Homo sapiens__NP_000609.1__HsIGF1 (opt13)
gggagaaagcuuaccaugggaaaaauaucaucacuaccuacacaacuauucaaaugcugcuucugcgacuuccuaaaaguaaaaaugcacacaaugucauccucacaccuauucuaccuagcacuaugccuacuaacauucacaucaucagcaacagccggaccagaaacacuaugcggagcagaacuaguagacgcauuacaauucguaugcggagacagaggauucuacuucaacaaaccaacaggauacggaucaucaucaagaagagcaccacaaacaggaauaguagacgaaugcuguuucagaucaugcgacuuaagaagacuagaaauguacugcgcaccauuaaaaccagcaaaaagcgcaagaucaguaagagcacaaagacauacagacaugccaaaaacacaaaaagaaguacaccuaaaaaacgcaucaagaggaucagcaggaaacaaaaacuacagaauguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2561 - RNA, 760 nt, Artificial Sequence
  mRNA product Design1 comprising derived and/or modified sequence from Homo sapiens__NP_000603.1__HsIGF2 (opt13)
gggagaaagcuuaccaugggaauaccaaugggaaaaucaaugcuaguacuauuaacauuucuagccuucgcaucauguugcauagcagcauacagaccaagugaaacucuauguggaggagaauuaguagauacacuacaauuuguauguggagauagagguuucuauuucaguagaccagcaagcagaguaucaagaagaaguagaggaauaguagaagaaugcuguuucagaucaugugaccuagcacuacuagaaacauauugcgcaacaccagcaaaaucagaaagagauguaucaacaccaccaacaguauuaccagauaacuuuccaagauacccuguaggaaaauuuuuccaauacgauacauggaaacaaucaacacaaagacuaagaagaggacuaccagcacuacuaagagcaagaagaggacacguacuagcaaaagaacuagaagcauuuagagaagcaaaaagacauagaccauuaauagcauuaccaacacaagauccagcacacggaggagcaccaccagaaauggcaucaaacagaaaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2562 - RNA, 856 nt, Artificial Sequence
  mRNA product Design1 comprising derived and/or modified sequence from Homo sapiens__NP_000591.1__HsIL6 (opt13)
gggagaaagcuuaccaugaacucauuuucaacaucagcauucggaccaguagcauucucacuaggauuacuacuaguacuaccagcagcauucccagccccaguaccacccggagaagacuccaaagacguagccgccccacacagacaaccacuaacaucauccgaaagaauagauaaacaaauaagauacauacuagacggaaucucagcacuaagaaaagaaacaugcaacaaaucaaacaugugcgaaucaucaaaagaagcacuagcagaaaacaauuuaaaccuaccaaaaauggcagaaaaagacggcugcuuccaaucaggauucaaugaagaaaccugccuaguaaaaauaauaacaggauuacucgaauucgaaguauacuuagaauaccuacaaaacagauucgaaucaucagaagaacaagcaagagcaguacaaaugagcacaaaaguacucauacaauuccuacaaaaaaaagcaaaaaaucuagacgcaauaacaacaccagacccaacaacaaacgcaucacuacuaacaaaacuacaagcacaaaaccaauggcuacaagacaugacaacucaccuaauacucagauccuucaaagaauuucuacaauccucacuaagagcacuaagacaaauguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2563 - RNA, 1498 nt, Artificial Sequence
  mRNA product Design1 comprising derived and/or modified sequence from Homo sapiens__NP_002183.1__HsINHBA (opt13)
gggagaaagcuuaccaugccauuacuaugguuaagagguuuucuauuagcaucaugcuggauaauaguaagaucaaguccaacaccaggaagugaaggucauagugcagcaccugacuguccuaguugcgcauuagcagcauuaccaaaagacguaccaaacagccagccagaaaugguagaagcaguaaaaaaacauauauuaaauaugcuacaucuaaaaaaaaggccagacguaacacaaccaguaccaaaagcggcuuuauuaaaugcaauaagaaaauuacauguagguaaaguaggagaaaacgguuacguagaaauagaggaugacauaggccgaagagcagaaaugaaugaacuaauggaacaaacaagugaaauaauaacauuugcagaaucaggaacagcaagaaaaacgcuacacuucgaaauaagcaaagaaggaagcgaucuuagugugguagaaagagcagaaguaugguuauuccugaagguacccaaagccaaucgaacgagaacaaaaguaacaauaagauuauuucaacaacaaaaacauccacaagguucacuagauacaggagaggaagccgaagaaguagguuuaaaaggagaaagaucugaauuauuauuguccgaaaaaguaguagaugccagaaaaaguaccuggcauguauuuccagugaguucaucaauacaaagauuacuagaucaagguaaaucaucacuagauguaagaauagcaugugaacaaugucaagaaaguggagcuaguuuaguacuauuaggaaagaaaaaaaaaaaggaggaagaaggagaaggaaaaaaaaaaggaggaggagaaggaggagcgggagcagaugaagaaaaagaacaaagucauagaccauucuuaauguuacaagcaagacaaagcgaagaucauccacacagaagaagacgacgaggacuagaaugcgauggaaaagucaauauauguuguaaaaaacaauuuuuuguaucauuuaaagacauaggauggaacgauuggauaauagcgccaucaggauaucacgcuaacuauugugaaggagaauguccaagccauauagcaggaacgaguggaagcucauuaucauuucacagcacgguaauaaaccauuauagaaugagaggacauagcccauuugcaaauuuaaaaucauguuguguaccuacaaaacuacguccaaugagcaugcuauauuacgacgacggacaaaauauuauaaagaaagauauccaaaauaugauaguagaagagugcggauguagcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2564 - RNA, 1441 nt, Artificial Sequence
  mRNA product Design1 comprising derived and/or modified sequence from Homo sapiens__NP_002184.2__HsINHBB (opt13)
gggagaaagcuuaccauggauggauuaccagggagagcauuaggagcagcaugucuauuauuauuagcagcagguugguuaggcccagaagcauggggaucuccaacaccaccaccaacaccagcagcacccccaccaccaccaccaccaggaaguccaggaggaagccaagauacauguacaagcugugguggauuuagaagaccagaagaauuaggaagaguagauggagacuuuuuagaagccguaaaaagacacauacuuucaagauuacaaaugagaggaaggccaaauauaacacaugcaguaccaaaggcagcaaugguuacagcauuaagaaaauuacacgcaggaaaaguaagagaagaugguagaguagaaauaccacauuuagacgggcacgcaucaccaggugcagaugggcaagaaagaguaagugagauaauuagcuuugcagaaacagauggauuagcaucaucaagaguacgauuauauuucuuuauaaguaacgaaggaaaucaaaaucuauucguagugcaagcaucacuaugguuauauuuaaaauuauugccauauguacuagaaaaaggaagcagaagaaagguaagaguuaaaguuuauuuucaagaacaaggucauggagaucgauggaauaugguagaaaaacgaguagauuuaaaaagaucaggauggcauacauuuccacuaacagaagcaauacaagcauuauucgaaagaggcgaaagaagacugaauuuagacgugcaaugugacucaugccaagaauuagcagugguuccagucuuuguagacccaggagaagaaagccauagaccauuuguaguaguacaagcaagacuaggagauaguagacauagaauaagaaaaagagguuuagaaugugacggaagaacaaauuuauguugcagacaacaauucuuuauugauuuuagguuaauagguuggaaugauuggauaauagcaccaacaggauauuauggaaauuauugugaaggaagcuguccagcauauuuagcugguguaccagguucagcuaguaguuuucacacagcaguagucaaucaauaucguaugcgaggauuaaauccugguacuguaaauagcuguuguauaccaacaaaacuaaguacaaugucaauguuauauuuugaugaugaauauaauauaguuaaaagagauguuccaaauaugauaguagaagaauguggaugcgcuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2565 - RNA, 3676 nt, Artificial Sequence
  mRNA product Design1 comprising derived and/or modified sequence from Homo sapiens__NP_000623.2__HsITGAM (opt13)
gggagaaagcuuaccauggcauuacgagucuuacuuuuaacagcauuaacucugugccacggauuuaaucuugauacagaaaaugcaaugacauuucaagaaaacgcacgaggauuuggccagucgguaguacaguuacaggguagcaggguuguugucggugccccacaagaaauaguagcagccaaucaaagagguucacuauaccaaugugauuacucuacaggaaguugugagcccauaagauuacaaguacccgucgaagcagucaauaugucccuaggacuaaguuuagcagcaacaacuagcccaccacaauuacuagcuugcggcccaaccguacaccagacauguucugaaaauaccuaugucaaagguuuaugcuucuuauucgguaguaauuuaagacagcaaccacaaaaauuuccugaagcacuacgcggauguccucaagaagacuccgacauagcauuucuaauagacggaaguggcaguauaauaccccaugacuuuaggagaaugaaagaauuuguguccacaguaauggaacaacuaaagaaaucuaagacacuuuucucauuaaugcaauauagugaagaauuuagaauacauuucaccuucaaagaauuucaaaacaacccgaauccaagaucccuaguuaaaccaauaacccaguuacuaggaagaacacauacugccacaggcauucgaaaaguaguacgagaacuauuuaacauuacuaauggagcuagaaagaacgcuuucaaaauucuaguaguuauaacugauggagagaaauucggagacccucuuggauacgaagauguuauaccagaagccgauagagaaggagucauaagauauguaauaggaguaggcgaugccuuccgaagcgaaaaauccagacaggaacuaaauacaauagcuagcaaaccaccgagggaccacguuuuucaagucaauaauuuugaagcauuaaaaaccauucaaaaccaacuaagggagaaaauauucgcuauagaaggaacacaaaccggaucuaguaguagcuuugaacaugaaaugucccaagaagguuuuucugcugcgauaacuucaaauggcccacuacuaucaacagucgguaguuaugauugggccggaggaguauuccuuuauacaaguaaagaaaaaucaacauucauaaauaugacaagaguagacucugauaugaaugaugccuauuuaggauacgcagcagcaaucauacuacgcaacagaguccaaucacucguacuaggugcccccagauaccaacauaucggucuggucgcuauguuucgucaaaauacagguaugugggaaaguaaugcaaauguaaaagguacucaaauaggcgcauauuuuggugcuucauuaugcagcguugacguggauucgaacgguaguacagacuuaguguuaauaggcgcaccccacuacuacgaacaaacaagaggugggcagguaucaguaugcccucuacccagaggccgugccagauggcaaugugacgcaguacuauauggagaacaagggcaaccaugggguagauuuggggcugcauugacaguuuuaggagacguaaauggagauaaacuaacggauguugcuauaggagccccuggugaggaagauaauagaggagcgguauaccuauuucauggaacaucuggaaguggaauuucaccuagucacucacaaaggauagcaggauccaagcucuccccacgauuacaauauuuuggacagagccuaucgggaggucaagaucuaacuauggaugguuugguggaucucaccguaggcgcucaaggucaugugcuacuauuacgaucacaaccuguacuuagaguaaaagccauaauggaguucaacccaagagaaguagcucguaauguauucgaaugcaacgaucaaguuguaaaaggcaaagaagcaggagaagugcgugucugucuucauguucagaaaagcacacgugaucgauuaagagagggccaaauucaaucuguaguuacauacgacuuagccuuagacuccggacgaccacacucucgcgcagucuuuaaugaaacgaaaaacucaacacgaaggcaaacacaaguacuaggauuaacucaaacaugcgaaacccuuaaacuacaauuaccuaacuguaucgaagacccaguaucuccaaucguauugagacuaaauuuuuccuuaguaggcacaccacuuagugcuuuuggaaaucuaagaccggucuuagcagaagaugcucaaagauuauuuaccgcacuguucccauucgagaaaaacuguggaaacgauaauauaugccaagacgacuuaucuauuacauucucauucaugucguuagauugucuaguaguaggaggacccagagaauuuaauguaaccgucacaguucgaaaugacggagaagacucauauagaacccaaguaacauucuucuuuccguuagaucucagcuaucggaaaguaucaacauuacaaaaccaacgaagccaacgaucauggaggcucgcaugugaaagcgcuuccaguacggaaguaaguggagcacucaaaucuacaucuugcucuauuaaccacccaauauuuccggaaaacagugaggucacuuuuaauaucaccuucgacguagauagcaaagccaguuuaggaaauaaacuucuucucaaggcaaacguaacuucugaaaauaauaugccaagaaccaacaaaacagaguuccaacuagaauuaccagucaaauacgcaguauauaugguaguaacaagucauggaguuuccacgaaauaccuaaacuuuacugcaucagaaaacacaagcagaguaaugcaacaucaauaccaaguaucaaauuuaggacaacgaaguuuaccaauaucguuaguuuuccuggucccagucagauugaaucaaacaguaaucugggauagaccacaaguaacauuuucagaaaaucucucaucaaccugucauaccaaggaaagauuaccuucacauucagauuuucuagcagaacuacgcaaagcuccaguaguuaauugcucaaucgcaguaugucaaagaauacaaugugacaucccauucuuuggcauucaagaagaauuuaacgcuacauuaaaaggaaaucuuaguuuugauugguacaucaaaaccagucauaaccauuuacuaauagucucuacugcugaaauacuauuuaaugauucuguauuuacucuauuaccaggacaaggagcuuuuguucgaucacaaacagaaacuaaaguagaaccauucgaagucccaaauccauuaccauuaaucguggguucuucuguaggcggcuuauuacuuuuagcauuaauaacugcugccuuguauaaauuaggauuuuucaaaaggcaauauaaagauaugaugucugaaggagguccacccggagccgaaccacaauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2566 - RNA, 1621 nt, Artificial Sequence
  mRNA product Design1 comprising derived and/or modified sequence from Homo sapiens__NP_002415.1__HsMMP8 (opt13)
gggagaaagcuuaccauguucucccucaaaacacuaccauucuuacuacuacuccauguacaaauauccaaagcauucccuguaucaucaaaagaaaaaaacacaaaaacaguacaagacuaccuagaaaaauucuaccaauuaccuucaaaccaauaccaaucaacaagaaaaaacggaacaaacguuauaguagaaaaacuaaaagaaaugcaacguuucuuugguuuaaauguaacagguaaaccaaacgaagaaacauuagacaugaugaaaaaaccaagauguggaguaccagacuccggcggauuuauguuaacaccaggaaauccaaaaugggaaagaacaaauuuaacuuaccgaauaagaaacuacacaccucaauuaagcgaagcagaaguagaaagagcaauaaaagaugccuucgaacuaugguccguagcaucaccucuaauuuucacaagaauaucacaaggagaagcagacaucaacauagcuuuuuaucaaagagaucacggagacaauucaccauuugauggaccaaacggaauccuagcacaugcauuucaacccggucaaggaauaggaggagacgcacacuucgaugccgaagaaacauggaccaacacuucagcaaacuacaaccuauuucuaguagcagcacaugaauucggccacucauuaggacucgcucauuccucagacccuggagcccuaauguaucccaacuaugcauucagagaaacaucaaacuauucacuaccucaagacgacauagauggaauucaagcuaucuacggauuaucaucaaacccaauucaaccaacaggaccaucaacacccaaaccuugugacccaucccuaacauuugacgcuauaacaacacuaagaggagaaauauuauucuucaaagacagauacuuuuggagaagacacccucaacuacaaagaguugaaaugaacuuuauaucauuauucuggccaucacuaccaacaggaauacaagcagcauacgaagacuucgauagagacuuaauauuccuuuucaaaggaaaccaauacugggcccuaaguggauacgacauauuacaagguuauccuaaagacauaucaaacuacggauuuccaucuucaguacaagcaauagacgcagcagucuucuauagaucaaaaacauacuuuuucguaaacgaccaauucuggagauaugacaaccaacgacaauuuauggaaccaggauauccaaaaucaauaucaggagcauucccuggaauagaauccaaaguagacgcaguauuucaacaagaacacuucuuccauguuuuuucaggaccaagauacuacgcuuuugacuuaauagcacaaagaguaacaagaguagcaagaggaaacaaauggcuaaacugccgauauggauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2567 - RNA, 2341 nt, Artificial Sequence
  mRNA product Design1 comprising derived and/or modified sequence from Homo sapiens__NP_004985.2__HsMMP9 (opt13)
gggagaaagcuuaccaugucauuauggcaaccauuaguuuugguacuuuuaguauuaggauguuguuuugcugcaccacgucaaagacaaaguacauuaguccuauuuccaggcgauuuaagaacaaauuuaacagacagacaacuugcagaagaauaucuauauagauaugguuauacaagaguagcugaaaugagaggugaaucaaaaucucuaggaccagcauuauuacuacuacaaaaacaguuaucacuaccagaaaccggggaacuagacucagcuacacuuaaagcaaugagaacuccacgguguggagucccagaucucggucgguuucaaacauuugaaggagaccuuaaauggcaucaucacaauauaacauauuggauacagaauuauucagaagaccuaccaagagcgguuauagacgacgcauucgcccgagcauuugcacuauggagugcuguaacaccauugacuuuuacaaggguauauagucgagaugcagauaucguaauacaauuugguguagcagagcauggggauggauacccuuuugacgguaaagacggacuucuagcacaugcauuuccaccaggaccuggaauacaaggagaugcccauuuugaugacgacgaacuauggagucuuggaaaaggagucguaguaccuacaagauuugguaaugcugauggugcagcaugucauuuuccuuuuauauuugaaggacgaucuuacucugcaugcacuacagauggacguucagauggauuaccaugguguucuacuacagccaauuaugauacagaugauagauuugguuuuuguccuucagaacgauuauauacgcaagauggaaaugcagauggaaaaccuugucaauucccauuuauauuucaaggacaaucauauucagcauguacaacagauggacgaagcgauggauaucgauggugugcaacaacagcuaacuacgacagagauaaauuauuugguuuuuguccaacucgcgcugacucaacagucaugggugguaauagcgcuggugaauuauguguauuuccauuuacuuuccuuggcaaagaauacucaacaugcacaucggaaggaagaggagauggacgauuauggugugcaacuacuaguaauuucgacagugacaaaaaauggggauuuuguccggaccaaggguauucacuuuucuuaguugcagcacacgaauucggucaugcacuuggccuagaccauucaucaguaccugaagcucuuauguacccaauguauagauuuacagaaggaccuccacuccauaaagacgaugucaacggcauacgccaucuauaugguccacguccagagccugaaccaaggccucccacaacaacaacaccacaaccuacugcuccaccuacaguaugcccgacuggcccaccaacaguacauccaucugaaagaccaacggccggaccaacgggaccuccuucagcggguccaacaggaccaccaacagcaggccccagcacugccacuacaguaccauuaucaccuguggacgaugcuuguaauguuaauauauuugaugcaauagcugaaauugguaaucaacuguauuuauuuaaagauggaaaauauuggcgauuuagugaaggacgcggaucuagaccccaaggaccauuucuaauugccgauaaauggccagcccuaccuagaaaauuagauucuguauuugaagaaagauuaucaaaaaaauuauuuuuuuucucaggaagacaaguauggguuuauacaggagcaucaguacuaggaccuagaagacuagauaaacuagguuuaggagccgacgucgcacaaguuacaggcgcccuaagaucaggaagaggaaaaauguuauuauucagcgguagaagauuauggagauuugaugugaaagcacaaaugguugauccaagaucagcuagcgaagucgaucgaauguucccagguguaccauuggauacucaugauguuuuucaauauagagaaaaagcauauuuuugucaagauagauuuuauuggcguguuucaucuaggagugaauuaaaccaaguggaucaaguaggauauguaacauacgauauacuacaauguccagaagauuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2568 - RNA, 1633 nt, Artificial Sequence
  mRNA product Design1 comprising derived and/or modified sequence from Homo sapiens__NP_002418.1__HsMMP13 (opt13)
gggagaaagcuuaccaugcacccaggaguauuagcagcauuccucuucuuaucauggacacacugccgagcauuaccauuaccaucaggaggagacgaagacgaucuaucagaagaagaccuucaauucgcagaaagauacuuaagaucauacuaccacccaacaaacuuagcagguauacuaaaagaaaacgcagccucuucaaugacagaaagacuuagagaaaugcaaucauucuucggauuagaaguaacaggaaaauuagaugacaauacacuagauguaaugaaaaaaccuagaugcggaguuccugacguaggagaauauaacgucuuuccaagaacauuaaaaugguccaaaaugaaccuaacauauagaauaguaaacuauacaccagauaugacccauucagaagucgaaaaagcauucaaaaaagcauucaaaguauggucagauguaacaccucuaaacuucacaagacuacaugacggaauagcagacaucaugauaagcuuuggaauaaaagaacacggagauuucuacccauucgacggaccaucuggauuauuagcccacgcauuucccccaggaccaaauuauggaggagacgcacauuucgaugacgaugaaacauggacaucaucaucaaaaggauacaaccuauucuuaguagcagcacacgaauucggacacucuuuaggcuuagaccauucaaaagaccccggagcacuaauguucccaauauauacauauacaggaaaaagccacuucauguuaccagacgaugacguccaagguauacaaagucuauacggaccaggagaugaagauccuaacccaaaacauccaaaaaccccagacaaaugugauccaucauuaucauuagaugccauaacaucauuacgaggagaaacaaugauuuucaaagaccguuucuucuggcgucuucacccacaacaagucgacgcagaacucuuuuuaacaaaaucguuuuggccugaacuaccaaacagaauagaugcagcauacgaacacccuagucacgacuuaauauuuauuuuucgaggacgaaaauucugggcccuaaauggauacgauauauuagaaggauacccuaaaaaaauaucugaacuaggauuaccaaaagaaguaaaaaaaauaucagccgcaguccacuuugaagauacaggaaaaacacuucuauuuucaggcaaucaagucuggagauacgacgacacaaaccacauaauggacaaagacuaccccagauuaauagaagaagacuucccaggcauaggugacaaaguagacgcaguauacgaaaaaaacggauauauauauuucuucaacggaccaauacaauuugaauacucuauauggucaaacagaauaguaagaguaaugccagcaaacuccauuuuauggugcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2569 - RNA, 1285 nt, Artificial Sequence
  mRNA product Design1 comprising derived and/or modified sequence from Homo sapiens__NP_001286.1__HsCCR1 (opt13)
gggagaaagcuuaccauggaaacaccaaacacaacagaagacuacgauacaaccacagaauuugauuauggagacgcaacaccaugucaaaaaguaaacgaaagagccuuuggcgcgcaacuacuacccccauuauacucacuagucuucgucauaggacuaguagguaauauacuaguaguacuaguauuaguccaauacaaaagauuaaaaaauaugacaucaauauauuuacuaaacuuagcaauaucagauuuacuauuccuauucacauuaccauucuggaucgacuacaaacuaaaagacgacuggguauuuggagacgcaaugugcaaaauacucucaggauucuacuacacaggccuauacucugaaaucuucuucauaauacuacuaacaauagauagauaccuagcaauaguucaugcaguauucgcauuaagagccagaaccgucacauucggagucauaacaucaauaauaauaugggccuuagcaauauuagcaucaaugccaggacuauacuuuucuaaaacacaaugggaauucacacaucauacaugcucacuucacuucccucacgaaucccuaagagaauggaaacucuuccaagcauuaaaacucaaucuuuucggacuaguacuaccccuacucguaaugaucauaugcuacacaggaauaauaaaaauacuacuacgacgaccaaacgaaaaaaaaucaaaagcaguaagauuaauauucguaauaaugaucaucuucuuccuuuuuuggaccccuuacaaccucacaauacuaauaucaguauuccaagacuuuuuauucacacacgaaugugaacaauccagacaucucgacuuagcaguacaagucaccgaaguaauagcauacacacacuguugcguuaaccccguaauauacgcuuuuguaggagaaagauuccgaaaauaucuaagacaacuauuucacagacgaguugcaguacacuuagucaaaugguuaccauuucuaucaguagauagauuagaaagagucucauccacaucaccaucaaccggagaacacgaauuaucagcaggauucuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2570 - RNA, 853 nt, Artificial Sequence
  mRNA product Design1 comprising derived and/or modified sequence from Homo sapiens__NP_002598.4__HsPDGFA (opt13)
gggagaaagcuuaccaugagaacacuagcaugccuacuauuacuaggaugcggauaccuagcacauguacuagcugaagaagcagaaauaccaagagaaguaauagaaagacuagcaagaucacaaauacacucaauaagagaccuacaacgacuacuagaaauagacucagucggaagugaagacucacucgacacaagucuaagagcacacggaguacacgcaacaaaacacguaccagaaaaaagaccacuacccauaagaagaaaaagaagcauagaagaagcaguaccagcaguaugcaaaacacgaacaguaauauacgaaauaccaagaucacaaguagacccaacaucagcaaacuuccuaauauggcccccaugcguagaaguaaaaagaugcacaggaugcugcaacacaucaagcguaaaaugccaaccaagcaggguacaccacagaagcgucaaaguagcaaaaguagaauacguaagaaaaaaaccaaaacuaaaagaaguacaaguaagacuagaagaacaccuagaaugcgcaugugcaacaacaagccuaaauccagauuacagagaagaagacacaggaagaccaagagaaagcggaaaaaaaagaaaaagaaaaagacuaaaaccaacauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2571 - RNA, 943 nt, Artificial Sequence
  mRNA product Design1 comprising derived and/or modified sequence from Homo sapiens__NP_002599.1__HsPDGFB (opt13)
gggagaaagcuuaccaugaacagaugcugggcauuauucuuaucauuaugcuguuaccuaagauuaguaucagcagaaggagauccaauaccagaagaacuauacgaaaugcuaagcgaucacaguauaagaagcuuugacgaucuacaaagauuacuucacggcgauccaggagaagaagacggagcagaauuagaccuaaauaugacaagaucacacucaggaggagaauuagaaucacuagcacguggaagaagaagccuaggaagucuaacaauagcagaaccugcaaugauagcagaauguaaaacacgaacagaaguauucgaaauaucaagaagauuaauagauagaacaaaugcaaauuucuuaguauggccaccauguguagaaguacaaagaugcaguggaugcugcaauaacagaaacguacaauguagaccaacacaaguacaauuaagaccaguacaaguaagaaaaauagaaauaguaagaaaaaaaccaauauuuaaaaaagcaacagucacauuagaggaccaccucgcaugcaaaugugaaaccguagcagcagcaagaccaguaacaagaagcccaggcggaagccaagaacaaagagcaaaaacaccacaaacuagaguuacaauaagaacaguaagaguacgaaggcccccaaaaggaaaacauagaaaauucaaacacacacacgacaaaacagcacuaaaagaaacacuaggagcguaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2572 - RNA, 1255 nt, Artificial Sequence
  mRNA product Design1 comprising derived and/or modified sequence from Homo sapiens__NP_057289.1__HsPDGFC (opt13)
gggagaaagcuuaccaugucauuauuuggauuauuacuacuuacaucagcauuagcaggacaaagacaagguacacaagcagaaagcaaucuaucaagcaaauuccaauuuucauccaauaaagaacaaaauggaguacaagacccacaacacgaaagaauaauaaccgucagcacaaacggcucaauacauaguccacgauucccacauacauauccaagaaacaccguacucgucuggagauuaguagcaguugaagaaaauguauggauccaauuaacauucgacgaaagauuuggauuagaagacccugaagacgacauaugcaaauacgacuuuguagaaguagaagaaccaucagacggaacaauauuaggacgauggugcggaucagguacaguaccugguaaacaaaucucaaaaggcaaccaaauaagaauaagauucguaagcgaugaauacuucccaagugaaccaggauucuguauacauuacaauaucgucaugccacaauucacagaagcaguaucaccaucaguacuaccaccaucagcucuaccauuagacuuacuaaauaacgcuauaacagcauuuucaacauuagaagacuuaauacgauacuuagaaccagaaagauggcaacuagaccuagaagaccuauacaggccaacauggcaacuucuaggaaaagcauuuguauuuggaagaaaaucacgaguugucgaucuaaaccuauuaacagaagaaguaagacuuuacucaugcacaccaagaaacuuuucaguauccauaagagaagaacuaaaaagaacagauacaauauucuggccaggaugccuacuaguaaaaagaugcggcggaaauugcgcaugcugcuuacacaacuguaacgaaugccaaugcguaccaucaaaaguuacaaaaaaauaccacgaaguacuacaauuaagacccaaaacuggaguuagaggacuacauaaaucucuaacagacguagcacuagaacaucacgaagaaugugacugcguuugccgaggaagcacaggaggcuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2573 - RNA, 1312 nt, Artificial Sequence
  mRNA product Design1 comprising derived and/or modified sequence from Homo sapiens__NP_149126.1__HsPDGFD (opt13)
gggagaaagcuuaccaugcacagauuaauauuuguauacacacuaauaugugcaaacuucugcucaugcagagacacauccgcaacuccacaaucagcaucaauaaaagcuuuaagaaacgcaaaucuaagaagagacgaucuauacagaagagacgaaaccauacaaguaaaaggaaacggcuacguacaaagcccacgauucccuaacucauacccaagaaaucuauuauuaacauggcgacuacacucccaagaaaacacaagaauacaacuaguauucgauaaccaauucggauuagaagaagcagaaaacgacauauguagauaugauuucguagaaguagaagacauaucagaaacaucaacuauaauacgaggaagauggugcggacacaaagaaguaccaccacgaauaaaaucaagaacaaaccaaauaaaaauaacuuucaaaucagaugacuacuucguugcaaaacccggauucaaaauauauuauagccuacuagaagacuuccaaccagcagcagcuucagaaacaaauugggaaucagucacaagcucaauaucaggaguaucauauaauagcccaucaguuacagacccaacacuaaucgccgacgcauuagacaaaaaaauagcagaauucgauacaguagaagaucuacuaaaauacuuuaacccugaaucauggcaagaagaucuagaaaacauguaucuagacacacccagauacagaggaagaagcuaccacgacagaaaaucaaaaguagacuuagacagacuaaaugaugacgcaaaaagauacucaugcacaccaagaaacuacagcguaaauauaagagaagaacuaaaauuagcaaacguaguauucuucccaagaugucuauuaguacaacgcugcggaggaaacuguggaugcggaacaguaaacuggcgaagcuguacaugcaauuccggaaaaacagucaaaaaauaccacgaaguacuacaauucgaacccggacauauaaaaagaagagguagagcaaaaacaauggcacuaguagauauacaauuagaccaccaugaaagaugcgauuguauaugcagcucuagaccuccaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2574 - RNA, 895 nt, Artificial Sequence
  mRNA product Design1 comprising derived and/or modified sequence from Homo sapiens__NP_003946.3__HsSOCS3 (opt13)
gggagaaagcuuaccauggucacccauucaaaauucccagcagcaggaaugucaagaccauuagacacaucauuacgauuaaaaacauucucaucaaaaucagaauaccaacuaguaguaaaugcaguaagaaaacuacaagaaucaggauucuauuggucagcaguaacaggaggagaagcaaauuuauuacuaucagcagaaccagcaggaacuuuccuaauacgagacucaucagaccaacgacacuucuuuacucuaucaguaaaaacacaaucaggaacaaaaaaccucagaauacaaugugaaggaggaucauucucccuacaaucagaccccagaucaacacaacccguaccaagauucgacugcguacuaaaacuaguacaccacuacaugccaccacccggagcaccauccuucccaucuccaccaacagaaccaucaucugaaguaccugaacaaccaucagcacaaccacuaccuggaucaccaccaagaagagcauacuacauauacucaggaggagaaaaaauaccacuaguacuuucaagaccacuaucaucuaauguagcaacacuacaacacuuaugccgaaaaacaguaaacggccaccuagacucauacgaaaaagucacacaacuaccaggaccaauaagagaauucuuagaucaauacgacgcaccacuauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2575 - RNA, 700 nt, Artificial Sequence
  mRNA product Design1 comprising derived and/or modified sequence from Homo sapiens__NP_003227.1__HsTGFA (opt13)
gggagaaagcuuaccaugguaccaucagcaggacaauuagcauuauuugcacuaggaauaguacuagcagcaugucaagcauuagaaaacucaacaucaccacuaucagcagacccaccaguagcagcagcaguaguaucacauuuuaaugauugcccagacucacacacacaauucugcuuucacggaacauguagauuucuaguacaagaagacaaaccagcauguguaugucauucaggauauguaggagcaagaugugaacaugcagauuuauuagcaguaguagcagcaucacaaaaaaaacaagcaauaacugcauuaguaguaguaaguauaguagcauuagcaguauuaauaauaacauguguauuaauacauugcugucaaguaagaaaacauugugaauggugcagagcauuaauauguagacaugaaaaaccuucagcauuacuaaaaggaagaacagcaugcugucacucagaaacaguaguauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2576 - RNA, 1390 nt, Artificial Sequence
  mRNA product Design1 comprising derived and/or modified sequence from Homo sapiens__NP_000651.3__HsTGFB1 (opt13)
gggagaaagcuuaccaugccaccaucaggucuacgacuacuaccucucuuacuaccuuuacuauggcuccucguacuaaccccaggccgaccagcagcuggccuaucaacaugcaaaacaauagacauggaauuagucaaaagaaaaagaauagaagcaauuagaggacaaauacuaucaaaauuaagauuagccuccccaccuucucaaggagaaguaccaccagguccacuaccugaagcaguccuagcacuauacaacucaacaagagacagaguagcaggagaauccgcagaaccagaacccgaaccagaagcagacuauuaugcaaaagaagucaccagaguacuaaugguagaaacacauaaugaaaucuacgauaaauuuaaacaaucaacacauucaauauacauguuuuucaacacaagugaacuaagagaagcaguaccagaaccaguauuacuaucacgagccgaauuaagacuccuaagacuuaaacuaaaaguagaacaacacguugaauuauaccaaaaauacucuaacaacucauggagauacuuaucuaaucgacuacuagcacccucagacucaccagaauggcucucauucgacguaaccggaguaguacgacaauggcuaucccguggcggugaaauagaaggauucagacuauccgcacacugcucuugcgacucaagagacaauacauuacaaguagauauaaacggauucacaacaggaagaagaggagacuuagcuacaauccacggaaugaaccgccccuuccuacuauuaauggcaacuccucuagaaagagcacaacacuuacaauccucaagacacagaagagcacuagacacaaacuauuguuucucaagcacugaaaaaaacugcugcguccgacaauuauacauagacuuccgaaaagaucucggauggaaauggauacacgaaccaaaaggauaccacgccaacuucugccucgguccauguccauauaucuggucacuagauacacaauacuccaaaguacuagcauuauauaaccaacauaauccaggagcaucagcagcgccaugcugcguaccacaagcauuagaaccacucccaauaguauacuaugucggaagaaaaccaaaaguagaacaacuaucaaacaugauagucagaucaugcaaauguucuuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2577 - RNA, 1462 nt, Artificial Sequence
  mRNA product Design1 comprising derived and/or modified sequence from Homo sapiens__NP_003229.1__HsTGFB2 (opt13)
gggagaaagcuuaccaugcacuauugcguacuuucagcauuucuaauauuacaccuaguaacagucgcuuuaaguuuaagcacaugcucaaccuuagacauggaccaauuuaugagaaaacgaauagaagcaauaagaggacaaauauuauccaaacuaaaacuaacaucaccacccgaagauuauccagaaccagaagaagucccaccagaaguaauaucaauauauaacagcacaagagaccuccuacaagaaaaagcaucaagaagagcagcagcaugcgaacgagaaagaucagaugaagaauauuacgcuaaagaaguauacaaaauagacaugccccccuucuuuccaucagaaaaugcaauaccaccaaccuuuuacagacccuauuuucgaauaguaagauucgauguaucagccauggaaaaaaacgcaucaaaccuagucaaagcggaauucagaguauuccgacuucaaaacccaaaagcuagaguucccgaacaacgaaucgaacuauaucaaauacuaaaaucaaaagaccuaaccucacccacacaaagauacauagacucaaaaguaguaaaaaccagagcagagggcgaaugguuaucauucgacguaacagacgcaguacacgaauggcuacaucacaaagaccgaaaucucggauucaaaauaucacuacacugcccaugcugcacauucgucccaucaaacaacuauauaauaccaaauaaaucagaagaacuugaagcaagauuugcuggaauagacggaacaaguacauacaccucuggagaccaaaaaacuauaaaaucaacaagaaaaaaaaacucuggcaaaacaccucaccuacuauuaaugcuacuacccucauacagacuagaaucacaacaaacaaaccgaagaaaaaaaagagcacuagacgcagcauacuguuucagaaacguacaagauaacugcugccucagaccacuauauauagacuucaaaagagaccuaggauggaaauggauacaugaaccaaaaggcuacaacgccaacuucugcgcaggagcaugcccauacuuauggucaucugacacacagcacucaagaguacuaucacuauacaacacaauaaauccagaagcuucagcaagucccugcugcguaucacaagacuuagaacccuuaacuauauuauauuauaucggaaaaacaccaaaaauagaacaacuaucaaacaugauaguaaaaucauguaaauguaguuaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2578 - RNA, 1456 nt, Artificial Sequence
  mRNA product Design1 comprising derived and/or modified sequence from Homo sapiens__NP_003230.1__HsTGFB3 (opt13)
gggagaaagcuuaccaugaaaaugcaccuccaaagagcccucgucguucucgcacuacuaaacuucgcaaccguaucacuaucccuaucaacaugcacaacccuagacuucggacacauaaaaaaaaaaagaguagaagcaauccgaggccaaauuuuaucaaaacuaagacuaacaucaccaccagaacccacagucaugacacacguaccauaccaaguccuagcacuauacaacucaacacgagaacuauuagaagaaaugcacggagaaagagaagaaggauguacacaagaaaacacugaaagugaauacuaugcaaaagaaauacacaaauucgauaugauacaaggacuagcagaacacaacgaacuagcaguaugcccaaaaggaauaacaucaaaaguauuucgauucaacguaucaucaguagagaaaaaucgaacaaaccuauuuagagccgaauuuagaguccuaagaguccccaauccaucaucaaaaagaaacgaacaacgcauagaacuauuucaaauacuacgcccagacgaacacauagcaaaacaaagauacauagguggaaaaaaccucccaaccagaggaacagccgaauggcuaucauucgacguaacagacaccgucagagaauggcuacuccgcagagaaucaaacuuaggucuagaaauaucaauacacugcccaugccauacauuucaaccaaauggagacauauuagaaaacauacaugaaguaauggaaaucaaauucaaaggaguagacaacgaagacgaccacggacgaggcgaccucggcagacuaaaaaaacaaaaagaucaccacaauccacaccuaauccuaaugaugauacccccccacagacuagacaacccaggacaaggaggacaacgaaaaaaaagagcacucgacacaaauuauuguuuccgaaaucuagaagaaaacugcugcguccguccacuuuacauagacuucagacaagaccuaggauggaaauggguucacgaaccaaaaggauauuaugccaacuucugcucaggacccugcccauacuuaagaucagcagacacaacacacucuacaguacuaggacuauacaacacacuaaacccagaagccucagcaucacccugcugugucccacaagaccuagaaccuuuaaccauacuauacuacguaggaagaacuccuaaaguagaacaacuuucaaauaugguaguaaaaucaugcaaaugcucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2579 - RNA, 1603 nt, Artificial Sequence
  mRNA product Design1 comprising derived and/or modified sequence from Homo sapiens__NP_001057.1__HsTNFRSF1B (opt13)
gggagaaagcuuaccauggcaccaguagcaguaugggcagcacuugcaguaggacucgaauuaugggcagcagcacaugcauuaccugcacaaguugcauucacacccuacgcacccgaaccaggcucaaccuguagauuaagagaauauuacgaucaaacagcucaaaugugcuguucuaaaugcucaccuggccaacaugcaaaaguauuuugcacuaaaacaucugauaccguaugugauucuugugaagacucaacauauacacaacuauggaacuggguuccagaaugucuaucaugcggaucaagauguucaucagaccaaguugaaacacaagcauguacucgugaacaaaaucgaauuugcacauguagaccaggaugguauugcgcuuuaucgaaacaagaaggauguagacuaugcgcaccucuuagaaaaugcagaccaggcuuuggagucgcucgacccggaacugaaacaucagacguaguaugcaaaccuugugcaccagguacauucucuaacacaacaaguucaacagauauuuguagaccacaccaaauauguaacguaguugcuauaccaggaaacgcaucuauggaugcaguauguacaucuacgucaccuaccagaucaauggcaccaggagcaguucacuuaccacaaccaguaucaacaagaagucaacacacacaaccaacaccugaacccucaacugcaccaagcacuucauuucuacuaccaaugggucccucaccaccugcugaaggaucaacaggagacuucgcauuaccugucggacuuaucguaggaguuacagcauuaggacuauuaauaaucgguguaguaaauuguguuauuaugacacaaguaaaaaaaaaacccuuauguuuacaaagagaagccaaaguaccucauuuaccagcagauaaagccagaggaacccaagguccagaacaacaacauuuauuaaucacagcucccucaucaucaucaucaucuuuagaaucaucagcaagugcucuagauagaagagcucccacaagaaaccaaccucaagcaccaggugucgaagcaucaggagcuggugaagcucgugcuucuacgggaucuucagauucaucacccggaggacacggaacacaaguaaauguaacaugcauaguaaaugucuguuccaguucggaucauucaucacaauguucaucacaagcaucaucuacuaugggagauacagauaguucaccaucagaauccccaaaagacgaacaaguaccauuuucaaaagaagaaugcgcauuuagaucacaauuagaaacaccagaaacauuauuaggaucaacugaagaaaaaccacuaccacuaggcguaccagaugcaggaaugaaacccucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2580 - RNA, 730 nt, Artificial Sequence
  mRNA product Design1 comprising derived and/or modified sequence from Homo sapiens__NP_002623.2__HsPGF (opt13)
gggagaaagcuuaccaugccaguaaugagauuauuuccauguuucuuacaauuauuagcaggauuagcauuaccagcaguaccaccacaacaaugggcguuaucagcaggaaauggaaguagugaaguagaaguaguaccauuucaagaaguauggggaagaucauauuguagagcacuagaaagacuaguagauguaguaagugaauauccaagcgaaguagaacauauguuuucaccaucauguguaaguuuauuaagauguacgggaugcuguggagaugaaaauuuacauuguguaccaguagaaacagcaaauguaacaaugcaauuauuaaaaauaagaaguggagauagaccaucauauguagaauuaacauuuagccaacauguaagaugugaauguagaccauuaagagaaaaaaugaaaccagaaagaagaagaccaaaaggaagaggaaaaagaagaagagaaaaacaaagaccaacagauugucauuuauguggagaugcaguaccaagaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2581 - RNA, 1456 nt, Artificial Sequence
  mRNA product Design1 comprising derived and/or modified sequence from Homo sapiens__NP_001020537.2__HsVEGFA (opt13)
gggagaaagcuuaccaugacagauagacaaacagauacagcgccaaguccaucauaccauuuauuaccaggaagaagaagaacaguagaugcagcagcgaguagaggacaaggaccagagccagcaccaggaggaggaguagaaggaguuggagcaagaggaguagcgcuaaaauuauuuguacaacuauuaggaugcaguagauucgguggagcaguaguaagagcuggagaagcagaaccauccggugcagccagaagcgcaaguaguggaagagaagaaccacaaccagaagaaggagaagaagaagaagaaaaagaagaggaaagaggaccacaauggagacuuggcgcuagaaaaccugggagcuggacaggagaagcagcuguaugcgcagauagugcaccagcagcaagagcaccacaagcauuagcaagagcaucaggacgaggaggaagaguagcaagaaggggagccgaagaaaguggaccuccacauaguccaaguagaagaggaucagcaaguagagcugggccaggaagggcaucugaaacaaugaauuuuuuauuaaguuggguacauuggaguuuagcuuuauugcuauauuuacaucacgcaaaauggagucaagcagcaccaauggcagaaggagggggacaaaaucaucacgaaguaguaaaauuuauggauguuuaucaaaggaguuauugucauccuauagaaacguuaguagauauauuucaagaauacccagaugaaauagaguauauauuuaaaccgaguuguguaccauuaaugagauguggaggauguuguaaugacgaaggacuagaauguguaccaacagaagaaagcaauauaacuaugcagauaaugagaauaaaaccucaucaaggacaacauauaggagaaaugaguuuuuugcaacacaauaagugcgaauguagaccaaaaaaagaucgagcaagacaagaaaaaaaaagcguaagagguaaagguaaaggacaaaaaagaaaaagaaaaaaaaguagauauaaaagcuggaguguauacguaggggcaagauguuguuugaugccauggagccucccaggaccucauccguguggaccauguucagagagaagaaaacaucuguuuguacaagauccacaaacauguaaaugcaguugcaaaaauacggauucaagauguaaagcgagacaauuagaauuaaaugaaaggacauguagaugcgauaagccgagaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2582 - RNA, 916 nt, Artificial Sequence
  mRNA product Design1 comprising derived and/or modified sequence from Homo sapiens__NP_001165094.1__HsVEGFA (opt13)
gggagaaagcuuaccaugaacuucuuacuaucauggguacauuggagcuuagcacuauuacuauaccuacaccacgcaaaauggucacaagcagcaccaauggcagaaggaggaggacaaaaccaccaugaaguaguaaaauucauggauguauaccaaagaucauacugccacccaauagaaacacuaguagacauauuccaagaauacccagacgaaauagaauacauauucaaaccaucauguguaccauuaaugagaugcggaggaugcugcaacgacgaaggacuagaauguguaccaacagaagaaaguaacauaacaaugcaaauaaugagaauaaaaccacaucaaggacaacacauaggagaaaugagcuuccuacaacacaauaaaugcgaaugcagaccaaaaaaagacagagcaagacaagaaaaaaaaaguguaagaggaaaaggaaaaggacaaaaaagaaaaagaaaaaaaucaagauacaaaucauggucaguauacguaggagcaagaugcugccuaaugccauggucacuaccaggaccacacccaugcggaccaugcucagaaagaagaaaacaccuauucguacaagacccacaaaccugcaaaugcaguugcaaaaacacagacagcagaugcaaagcaagacaauuagaacuaaacgaaagaacaugcagaugcgauaaaccacgaagauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2583 - RNA, 841 nt, Artificial Sequence
  mRNA product Design1 comprising derived and/or modified sequence from Homo sapiens__NP_003368.1__HsVEGFB (opt13)
gggagaaagcuuaccaugucaccacuauuaagaagauuauuacuagcagcauuacuacaauuagcacccgcacaagcaccuguaucacaaccagaugcaccaggacaucaaagaaaaguaguaucauggauagacguauacacaagagcaacaugucaaccaagagaaguaguaguaccauuaacaguagaacuaaugggaacagucgcaaaacaacuaguaccaucaugcguaacaguacaaagaugcggaggcuguuguccagacgauggauuagaauguguuccaacaggacaacaucaaguaagaaugcaaauacuaaugauaagauacccaucaucucaacuaggagaaauguccuuagaagaacauagucaaugcgaaugcagaccaaaaaaaaaagauucagcaguaaaaccagaccgagcagcaacaccacaucauagaccacaaccacgaucaguaccaggcugggacucagccccaggagcaccaucaccagcagauauaacccaucccacaccugcaccaggaccaucugcacaugcagcaccuucaacaacaucagcauuaacaccaggaccagcagcagcagccgcagacgcagcugcaucaucaguagcaaaaggaggagcauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2584 - RNA, 1477 nt, Artificial Sequence
  mRNA product Design1 comprising derived and/or modified sequence from Homo sapiens__NP_005420.1__HsVEGFC (opt13)
gggagaaagcuuaccaugcaccucuuaggauucuucucaguagcuugcucauuauuagccgccgccuuauuaccaggaccaagagaagcaccagcagcagccgcagcauuugaaucaggauuagacuuaagugaugcugaaccagacgcaggagaagcuacagcauaugccaguaaagacuuagaagaacaauuaagaucaguaaguuccguagacgaauuaaugacaguacucuauccagaauacuggaaaauguauaaaugucaacuaagaaaaggcggauggcaacauaauagggaacaagcaaaucuaaauucaagaacagaagaaacuauaaaauucgcagccgcacacuauaacacggaaauacuaaaaaguauagauaacgaauggagaaaaacacaaugcaugccaagagaaguaugcauagauguaggaaaagaauuuggaguagcaacaaacacauuuuucaaaccaccauguguaagcguauacagauguggcgguugcugcaauagcgaaggauuacaauguaugaacacuagcacuucauacuuaucaaaaacacuauuugaaauuacaguaccauuaagucaaggaccuaaaccaguaacgauaaguuuugcaaaccacacaucauguagauguaugucaaaacuagauguauauagacaaguacacucaauaauaagaagaucacuaccagcaacacuuccacaaugccaagcagcaaauaaaacauguccaacaaacuauauguggaacaaccacauaugcagaugucuagcacaagaagauuucauguuuaguucagacgcaggagacgacagcacagauggauuucaugacauaugcggacccaacaaagaauuagacgaagaaacuugucaaugcguauguagagcaggacuacgaccagcaucauguggaccacauaaagaauuagacagaaacaguugccaaugcguaugcaaaaauaaacuauucccaucacaauguggagcaaaucgagaauuugaugaaaacacaugucaauguguaugcaaaagaacaugcccaagaaaucaaccauuaaauccagguaaaugcgcaugugaauguacagaaucaccacaaaaaugccuauuaaaaggaaagaaauuucaccaucaaacaugcaguuguuauagaagaccauguacaaauagacaaaaagccugugaaccaggauucuccuacucagaagaaguauguagauguguaccaaguuacuggaaaagaccacaaaugucauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2585 - RNA, 1282 nt, Artificial Sequence
  mRNA product Design1 comprising derived and/or modified sequence from Homo sapiens__NP_004460.1__HsVEGFD (opt13)
gggagaaagcuuaccauguaccgagaauggguaguaguaaacguauucaugaugcuuuacguacaacuaguacaaggaucaucaaaugaacacggaccaguaaaaagaucaagccaaucaacauuagaaagaucagaacaacaaauacgagcagcaucaucacucgaagaacuccuaagaauaacacacuccgaagacuggaaacuauggcgaugcagacuaagauuaaaaucauucacaucaauggauucacgcuccgcaucccacagaucaacaagauuugccgccacauuuuacgacauagaaacauuaaaagucaucgacgaagaauggcaacgaacacaaugcucaccuagagaaacaugcguagaaguagcaucagaacuagguaaauccacaaauaccuuuuuuaaaccaccuugcguaaacguauucagaugcggaggcuguugcaacgaagaaucacuaauuuguaugaacacaucuacauccuacauaucaaaacaacuauucgaaauaucaguaccacuaacaagcguacccgaacuaguccccguaaaaguagcaaaccacacaggaugcaaaugccuaccaacagcaccaagacauccauacuccauaauacgaagaucaauacaaauaccagaagaagacagaugcucacacucaaaaaaacuaugcccuauagauaugcuaugggacagcaacaaaugcaaaugcguacuacaagaagaaaacccucuagcaggaaccgaagaccacagccaucuacaagaaccagcauuaugcgguccacauaugauguucgacgaagacagaugcgaaugcguaugcaaaacaccaugccccaaagaccuuauacaacacccuaaaaacuguagcugcuuugaaugcaaagaaucacuagaaacaugcugccaaaaacacaaauuauuucacccagacacaugcucaugcgaagacagaugcccauuccacaccagaccaugcgcauccgguaaaacagcaugugcaaaacacugcagauuccccaaagaaaaaagagcagcccaaggaccacacucaagaaaaaauccauaaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2586 - RNA, 1012 nt, Artificial Sequence
  mRNA product Design2 comprising derived and/or modified sequence from Homo sapiens__NP_061986.1__HsFGF21 (wt)
ggggcgcugccuacggagguggcagccaucuccuucucggcaucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2587 - RNA, 1012 nt, Artificial Sequence
  mRNA product Design2 comprising derived and/or modified sequence from Homo sapiens__NP_061986.1__HsFGF21 (wt)
ggggcgcugccuacggagguggcagccaucuccuucucggcaucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2588 - RNA, 1792 nt, Artificial Sequence
  mRNA product Design2 comprising derived and/or modified sequence from Homo sapiens__NP_002412.1__HsMMP1 (wt)
ggggcgcugccuacggagguggcagccaucuccuucucggcaucaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaauucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2589 - RNA, 1792 nt, Artificial Sequence
  mRNA product Design2 comprising derived and/or modified sequence from Homo sapiens__NP_002412.1__HsMMP1 (wt)
ggggcgcugccuacggagguggcagccaucuccuucucggcaucaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaguucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2590 - RNA, 1552 nt, Artificial Sequence
  mRNA product Design2 comprising derived and/or modified sequence from Homo sapiens__NP_002412.1__HsMMP1(1-19,100-469) (wt)
ggggcgcugccuacggagguggcagccaucuccuucucggcaucaagcuuaccaugcacagcuuuccuccacugcugcugcugcuguucugggguguggugucucacagcuuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2591 - RNA, 3739 nt, Artificial Sequence
  mRNA product Design2 comprising derived and/or modified sequence from Clostridium histolyticum__BAA77453.1__ColG (wt)
ggggcgcugccuacggagguggcagccaucuccuucucggcaucaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2592 - RNA, 3739 nt, Artificial Sequence
  mRNA product Design2 comprising derived and/or modified sequence from Clostridium histolyticum__BAA77453.1__ColG (wt)
ggggcgcugccuacggagguggcagccaucuccuucucggcaucaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2593 - RNA, 3463 nt, Artificial Sequence
  mRNA product Design2 comprising derived and/or modified sequence from Clostridium histolyticum__BAA77453.1__HsALB(1-18)_ColG(111-1118) (wt)
ggggcgcugccuacggagguggcagccaucuccuucucggcaucaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2594 - RNA, 3463 nt, Artificial Sequence
  mRNA product Design2 comprising derived and/or modified sequence from Clostridium histolyticum__BAA77453.1__HsALB(1-18)_ColG(111-1118) (wt)
ggggcgcugccuacggagguggcagccaucuccuucucggcaucaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2595 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (wt)
ggggcgcugccuacggagguggcagccaucuccuucucggcaucaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2596 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (wt)
ggggcgcugccuacggagguggcagccaucuccuucucggcaucaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2597 - RNA, 3487 nt, Artificial Sequence
  mRNA product Design2 comprising derived and/or modified sequence from Clostridium histolyticum__BAA34542.1__ColH (wt)
ggggcgcugccuacggagguggcagccaucuccuucucggcaucaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2598 - RNA, 3487 nt, Artificial Sequence
  mRNA product Design2 comprising derived and/or modified sequence from Clostridium histolyticum__BAA34542.1__ColH (wt)
ggggcgcugccuacggagguggcagccaucuccuucucggcaucaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2599 - RNA, 3448 nt, Artificial Sequence
  mRNA product Design2 comprising derived and/or modified sequence from Clostridium histolyticum__BAA34542.1__ColH (wt)
ggggcgcugccuacggagguggcagccaucuccuucucggcaucaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2600 - RNA, 3448 nt, Artificial Sequence
  mRNA product Design2 comprising derived and/or modified sequence from Clostridium histolyticum__BAA34542.1__ColH (wt)
ggggcgcugccuacggagguggcagccaucuccuucucggcaucaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2601 - RNA, 3382 nt, Artificial Sequence
  mRNA product Design2 comprising derived and/or modified sequence from Clostridium histolyticum__BAA34542.1__HsALB(1-18)_ColH(41-1021) (wt)
ggggcgcugccuacggagguggcagccaucuccuucucggcaucaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2602 - RNA, 3382 nt, Artificial Sequence
  mRNA product Design2 comprising derived and/or modified sequence from Clostridium histolyticum__BAA34542.1__HsALB(1-18)_ColH(41-1021) (wt)
ggggcgcugccuacggagguggcagccaucuccuucucggcaucaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2603 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (wt)
ggggcgcugccuacggagguggcagccaucuccuucucggcaucaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2604 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (wt)
ggggcgcugccuacggagguggcagccaucuccuucucggcaucaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2605 - RNA, 958 nt, Artificial Sequence
  mRNA product Design2 comprising derived and/or modified sequence from Homo sapiens__NP_001133.1__HsAMELX (wt)
ggggcgcugccuacggagguggcagccaucuccuucucggcaucaagcuuaccauggggaccuggauuuuauuugccugccuccugggagcagcuuuugccaugccucuaccaccucauccugggcacccugguuauaucaacuucagcuaugaggugcuuaccccuuugaagugguaccagagcauaaggccaccguacccuuccuaugguuacgagcccauggguggauggcugcaccaccaaaucauccccgugcugucccaacagcaccccccgacucacacccugcagccucaucaccacaucccaguggugccagcucagcagcccgugaucccccagcaaccaaugaugcccguuccuggccaacacuccaugacuccaauccaacaccaccagccaaaccucccuccgcccgcccagcagcccuaccagccccagccuguucagccacagccucaccagcccaugcagccccagccaccugugcaccccaugcagccccugccgccacagccaccucugccuccgauguuccccaugcagccccugccucccaugcuuccugaucugacucuggaagcuuggccaucaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2606 - RNA, 958 nt, Artificial Sequence
  mRNA product Design2 comprising derived and/or modified sequence from Homo sapiens__NP_001133.1__HsAMELX (wt)
ggggcgcugccuacggagguggcagccaucuccuucucggcaucaagcuuaccauggggaccuggauuuuauuugccugccuccugggagcagcuuuugccaugccucuaccaccucauccugggcacccugguuauaucaacuucagcuaugaggugcuuaccccuuugaagugguaccagagcauaaggccaccguacccuuccuaugguuacgagcccauggguggauggcugcaccaccaaaucauccccgugcugucccaacagcaccccccgacucacacccugcagccucaucaccacaucccaguggugccagcucagcagcccgugaucccccagcaaccaaugaugcccguuccuggccaacacuccaugacuccaauccaacaccaccagccaaaccucccuccgcccgcccagcagcccuaccagccccagccuguucagccacagccucaccagcccaugcagccccagccaccugugcaccccaugcagccccugccgccacagccaccucugccuccgauguuccccaugcagccccugccucccaugcuuccugaucugacucuggaagcauggccaucaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2607 - RNA, 517 nt, Artificial Sequence
  mRNA product Design2 comprising derived and/or modified sequence from Homo sapiens__NP_001133.1__HsAMELX-TRAP (wt)
ggggcgcugccuacggagguggcagccaucuccuucucggcaucaagcuuaccaugccucuaccaccucauccugggcacccugguuauaucaacuucagcuaugaggugcuuaccccuuugaagugguaccagagcauaaggccaccguacccuuccuaugguuacgagcccauggguggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2608 - RNA, 550 nt, Artificial Sequence
  mRNA product Design2 comprising derived and/or modified sequence from Homo sapiens__NP_001133.1__HsAMELX-LRAP (wt)
ggggcgcugccuacggagguggcagccaucuccuucucggcaucaagcuuaccaugccucuaccaccucauccugggcacccugguuauaucaacuucagcuaugaggugcuuaccccuuugaagugguaccagagcauaaggccaccucccaugcuuccugaucugacucuggaagcuuggccaucaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2609 - RNA, 550 nt, Artificial Sequence
  mRNA product Design2 comprising derived and/or modified sequence from Homo sapiens__NP_001133.1__HsAMELX-LRAP (wt)
ggggcgcugccuacggagguggcagccaucuccuucucggcaucaagcuuaccaugccucuaccaccucauccugggcacccugguuauaucaacuucagcuaugaggugcuuaccccuuugaagugguaccagagcauaaggccaccucccaugcuuccugaucugacucuggaagcauggccaucaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2610 - RNA, 589 nt, Artificial Sequence
  mRNA product Design2 comprising derived and/or modified sequence from Homo sapiens__NP_001133.1__HLA-A2-SP_HsAMELX(17-60) (wt)
ggggcgcugccuacggagguggcagccaucuccuucucggcaucaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccuuugaagugguaccagagcauaaggccaccguacccuuccuaugguuacgagcccauggguggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2611 - RNA, 622 nt, Artificial Sequence
  mRNA product Design2 comprising derived and/or modified sequence from Homo sapiens__NP_001133.1__HLA-A2-SP_HsAMELX(17-47,168-191) (wt)
ggggcgcugccuacggagguggcagccaucuccuucucggcaucaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccuuugaagugguaccagagcauaaggccaccucccaugcuuccugaucugacucuggaagcauggccaucaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2612 - RNA, 961 nt, Artificial Sequence
  mRNA product Design2 comprising derived and/or modified sequence from Homo sapiens__NP_001134.1__HsAMELY (wt)
ggggcgcugccuacggagguggcagccaucuccuucucggcaucaagcuuaccauggggaccuggauuuuguuugccugccuugugggagcagcuuuugccaugccucuaccaccucauccugggcacccugguuauaucaacuucagcuaugaggugcucaccccuuugaagugguaccagagcaugauaagaccaccauacucuuccuaugguuacgagcccauggguggauggcugcaccaccaaaucauccccguggugucccaacagcacccccugacucacacccugcagucucaucaccacaucccaguggugccagcucagcagcccaggguccgccagcaagcacugaugccuguuccuggccagcaauccaugacuccaacccaacaccaucagccaaaccucccucugccugcccagcagcccuuccagccccagccuguucagccacagccucaccagcccaugcagccccagccaccugugcaacccaugcagccccugcugccacagccaccucugccuccaauguucccccugcggccccugccccccauacuuccugaucugcaucuggaagcuuggccagcaacagacaagaccaagcaggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2613 - RNA, 961 nt, Artificial Sequence
  mRNA product Design2 comprising derived and/or modified sequence from Homo sapiens__NP_001134.1__HsAMELY (wt)
ggggcgcugccuacggagguggcagccaucuccuucucggcaucaagcuuaccauggggaccuggauuuuguuugccugccuugugggagcagcuuuugccaugccucuaccaccucauccugggcacccugguuauaucaacuucagcuaugaggugcucaccccuuugaagugguaccagagcaugauaagaccaccauacucuuccuaugguuacgagcccauggguggauggcugcaccaccaaaucauccccguggugucccaacagcacccccugacucacacccugcagucucaucaccacaucccaguggugccagcucagcagcccaggguccgccagcaagcacugaugccuguuccuggccagcaauccaugacuccaacccaacaccaucagccaaaccucccucugccugcccagcagcccuuccagccccagccuguucagccacagccucaccagcccaugcagccccagccaccugugcaacccaugcagccccugcugccacagccaccucugccuccaauguucccccugcggccccugccccccauacuuccugaucugcaucuggaagcauggccagcaacagacaagaccaagcaggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2614 - RNA, 520 nt, Artificial Sequence
  mRNA product Design2 comprising derived and/or modified sequence from Homo sapiens__NP_001134.1__HsAMELY-TRAP (wt)
ggggcgcugccuacggagguggcagccaucuccuucucggcaucaagcuuaccaugccucuaccaccucauccugggcacccugguuauaucaacuucagcuaugaggugcucaccccuuugaagugguaccagagcaugauaagaccaccauacucuuccuaugguuacgagcccauggguggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2615 - RNA, 553 nt, Artificial Sequence
  mRNA product Design2 comprising derived and/or modified sequence from Homo sapiens__NP_001134.1__HsAMELY-LRAP (wt)
ggggcgcugccuacggagguggcagccaucuccuucucggcaucaagcuuaccaugccucuaccaccucauccugggcacccugguuauaucaacuucagcuaugaggugcucaccccuuugaagugguaccagagcaugauaagaccaccccccauacuuccugaucugcaucuggaagcuuggccagcaacagacaagaccaagcaggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2616 - RNA, 553 nt, Artificial Sequence
  mRNA product Design2 comprising derived and/or modified sequence from Homo sapiens__NP_001134.1__HsAMELY-LRAP (wt)
ggggcgcugccuacggagguggcagccaucuccuucucggcaucaagcuuaccaugccucuaccaccucauccugggcacccugguuauaucaacuucagcuaugaggugcucaccccuuugaagugguaccagagcaugauaagaccaccccccauacuuccugaucugcaucuggaagcauggccagcaacagacaagaccaagcaggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2617 - RNA, 592 nt, Artificial Sequence
  mRNA product Design2 comprising derived and/or modified sequence from Homo sapiens__NP_001134.1__HLA-A2-SP_HsAMELY(17-61) (wt)
ggggcgcugccuacggagguggcagccaucuccuucucggcaucaagcuuaccauggccgucauggcgccccgaacccucguccugcuacucucgggggcucuggcccugacccagaccugggcgaugccucuaccaccucauccugggcacccugguuauaucaacuucagcuaugaggugcucaccccuuugaagugguaccagagcaugauaagaccaccauacucuuccuaugguuacgagcccauggguggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2618 - RNA, 625 nt, Artificial Sequence
  mRNA product Design2 comprising derived and/or modified sequence from Homo sapiens__NP_001134.1__HLA-A2-SP_HsAMELY(17-48,169-192) (wt)
ggggcgcugccuacggagguggcagccaucuccuucucggcaucaagcuuaccauggccgucauggcgccccgaacccucguccugcuacucucgggggcucuggcccugacccagaccugggcgaugccucuaccaccucauccugggcacccugguuauaucaacuucagcuaugaggugcucaccccuuugaagugguaccagagcaugauaagaccaccccccauacuuccugaucugcaucuggaagcauggccagcaacagacaagaccaagcaggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2619 - RNA, 952 nt, Artificial Sequence
  mRNA product Design2 comprising derived and/or modified sequence from Sus scrofa__NP_999071.1__SsAMELX-001-1 (wt)
ggggcgcugccuacggagguggcagccaucuccuucucggcaucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2620 - RNA, 952 nt, Artificial Sequence
  mRNA product Design2 comprising derived and/or modified sequence from Sus scrofa__NP_999071.1__SsAMELX-001-1 (wt)
ggggcgcugccuacggagguggcagccaucuccuucucggcaucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2621 - RNA, 520 nt, Artificial Sequence
  mRNA product Design2 comprising derived and/or modified sequence from Sus scrofa__NP_999071.1__SsAMELX-TRAP (wt)
ggggcgcugccuacggagguggcagccaucuccuucucggcaucaagcuuaccaugccucuaccaccucauccugggcacccugguuauaucaacuucagcuaugaggugcuuaccccucugaagugguaccagaacaugauaagacauccguacacuuccuauggguacgaacccauggguggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2622 - RNA, 553 nt, Artificial Sequence
  mRNA product Design2 comprising derived and/or modified sequence from Sus scrofa__NP_999071.1__SsAMELX-LRAP (wt)
ggggcgcugccuacggagguggcagccaucuccuucucggcaucaagcuuaccaugccucuaccaccucauccugggcacccugguuauaucaacuucagcuaugaggugcuuaccccucugaagugguaccagaacaugauaagacauccgucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2623 - RNA, 553 nt, Artificial Sequence
  mRNA product Design2 comprising derived and/or modified sequence from Sus scrofa__NP_999071.1__SsAMELX-LRAP (wt)
ggggcgcugccuacggagguggcagccaucuccuucucggcaucaagcuuaccaugccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2624 - RNA, 592 nt, Artificial Sequence
  mRNA product Design2 comprising derived and/or modified sequence from Sus scrofa__NP_999071.1__HLA-A2-SP_SsAMEL(17-61) (wt)
ggggcgcugccuacggagguggcagccaucuccuucucggcaucaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccucugaagugguaccagaacaugauaagacauccguacacuuccuauggguacgaacccauggguggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2625 - RNA, 625 nt, Artificial Sequence
  mRNA product Design2 comprising derived and/or modified sequence from Sus scrofa__NP_999071.1__HLA-A2-SP_SsAMEL(17-49,167-189) (wt)
ggggcgcugccuacggagguggcagccaucuccuucucggcaucaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2626 - RNA, 916 nt, Artificial Sequence
  mRNA product Design2 comprising derived and/or modified sequence from Sus scrofa__P45561-2__SsAMELX-001-2 (wt)
ggggcgcugccuacggagguggcagccaucuccuucucggcaucaagcuuaccauggggaccuggauuuuguuugcuugccuccugggagcagccuucucuaugccucuaccaccucauccugggcacccugguuauaucaacuucagcuauauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2627 - RNA, 952 nt, Artificial Sequence
  mRNA product Design2 comprising derived and/or modified sequence from Sus scrofa__NP_998965.1__SsAMELX-001-3 (wt)
ggggcgcugccuacggagguggcagccaucuccuucucggcaucaagcuuaccauggggaccuggauuuucuuugccugccuuuugggagcaucccuugcuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2628 - RNA, 601 nt, Artificial Sequence
  mRNA product Design2 comprising derived and/or modified sequence from Sus scrofa__K7GPB2__SsAMELX-002 (wt)
ggggcgcugccuacggagguggcagccaucuccuucucggcaucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2629 - RNA, 994 nt, Artificial Sequence
  mRNA product Design2 comprising derived and/or modified sequence from Sus scrofa__K7GLD0__SsAMELX-003 (wt)
ggggcgcugccuacggagguggcagccaucuccuucucggcaucaagcuuaccauggggaccuggauuuuguuugcuugccuccugggagcagccuucucuaugccucuaccaccucauccugggcacccugguuauaucaacuucagcuaugaggacuuauacuuggaggcuauccguauugacaggacugcauucgugcuuaccccucugaagugguaccagaacaugauaagacauccguacacuuccuaugguuacgaacccauggguggauggcugcaccaccaaaucauucccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2630 - RNA, 880 nt, Artificial Sequence
  mRNA product Design2 comprising derived and/or modified sequence from Sus scrofa__K7GPE9__SsAMELX-004 (wt)
ggggcgcugccuacggagguggcagccaucuccuucucggcaucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2631 - RNA, 904 nt, Artificial Sequence
  mRNA product Design2 comprising derived and/or modified sequence from Sus scrofa__J9JIM4__SsAMELX-201 (wt)
ggggcgcugccuacggagguggcagccaucuccuucucggcaucaagcuuaccaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2632 - RNA, 3343 nt, Artificial Sequence
  mRNA product Design2 comprising derived and/or modified sequence from Homo sapiens__NP_006120.1__HsBMP1 (wt)
ggggcgcugccuacggagguggcagccaucuccuucucggcaucaagcuuaccaugcccggcguggcccgccugccgcugcugcucgggcugcugcugcucccgcgucccggccggccgcuggacuuggccgacuacaccuaugaccuggcggaggaggacgacucggagccccucaacuacaaagaccccugcaaggcggcugccuuucuuggggacauugcccuggacgaagaggaccugagggccuuccagguacagcaggcuguggaucucagacggcacacagcucguaaguccuccaucaaagcugcaguuccaggaaacacuucuacccccagcugccagagcaccaacgggcagccucagaggggagccugugggagauggagagguagaucccguagccggcgggcggcgacgucccgaccagagcguguguggcccgauggggucauccccuuugucauugggggaaacuucacugguagccagagggcagucuuccggcaggccaugaggcacugggagaagcacaccugugucaccuuccuggagcgcacugacgaggacagcuauauuguguucaccuaucgaccuugcgggugcugcuccuacgugggucgccgcggcgggggcccccaggccaucuccaucggcaagaacugugacaaguucggcauugugguccacgagcugggccacgucgucggcuucuggcacgaacacacucggccagaccgggaccgccacguuuccaucguucgugagaacauccagccagggcaggaguauaacuuccugaagauggagccucaggagguggagucccugggggagaccuaugacuucgacagcaucaugcauuacgcucggaacacauucuccaggggcaucuuccuggauaccauuguccccaaguaugaggugaacggggugaaaccucccauuggccaaaggacacggcucagcaagggggacauugcccaagcccgcaagcuuuacaagugcccagccuguggagagacccugcaagacagcacaggcaacuucuccuccccugaauaccccaauggcuacucugcucacaugcacugcguguggcgcaucucugucacacccggggagaagaucauccugaacuucacgucccuggaccuguaccgcagccgccugugcugguacgacuauguggagguccgagauggcuucuggaggaaggcgccccuccgaggccgcuucugcggguccaaacucccugagccuaucgucuccacugacagccgccucuggguugaauuccgcagcagcagcaauuggguuggaaagggcuucuuugcagucuacgaagccaucugcgggggugaugugaaaaaggacuauggccacauucaaucgcccaacuacccagacgauuaccggcccagcaaagucugcaucuggcggauccaggugucugagggcuuccacgugggccucacauuccaguccuuugagauugagcgccacgacagcugugccuacgacuaucuggaggugcgcgacgggcacagugagagcagcacccucaucgggcgcuacuguggcuaugagaagccugaugacaucaagagcacguccagccgccucuggcucaaguucgucucugacggguccauuaacaaagcgggcuuugccgucaacuuuuucaaagagguggacgagugcucucggcccaaccgcgggggcugugagcagcggugccucaacacccugggcagcuacaagugcagcugugaccccggguacgagcuggccccagacaagcgccgcugugaggcugcuuguggcggauuccucaccaagcucaacggcuccaucaccagcccgggcuggcccaaggaguacccccccaacaagaacugcaucuggcagcugguggcccccacccaguaccgcaucucccugcaguuugacuucuuugagacagagggcaaugaugugugcaaguacgacuucguggaggugcgcaguggacucacagcugacuccaagcugcauggcaaguucugugguucugagaagcccgaggucaucaccucccaguacaacaacaugcgcguggaguucaaguccgacaacaccguguccaaaaagggcuucaaggcccacuucuucucagacaaggacgagugcuccaaggauaacggcggcugccagcaggacugcgucaacacguucggcaguuaugagugccaaugccgcaguggcuucguccuccaugacaacaagcacgacugcaaagaagccggcugugaccacaaggugacauccaccagugguaccaucaccagccccaacuggccugacaaguaucccagcaagaaggagugcacgugggccaucuccagcacccccgggcaccgggucaagcugaccuucauggagauggacaucgagucccagccugagugugccuacgaccaccuagagguguucgacgggcgagacgccaaggcccccguccucggccgcuucugugggagcaagaagcccgagcccguccuggccacaggcagccgcauguuccugcgcuucuacucagauaacucgguccagcgaaagggcuuccaggccucccacgccacagagugcgggggccagguacgggcagacgugaagaccaaggaccuuuacucccacgcccaguuuggcgacaacaacuacccuggggguguggacugugagugggucauuguggccgaggaaggcuacggcguggagcucguguuccagaccuuugagguggaggaggagaccgacugcggcuaugacuacauggagcucuucgacggcuacgacagcacagcccccaggcuggggcgcuacuguggcucagggccuccugaggagguguacucggcgggagauucuguccuggugaaguuccacucggaugacaccaucaccaaaaaagguuuccaccugcgauacaccagcaccaaguuccaggacacacuccacagcaggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2633 - RNA, 1573 nt, Artificial Sequence
  mRNA product Design2 comprising derived and/or modified sequence from Homo sapiens__NP_001191.1__HsBMP2 (wt)
ggggcgcugccuacggagguggcagccaucuccuucucggcaucaagcuuaccaugguggccgggacccgcugucuucuagcguugcugcuuccccagguccuccugggcggcgcggcuggccucguuccggagcugggccgcaggaaguucgcggcggcgucgucgggccgccccucaucccagcccucugacgagguccugagcgaguucgaguugcggcugcucagcauguucggccugaaacagagacccacccccagcagggacgccguggugccccccuacaugcuagaccuguaucgcaggcacucaggucagccgggcucacccgccccagaccaccgguuggagagggcagccagccgagccaacacugugcgcagcuuccaccaugaagaaucuuuggaagaacuaccagaaacgagugggaaaacaacccggagauucuucuuuaauuuaaguucuauccccacggaggaguuuaucaccucagcagagcuucagguuuuccgagaacagaugcaagaugcuuuaggaaacaauagcaguuuccaucaccgaauuaauauuuaugaaaucauaaaaccugcaacagccaacucgaaauuccccgugaccagacuuuuggacaccagguuggugaaucagaaugcaagcaggugggaaaguuuugaugucacccccgcugugaugcgguggacugcacagggacacgccaaccauggauucgugguggaaguggcccacuuggaggagaaacaaggugucuccaagagacauguuaggauaagcaggucuuugcaccaagaugaacacagcuggucacagauaaggccauugcuaguaacuuuuggccaugauggaaaagggcauccucuccacaaaagagaaaaacgucaagccaaacacaaacagcggaaacgccuuaaguccagcuguaagagacacccuuuguacguggacuucagugacgugggguggaaugacuggauuguggcucccccgggguaucacgccuuuuacugccacggagaaugcccuuuuccucuggcugaucaucugaacuccacuaaucaugccauuguucagacguuggucaacucuguuaacucuaagauuccuaaggcaugcugugucccgacagaacucagugcuaucucgaugcuguaccuugacgagaaugaaaagguuguauuaaagaacuaucaggacaugguuguggaggguugugggugucgcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2634 - RNA, 1609 nt, Artificial Sequence
  mRNA product Design2 comprising derived and/or modified sequence from Homo sapiens__NP_001193.2__HsBMP4 (wt)
ggggcgcugccuacggagguggcagccaucuccuucucggcaucaagcuuaccaugauuccugguaaccgaaugcugauggucguuuuauuaugccaaguccugcuaggaggcgcgagccaugcuaguuugauaccugagacggggaagaaaaaagucgccgagauucagggccacgcgggaggacgccgcucagggcagagccaugagcuccugcgggacuucgaggcgacacuucugcagauguuugggcugcgccgccgcccgcagccuagcaagagugccgucauuccggacuacaugcgggaucuuuaccggcuucagucuggggaggaggaggaagagcagauccacagcacuggucuugaguauccugagcgcccggccagccgggccaacaccgugaggagcuuccaccacgaagaacaucuggagaacaucccagggaccagugaaaacucugcuuuucguuuccucuuuaaccucagcagcaucccugagaacgaggugaucuccucugcagagcuucggcucuuccgggagcagguggaccagggcccugauugggaaaggggcuuccaccguauaaacauuuaugagguuaugaagcccccagcagaaguggugccugggcaccucaucacacgacuacuggacacgagacugguccaccacaaugugacacggugggaaacuuuugaugugagcccugcgguccuucgcuggacccgggagaagcagccaaacuaugggcuagccauugaggugacucaccuccaucagacucggacccaccagggccagcaugucaggauuagccgaucguuaccucaagggagugggaauugggcccagcuccggccccuccuggucaccuuuggccaugauggccggggccaugccuugacccgacgccggagggccaagcguagcccuaagcaucacucacagcgggccaggaagaagaauaagaacugccggcgccacucgcucuauguggacuucagcgaugugggcuggaaugacuggauuguggccccaccaggcuaccaggccuucuacugccauggggacugccccuuuccacuggcugaccaccucaacucaaccaaccaugccauugugcagacccuggucaauucugucaauuccaguauccccaaagccuguugugugcccacugaacugagugccaucuccaugcuguaccuggaugaguaugauaaggugguacugaaaaauuaucaggagaugguaguagagggaugugggugccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2635 - RNA, 1924 nt, Artificial Sequence
  mRNA product Design2 comprising derived and/or modified sequence from Homo sapiens__NP_001709.1__HsBMP6 (wt)
ggggcgcugccuacggagguggcagccaucuccuucucggcaucaagcuuaccaugccggggcuggggcggagggcgcaguggcugugcugguggugggggcugcugugcagcugcugcgggcccccgccgcugcggccgcccuugcccgcugccgcggccgccgccgccggggggcagcugcugggggacggcgggagccccggccgcacggagcagccgccgccgucgccgcaguccuccucgggcuuccuguaccggcggcucaagacgcaggagaagcgggagaugcagaaggagaucuugucggugcuggggcucccgcaccggccccggccccugcacggccuccaacagccgcagcccccggcgcuccggcagcaggaggagcagcagcagcagcagcagcugccucgcggagagcccccucccgggcgacugaaguccgcgccccucuucaugcuggaucuguacaacgcccuguccgccgacaacgacgaggacggggcgucggagggggagaggcagcaguccuggccccacgaagcagccagcucgucccagcgucggcagccgcccccgggcgccgcgcacccgcucaaccgcaagagccuucuggcccccggaucuggcagcggcggcgcguccccacugaccagcgcgcaggacagcgccuuccucaacgacgcggacauggucaugagcuuugugaaccugguggaguacgacaaggaguucuccccucgucagcgacaccacaaagaguucaaguucaacuuaucccagauuccugagggugagguggugacggcugcagaauuccgcaucuacaaggacuguguuauggggaguuuuaaaaaccaaacuuuucuuaucagcauuuaucaagucuuacaggagcaucagcacagagacucugaccuguuuuuguuggacacccguguaguaugggccucagaagaaggcuggcuggaauuugacaucacggccacuagcaaucuguggguugugacuccacagcauaacauggggcuucagcugagcguggugacaagggauggaguccacguccacccccgagccgcaggccuggugggcagagacggcccuuacgacaagcagcccuucaugguggcuuucuucaaagugagugaggugcacgugcgcaccaccaggucagccuccagccggcgccgacaacagagucguaaucgcucuacccagucccaggacguggcgcgggucuccagugcuucagauuacaacagcagugaauugaaaacagccugcaggaagcaugagcuguaugugaguuuccaagaccugggauggcaggacuggaucauugcacccaagggcuaugcugccaauuacugugauggagaaugcuccuucccacucaacgcacacaugaaugcaaccaaccacgcgauugugcagaccuugguucaccuuaugaaccccgaguauguccccaaaccgugcugugcgccaacuaagcuaaaugccaucucgguucuuuacuuugaugacaacuccaaugucauucugaaaaaauacaggaauaugguuguaagagcuuguggaugccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2636 - RNA, 1678 nt, Artificial Sequence
  mRNA product Design2 comprising derived and/or modified sequence from Homo sapiens__NP_001710.1__HsBMP7 (wt)
ggggcgcugccuacggagguggcagccaucuccuucucggcaucaagcuuaccaugcacgugcgcucacugcgagcugcggcgccgcacagcuucguggcgcucugggcaccccuguuccugcugcgcuccgcccuggccgacuucagccuggacaacgaggugcacucgagcuucauccaccggcgccuccgcagccaggagcggcgggagaugcagcgcgagauccucuccauuuugggcuugccccaccgcccgcgcccgcaccuccagggcaagcacaacucggcacccauguucaugcuggaccuguacaacgccauggcgguggaggagggcggcgggcccggcggccagggcuucuccuaccccuacaaggccgucuucaguacccagggccccccucuggccagccugcaagauagccauuuccucaccgacgccgacauggucaugagcuucgucaaccucguggaacaugacaaggaauucuuccacccacgcuaccaccaucgagaguuccgguuugaucuuuccaagaucccagaaggggaagcugucacggcagccgaauuccggaucuacaaggacuacauccgggaacgcuucgacaaugagacguuccggaucagcguuuaucaggugcuccaggagcacuugggcagggaaucggaucucuuccugcucgacagccguacccucugggccucggaggagggcuggcugguguuugacaucacagccaccagcaaccacuggguggucaauccgcggcacaaccugggccugcagcucucgguggagacgcuggaugggcagagcaucaaccccaaguuggcgggccugauugggcggcacgggccccagaacaagcagcccuucaugguggcuuucuucaaggccacggagguccacuuccgcagcauccgguccacggggagcaaacagcgcagccagaaccgcuccaagacgcccaagaaccaggaagcccugcggauggccaacguggcagagaacagcagcagcgaccagaggcaggccuguaagaagcacgagcuguaugucagcuuccgagaccugggcuggcaggacuggaucaucgcgccugaaggcuacgccgccuacuacugugagggggagugugccuucccucugaacuccuacaugaacgccaccaaccacgccaucgugcagacgcugguccacuucaucaacccggaaacggugcccaagcccugcugugcgcccacgcagcucaaugccaucuccguccucuacuucgaugacagcuccaacgucauccugaagaaauacagaaacauggugguccgggccuguggcugccacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2637 - RNA, 682 nt, Artificial Sequence
  mRNA product Design2 comprising derived and/or modified sequence from Homo sapiens__NP_006264.2__HsCCL7 (wt)
ggggcgcugccuacggagguggcagccaucuccuucucggcaucaagcuuaccaugaaagccucugcagcacuucugugucugcugcucacagcagcugcuuucagcccccaggggcuugcucagccaguugggauuaauacuucaacuaccugcugcuacagauuuaucaauaagaaaaucccuaagcagaggcuggagagcuacagaaggaccaccaguagccacuguccccgggaagcuguaaucuucaagaccaaacuggacaaggagaucugugcugaccccacacagaaguggguccaggacuuuaugaagcaccuggacaagaaaacccaaacuccaaagcuuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2638 - RNA, 4006 nt, Artificial Sequence
  mRNA product Design2 comprising derived and/or modified sequence from Homo sapiens__NP_001954.2__HsEGF (wt)
ggggcgcugccuacggagguggcagccaucuccuucucggcaucaagcuuaccaugcugcucacucuuaucauucuguugccaguaguuucaaaauuuaguuuuguuagucucucagcaccgcagcacuggagcuguccugaagguacucucgcaggaaaugggaauucuacuuguguggguccugcacccuucuuaauuuucucccauggaaauaguaucuuuaggauugacacagaaggaaccaauuaugagcaauuggugguggaugcuggugucucagugaucauggauuuucauuauaaugagaaaagaaucuauuggguggauuuagaaagacaacuuuugcaaagaguuuuucugaaugggucaaggcaagagagaguauguaauauagagaaaaauguuucuggaauggcaauaaauuggauaaaugaagaaguuauuuggucaaaucaacaggaaggaaucauuacaguaacagauaugaaaggaaauaauucccacauucuuuuaagugcuuuaaaauauccugcaaauguagcaguugauccaguagaaagguuuauauuuuggucuucagagguggcuggaagccuuuauagagcagaucucgauggugugggagugaaggcucuguuggagacaucagagaaaauaacagcugugucauuggaugugcuugauaagcggcuguuuuggauucaguacaacagagaaggaagcaauucucuuauuugcuccugugauuaugauggagguucuguccacauuaguaaacauccaacacagcauaauuuguuugcaaugucccuuuuuggugaccguaucuucuauucaacauggaaaaugaagacaauuuggauagccaacaaacacacuggaaaggacaugguuagaauuaaccuccauucaucauuuguaccacuuggugaacugaaaguagugcauccacuugcacaacccaaggcagaagaugacacuugggagccugagcagaaacuuugcaaauugaggaaaggaaacugcagcagcacugugugugggcaagaccuccagucacacuugugcaugugugcagagggauacgcccuaagucgagaccggaaguacugugaagauguuaaugaaugugcuuuuuggaaucauggcuguacucuuggguguaaaaacaccccuggauccuauuacugcacgugcccuguaggauuuguucugcuuccugaugggaaacgaugucaucaacuuguuuccuguccacgcaaugugucugaaugcagccaugacuguguucugacaucagaaggucccuuauguuucuguccugaaggcucagugcuugagagagaugggaaaacauguagcgguuguuccucacccgauaaugguggauguagccagcucugcguuccucuuagcccaguauccugggaaugugauugcuuuccuggguaugaccuacaacuggaugaaaaaagcugugcagcuucaggaccacaaccauuuuugcuguuugccaauucucaagauauucgacacaugcauuuugauggaacagacuauggaacucugcucagccagcagaugggaaugguuuaugcccuagaucaugacccuguggaaaauaagauauacuuugcccauacagcccugaaguggauagagagagcuaauauggaugguucccagcgagaaaggcuuauugaggaaggaguagaugugccagaaggucuugcuguggacuggauuggccguagauucuauuggacagacagagggaaaucucugauuggaaggagugauuuaaaugggaaacguuccaaaauaaucacuaaggagaacaucucucaaccacgaggaauugcuguucauccaauggccaagagauuauucuggacugauacagggauuaauccacgaauugaaaguucuucccuccaaggccuuggccgucugguuauagccagcucugaucuaaucuggcccaguggaauaacgauugacuucuuaacugacaaguuguacuggugcgaugccaagcagucugugauugaaauggccaaucuggaugguucaaaacgccgaagacuuacccagaaugauguaggucacccauuugcuguagcaguguuugaggauuaugugugguucucagauugggcuaugccaucaguaaugagaguaaacaagaggacuggcaaagauagaguacgucuccaaggcagcaugcugaagcccucaucacugguugugguucauccauuggcaaaaccaggagcagaucccugcuuauaucaaaacggaggcugugaacauauuugcaaaaagaggcuuggaacugcuugguguucgugucgugaagguuuuaugaaagccucagaugggaaaacgugucuggcucuggauggucaucagcuguuggcagguggugaaguugaucuaaagaaccaaguaacaccauuggacaucuuguccaagacuagagugucagaagauaacauuacagaaucucaacacaugcuaguggcugaaaucauggugucagaucaagaugacugugcuccugugggaugcagcauguaugcucgguguauuucagagggagaggaugccacaugucaguguuugaaaggauuugcuggggauggaaaacuauguucugauauagaugaaugugagaugggugucccagugugccccccugccuccuccaagugcaucaacaccgaaggugguuaugucugccggugcucagaaggcuaccaaggagaugggauucacugucuugauauugaugagugccaacugggggagcacagcuguggagagaaugccagcugcacaaauacagagggaggcuauaccugcaugugugcuggacgccugucugaaccaggacugauuugcccugacucuacuccacccccucaccucagggaagaugaccaccacuauuccguaagaaauagugacucugaauguccccugucccacgauggguacugccuccaugauggugugugcauguauauugaagcauuggacaaguaugcaugcaacuguguuguuggcuacaucggggagcgaugucaguaccgagaccugaaguggugggaacugcgccacgcuggccacgggcagcagcagaaggucaucgugguggcugucugcgugguggugcuugucaugcugcuccuccugagccuguggggggcccacuacuacaggacucagaagcugcuaucgaaaaacccaaagaauccuuaugaggagucgagcagagaugugaggagucgcaggccugcugacacugaggaugggauguccucuugcccucaaccuugguuugugguuauaaaagaacaccaagaccucaagaaugggggucaaccaguggcuggugaggauggccaggcagcagaugggucaaugcaaccaacuucauggaggcaggagccccaguuauguggaaugggcacagagcaaggcugcuggauuccaguauccagugauaagggcuccuguccccagguaauggagcgaagcuuucauaugcccuccuaugggacacagacccuugaagggggugucgagaagccccauucucuccuaucagcuaacccauuauggcaacaaagggcccuggacccaccacaccaaauggagcugacucagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2639 - RNA, 892 nt, Artificial Sequence
  mRNA product Design2 comprising derived and/or modified sequence from Homo sapiens__NP_001423.1__HsEREG (wt)
ggggcgcugccuacggagguggcagccaucuccuucucggcaucaagcuuaccaugaccgcggggaggaggauggagaugcucugugccggcagggucccugcgcugcugcucugccuggguuuccaucuucuacaggcaguccucaguacaacugugauuccaucauguaucccaggagaguccagugauaacugcacagcuuuaguucagacagaagacaauccacguguggcucaagugucaauaacaaaguguagcucugacaugaauggcuauuguuugcauggacagugcaucuaucugguggacaugagucaaaacuacugcaggugugaaguggguuauacugguguccgaugugaacacuucuuuuuaaccguccaccaaccuuuaagcaaagaauauguggcuuugaccgugauucuuauuauuuuguuucuuaucacagucgucgguuccacauauuauuucugcagaugguacagaaaucgaaaaaguaaagaaccaaagaaggaauaugagagaguuaccucaggggauccagaguugccgcaagucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2640 - RNA, 850 nt, Artificial Sequence
  mRNA product Design2 comprising derived and/or modified sequence from Homo sapiens__NP_000791.1__HsFGF1 (wt)
ggggcgcugccuacggagguggcagccaucuccuucucggcaucaagcuuaccauggcugaaggggaaaucaccaccuucacagcccugaccgagaaguuuaaucugccuccagggaauuacaagaagcccaaacuccucuacuguagcaacgggggccacuuccugaggauccuuccggauggcacaguggaugggacaagggacaggagcgaccagcacauucagcugcagcucagugcggaaagcgugggggagguguauauaaagaguaccgagacuggccaguacuuggccauggacaccgacgggcuuuuauacggcucacagacaccaaaugaggaauguuuguuccuggaaaggcuggaggagaaccauuacaacaccuauauauccaagaagcaugcagagaagaauugguuuguuggccucaagaagaaugggagcugcaaacgcgguccucggacucacuauggccagaaagcaaucuuguuucucccccugccagucucuucugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2641 - RNA, 1249 nt, Artificial Sequence
  mRNA product Design2 comprising derived and/or modified sequence from Homo sapiens__NP_001997.5__HsFGF2 (wt)
ggggcgcugccuacggagguggcagccaucuccuucucggcaucaagcuuaccauggugggugugggggguggagauguagaagaugugacgccgcggcccggcgggugccagauuagcggacgcggugcccgcgguugcaacgggaucccgggcgcugcagcuugggaggcggcucuccccaggcggcguccgcggagacacccauccgugaaccccaggucccgggccgccggcucgccgcgcaccaggggccggcggacagaagagcggccgagcggcucgaggcugggggaccgcgggcgcggccgcgcgcugccgggcgggaggcuggggggccggggccggggccgugccccggagcgggucggaggccggggccggggccgggggacggcggcuccccgcgcggcuccagcggcucggggaucccggccgggccccgcagggaccauggcagccgggagcaucaccacgcugcccgccuugcccgaggauggcggcagcggcgccuucccgcccggccacuucaaggaccccaagcggcuguacugcaaaaacgggggcuucuuccugcgcauccaccccgacggccgaguugacgggguccgggagaagagcgacccucacaucaagcuacaacuucaagcagaagagagaggaguugugucuaucaaaggagugugugcuaaccguuaccuggcuaugaaggaagauggaagauuacuggcuucuaaauguguuacggaugaguguuucuuuuuugaacgauuggaaucuaauaacuacaauacuuaccggucaaggaaauacaccaguugguauguggcacugaaacgaacugggcaguauaaacuuggauccaaaacaggaccugggcagaaagcuauacuuuuucuuccaaugucugcuaagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2642 - RNA, 967 nt, Artificial Sequence
  mRNA product Design2 comprising derived and/or modified sequence from Homo sapiens__NP_002000.1__HsFGF7 (wt)
ggggcgcugccuacggagguggcagccaucuccuucucggcaucaagcuuaccaugcacaaauggauacugacauggauccugccaacuuugcucuacagaucaugcuuucacauuaucugucuaguggguacuauaucuuuagcuugcaaugacaugacuccagagcaaauggcuacaaaugugaacuguuccagcccugagcgacacacaagaaguuaugauuacauggaaggaggggauauaagagugagaagacucuucugucgaacacagugguaccugaggaucgauaaaagaggcaaaguaaaagggacccaagagaugaagaauaauuacaauaucauggaaaucaggacaguggcaguuggaauuguggcaaucaaagggguggaaagugaauucuaucuugcaaugaacaaggaaggaaaacucuaugcaaagaaagaaugcaaugaagauuguaacuucaaagaacuaauucuggaaaaccauuacaacacauaugcaucagcuaaauggacacacaacggaggggaaauguuuguugccuuaaaucaaaaggggauuccuguaagaggaaaaaaaacgaagaaagaacaaaaaacagcccacuuucuuccuauggcaauaacuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2643 - RNA, 1009 nt, Artificial Sequence
  mRNA product Design2 comprising derived and/or modified sequence from Homo sapiens__NP_001936.1__HsHBEGF (wt)
ggggcgcugccuacggagguggcagccaucuccuucucggcaucaagcuuaccaugaagcugcugccgucgguggugcugaagcucuuucuggcugcaguucucucggcacuggugacuggcgagagccuggagcggcuucggagagggcuagcugcuggaaccagcaacccggacccucccacuguauccacggaccagcugcuaccccuaggaggcggccgggaccggaaaguccgugacuugcaagaggcagaucuggaccuuuugagagucacuuuauccuccaagccacaagcacuggccacaccaaacaaggaggagcacgggaaaagaaagaagaaaggcaaggggcuagggaagaagagggacccaugucuucggaaauacaaggacuucugcauccauggagaaugcaaauaugugaaggagcuccgggcucccuccugcaucugccacccggguuaccauggagagaggugucaugggcugagccucccaguggaaaaucgcuuauauaccuaugaccacacaaccauccuggccgugguggcuguggugcugucaucugucugucugcuggucaucguggggcuucucauguuuagguaccauaggagaggagguuaugauguggaaaaugaagagaaagugaaguugggcaugacuaauucccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2644 - RNA, 2569 nt, Artificial Sequence
  mRNA product Design2 comprising derived and/or modified sequence from Homo sapiens__NP_000592.3__HsHGF (wt)
ggggcgcugccuacggagguggcagccaucuccuucucggcaucaagcuuaccaugugggugaccaaacuccugccagcccugcugcugcagcauguccuccugcaucuccuccugcuccccaucgccauccccuaugcagagggacaaaggaaaagaagaaauacaauucaugaauucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaauuccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcuuggcuuggaauucaugauguccacggaagaggagaugagaaaugcaaacagguucucaauguuucccagcugguauauggcccugaaggaucagaucugguuuuaaugaagcuugccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2645 - RNA, 2308 nt, Artificial Sequence
  mRNA product Design2 comprising derived and/or modified sequence from Homo sapiens__NP_005336.3 __HsHSPA1A (wt)
ggggcgcugccuacggagguggcagccaucuccuucucggcaucaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggugagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaagagcgccguggaggaugaggggcucaagggcaagaucagcgaggcggacaagaagaaggugcuggacaagugucaagaggucaucucguggcuggacgccaacaccuuggccgagaaggacgaguuugagcacaagaggaaggagcuggagcagguguguaaccccaucaucagcggacuguaccagggugccgguggucccgggccugggggcuucggggcucagggucccaagggagggucugggucaggccccaccauugaggagguagauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2646 - RNA, 2308 nt, Artificial Sequence
  mRNA product Design2 comprising derived and/or modified sequence from Homo sapiens__NP_005337.2 __HsHSPA1B (wt)
ggggcgcugccuacggagguggcagccaucuccuucucggcaucaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggugagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaagagcgccguggaggaugaggggcucaagggcaagaucagcgaggcggacaagaagaagguucuggacaagugucaagaggucaucucguggcuggacgccaacaccuuggccgagaaggacgaguuugagcacaagaggaaggagcuggagcagguguguaaccccaucaucagcggacuguaccagggugccgguggucccgggccuggcggcuucggggcucagggucccaagggagggucugggucaggcccuaccauugaggagguggauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2647 - RNA, 2308 nt, Artificial Sequence
  mRNA product Design2 comprising derived and/or modified sequence from Homo sapiens__NP_005518.3 __HsHSPA1L (wt)
ggggcgcugccuacggagguggcagccaucuccuucucggcaucaagcuuaccauggcuacugccaagggaaucgccauaggcaucgaccugggcaccaccuacuccuguguggggguguuccagcacggcaagguggagaucaucgccaacgaccagggcaaccgcaccacccccagcuacguggccuucacagacaccgagcggcucauuggggaugcggccaagaaccagguagcaaugaauccccagaacacuguuuuugaugcuaaacgucugaucggcaggaaauuuaaugauccuguuguacaagcagauaugaaacuuuggccuuuucaagugauuaaugaaggaggcaagcccaaaguccuuguguccuacaaaggggagaauaaagcuuucuacccugaggaaaucucuucgaugguauugacuaaguugaaggagacugcugaggccuuuuugggccacccugucaccaaugcagugauuaccgugccagccuauuucaaugacucucaacgucaggcuacuaaggaugcaggugugauugcuggacuuaaugugcuaagaaucaucaaugagcccacggcugcugccauugccuaugguuuagauaaaggaggucaaggagaacgacauguccugauuuuugaucuggguggaggcacauuugaugugucaauucugaccauagaugaugggauuuuugagguaaaggccacugcuggggacacucaccuggguggggaggacuuugacaacaggcuugugagccacuucguggaggaguucaagaggaaacacaaaaaggacaucagccagaacaagcgagccgugaggcggcugcgcaccgccugcgagagggccaagaggacccugucguccagcacccaggccaaccuagaaauugauucacuuuaugaaggcauugacuucuauacauccaucaccagagcucgauuugaagaguugugugcagaccuguuuagggguacccuggagccuguagaaaaagcgcuucgggaugccaagauggauaaggcuaaaauccaugacauuguuuuaguagggggcuccacccgcauccccaaggugcagcggcugcuucaggacuacuucaauggacgugaucucaacaagagcaucaacccugaugaggccguagcauauggggcugcgguacaagcagccauccugaugggggacaagucugagaagguacaggaccugcugcugcuggacguggcuccccugucccuggggcuggagacggcugggggcgugaugacugcccugauaaagcgcaacuccaccauccccaccaagcagacacagauuuucaccaccuacucugacaaccaacccggggugcugauccagguguaugagggcgagagggccaugacaaaggacaacaaccugcuggggcgguuugaccugacuggaaucccuccagcacccaggggaguuccucagaucgaggugacguuugacauugaugccaaugguauucucaaugucacagccacggacaagagcaccggcaaggugaacaagaucaccaucaccaaugacaagggccgccugagcaaggaggagauugagcgcaugguucuggaugcugagaaauauaaagcugaagaugagguccagagggagaaaauugcugcaaagaaugccuuagaauccuaugcuuuuaacaugaagaguguugugagugaugaagguuugaagggcaagauuagugagucugauaaaaauaaaauauuggauaaaugcaacgagcuccuuucguggcuggaggucaaucaacuggcagagaaagaugaguuugaucauaagagaaaggaauuggagcagauguguaacccuaucaucacaaaacucuaccaaggaggaugcacugggccugccugcggaacaggguaugugccuggaaggccugccacaggccccacaauugaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2648 - RNA, 2302 nt, Artificial Sequence
  mRNA product Design2 comprising derived and/or modified sequence from Homo sapiens__NP_068814.2 __HsHSPA2 (wt)
ggggcgcugccuacggagguggcagccaucuccuucucggcaucaagcuuaccaugucugcccguggcccggcuaucggcaucgaccugggcaccaccuauucgugcgucggggucuuccaacauggcaagguggagaucaucgccaacgaccagggcaaucgcaccacccccagcuacguggccuucacggacaccgagcgccucaucggcgacgccgccaagaaccagguggccaugaaccccaccaacaccaucuucgacgccaagaggcugauuggacggaaauucgaggaugccacagugcagucggauaugaaacacuggccguuccggguggugagcgagggaggcaagcccaaagugcaaguagaguacaagggggagaccaagaccuucuucccagaggagauauccuccaugguccucacgaagaugaaggagaucgcggaagccuaccuggggggcaaggugcacagcgcggucauaacggucccggccuauuucaacgacucgcagcgccaggccaccaaggacgcaggcaccaucacggggcucaaugugcugcgcaucaucaacgagcccacggcggcggccaucgccuacggccuggacaagaagggcugcgcgggcggcgagaagaacgugcucaucuuugaccugggcgguggcacuuucgacguguccauccugaccaucgaggauggcaucuucgaggugaaguccacggccggcgacacccaccugggcggugaggacuucgacaaccgcauggugagccaccuggcggaggaguucaagcgcaagcacaagaaggacauugggcccaacaagcgcgccgugaggcggcugcgcaccgcuugcgagcgcgccaagcgcacccugagcucguccacgcaggcgagcaucgagaucgacucgcucuacgagggcguggacuucuauacguccaucacgcgcgcccgcuucgaggagcucaaugccgaccucuuucgcgggacccuggagccgguggagaaggcgcugcgcgacgccaagcuggacaagggccagauccaggagaucgugcuggugggcggcuccacucguauccccaagauccagaagcugcugcaggauuucuucaacggcaaggagcugaacaagagcaucaaccccgacgaggcgguggccuauggcgccgcggugcaggcggccauccucaucggcgacaaaucagagaaugugcaggaccugcugcuacucgacgugaccccguugucgcugggcaucgagacagcuggcggugucaugaccccacucaucaagaggaacaccacgauccccaccaagcagacgcagaccuucaccaccuacucggacaaccagagcagcguacuggugcagguauacgagggcgaacgggccaugaccaaggacaauaaccugcugggcaaguucgaccugaccgggauucccccugcgccucgcggggucccccaaaucgagguuaccuucgacauugacgccaauggcauccuuaacguuaccgccgccgacaagagcaccgguaaggaaaacaaaaucaccaucaccaaugacaaaggucgucugagcaaggacgacauugaccggauggugcaggaggcggagcgguacaaaucggaagaugaggcgaaucgcgaccgagucgcggccaaaaacgcccuggaguccuauaccuacaacaucaagcagacgguggaagacgagaaacugaggggcaagauuagcgagcaggacaaaaacaagauccucgacaagugucaggaggugaucaacuggcucgaccgaaaccagauggcagagaaagaugaguaugaacacaagcagaaagagcucgaaagaguuugcaaccccaucaucagcaaacuuuaccaaggugguccuggcggcggcagcggcggcggcgguucaggagccuccgggggacccaccaucgaagaaguggacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2649 - RNA, 2905 nt, Artificial Sequence
  mRNA product Design2 comprising derived and/or modified sequence from Homo sapiens__NP_002145.3 __HsHSPA4 (wt)
ggggcgcugccuacggagguggcagccaucuccuucucggcaucaagcuuaccaugucgguggugggcauagaccugggcuuccagagcugcuacgucgcuguggcccgcgccggcggcaucgagacuaucgcuaaugaguauagcgaccgcugcacgccggcuugcauuucuuuugguccuaagaaucguucaauuggagcagcagcuaaaagccagguaauuucuaaugcaaagaacacaguccaaggauuuaaaagauuccauggccgagcauucucugauccauuuguggaggcagaaaaaucuaaccuugcauaugauauugugcaguugccuacaggauuaacagguauaaaggugacauauauggaggaagagcgaaauuuuaccacugagcaagugacugccaugcuuuuguccaaacugaaggagacagccgaaaguguucuuaagaagccuguaguugacuguguuguuucgguuccuuguuucuauacugaugcagaaagacgaucagugauggaugcaacacagauugcuggucuuaauugcuugcgauuaaugaaugaaaccacugcaguugcucuugcauauggaaucuauaagcaggaucuuccugccuuagaagagaaaccaagaaauguaguuuuuguagacaugggccacucugcuuaucaaguuucuguaugugcauuuaauagaggaaaacugaaaguucuggccacugcauuugacacgacauugggagguagaaaauuugaugaaguguuaguaaaucacuucugugaagaauuugggaagaaauacaagcuagacauuaaguccaaaauccgugcauuauuacgacucucucaggagugugagaaacucaagaaauugaugagugcaaaugcuucagaucucccuuugagcauugaauguuuuaugaaugauguugauguaucuggaacuaugaauagaggcaaauuucuggagaugugcaaugaucucuuagcuagaguggagccaccacuucguaguguuuuggaacaaaccaaguuaaagaaagaagauauuuaugcaguggagauaguugguggugcuacacgaaucccugcgguaaaagagaagaucagcaaauuuuucgguaaagaacuuaguacaacauuaaaugcugaugaagcugucacucgaggcugugcauugcagugugccaucuuaucgccugcuuucaaagucagagaauuuucuaucacugauguaguaccauauccaauaucucugagauggaauucuccagcugaagaagggucaagugacugugaagucuuuuccaaaaaucaugcugcuccuuucucuaaaguucuuacauuuuauagaaaggaaccuuucacucuugaggccuacuacagcucuccucaggauuugcccuauccagauccugcuauagcucaguuuucaguucagaaagucacuccucagucugauggcuccaguucaaaagugaaagucaaaguucgaguaaauguccauggcauuuucaguguguccagugcaucuuuaguggagguucacaagucugaggaaaaugaggagccaauggaaacagaucagaaugcaaaggaggaagagaagaugcaaguggaccaggaggaaccacauguugaagagcaacagcagcagacaccagcagaaaauaaggcagagucugaagaaauggagaccucucaagcuggauccaaggauaaaaagauggaccaaccaccccaagccaagaaggcaaaagugaagaccaguacuguggaccugccaaucgagaaucagcuauuauggcagauagacagagagaugcucaacuuguacauugaaaaugaggguaagaugaucaugcaggauaaacuggagaaggagcggaaugaugcuaagaacgcaguggaggaauauguguaugaaaugagagacaagcuuaguggugaauaugagaaguuugugagugaagaugaucguaacaguuuuacuuugaaacuggaagauacugaaaauugguuguaugaggauggagaagaccagccaaagcaaguuuauguugauaaguuggcugaauuaaaaaaucuaggucaaccuauuaagauacguuuccaggaaucugaagaacgaccaaaauuauuugaagaacuagggaaacagauccaacaguauaugaaaauaaucagcucuuucaaaaacaaggaggaccaguaugaucauuuggaugcugcugacaugacaaagguagaaaaaagcacaaaugaagcaauggaguggaugaauaacaagcuaaaucugcagaacaagcagaguuugaccauggauccaguugucaagucaaaagagauugaagcuaaaauuaaggagcugacaaguacuuguagcccuauaauuucaaagcccaaacccaaaguggaaccuccaaaagaggaacaaaaaaaugcagagcagaauggaccaguggauggacaaggagacaacccaggcccccaggcugcugagcaggguacagacacagcugugccuucggauucagacaagaagcuuccugaaauggacauugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2650 - RNA, 2902 nt, Artificial Sequence
  mRNA product Design2 comprising derived and/or modified sequence from Homo sapiens__NP_055093.2 __HsHSPA4L (wt)
ggggcgcugccuacggagguggcagccaucuccuucucggcaucaagcuuaccaugucugugguuggcauugaccucggcuuucucaacugcuacauugcugucgcgagaaguggcggcaucgagaccaucgccaaugaguacagcgacagguguaccccggccuguauaucauugggaucaagaacucgagccauuggaaaugcagcaaagagccagauagucacgaacguaagaaauacaauucauggcuucaaaaagcuucaugggcgaucauuugaugaucccauugugcaaacugaaaggaucaggcuucccuaugaacugcagaaaaugccuaauggaagugcaggaguuaaggugcgguacuuagaggaagagagaccuuuugcaauugagcaaguuacuggaaugcuguuagccaagcuuaaagagacuucagaaaaugcuuugaagaaaccaguggcugacugugugauuucaauuccuagcuuuuuuacugaugccgagagaagaucugugauggcugcagcccagguugcaggcuuaaauuguuuaagguugaugaaugaaacuacugcaguugcacuggcguauggaauuuauaaacaggaucuucccccauuagaugagaaaccaagaaauguaguauuuauugauaugggacauucugccuaucaggucuugguuugugcuuuuaacaaaggaaaacuuaaagucuuggcuacuaccuuugauccauauuuggguggcaggaacuuugaugaggcuuuaguagacuacuucugugaugaguucaagaccaaauauaagauaaaugugaaagaaaacucucgggccuuguugcguuuauaucaggaaugugaaaaacuaaagaagcuaaugagugcaaaugcaucagaucuuccauugaacauugaguguuucaugaaugaccuugauguuucuaguaaaaugaacagggcucaauuugaacaacugugugcuucccuuuuggccaggguugaaccaccuuuaaaagcaguaauggaacaagcuaacuuacaacgugaagacauuaguaguauagaaauuguaggaggagcaacacgaauuccugcagugaaagaacaaaucacuaaauucuuucuuaaagacauaaguaccacauuaaaugcugaugaagcuguugcaagaggaugugcguuacagugugcgauucucucaccagcauuuaaagugcgugaauuuuccauaacagaccuuguucccuauucaaucacauuaagguggaagaccucuuuugaagauggaaguggggaaugugaaguuuucuguaagaaccauccugccccauucucaaaagucauuacuuuccacaagaaggaaccauuugaacuagaagcauuuuauacuaauuuacaugaagugccuuauccugaugcaagaauugggagcuucacuauucagaauguuuuuccacagucugauggugauaguuccaaagugaagguuaaaguucguguuaacauccauggaaucuucaguguggcuagcgcaucaguaauugagaagcaaaauuuggaaggcgaucacagugaugcuccaauggagacagaaacuucauuuaaaaaugaaaacaaagauaauauggauaaaaugcagguugaucaagaagaagggcaucaaaaaugucaugcugaacacacuccagaagaggaaauugaucauacaggagccaaaacaaagucagcugucucagacaaacaagaccgauuaaaucagacacuuaaaaaaggaaaagucaaaaguauugaucuaccgauccagaguagccuauguagacaacuaggccaagaucuucucaacagcuacauugaaaaugaggggaagaugaucaugcaagauaaguuagagaaagaaagaaaugaugcuaagaaugccguugaagaauauguauaugauuuuagagacaggcugggcacugucuaugaaaaauucaucacuccagaagacuugaguaaacugucugcaguauuggaagacacagaaaauuggcuuuaugaagacggagaggaccaaccuaaacaaguuuauguggauaagcuucaagaacuaaagaaauacggccagccuauucaaaugaaguacauggagcaugaagagagaccaaaagccuuaaaugacuugggaaaaaagauccaacuugucaugaaagugauagaagcuuauagaaacaaggaugaaagauaugaucaucuggauccuacugaaauggaaaagguugaaaaauguaucagugaugccaugaguuggcugaauaguaagaugaaugcacagaacaaacuaagucucacucaagauccugugguaaaaguuucagaaauaguagcaaagucaaaggaacuggauaauuucuguaaccccaucauuuacaagcccaaaccaaaagcagaaguuccugaagacaaaccaaaagcuaauagugaacacaauggcccaauggauggacagaguggaacugaaacuaaaucagauucaacaaaagacagcucacagcauacuaaauccucuggagagauggaaguggacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2651 - RNA, 2347 nt, Artificial Sequence
  mRNA product Design2 comprising derived and/or modified sequence from Homo sapiens__NP_005338.1__HsHSPA5 (wt)
ggggcgcugccuacggagguggcagccaucuccuucucggcaucaagcuuaccaugaagcucucccugguggccgcgaugcugcugcugcucagcgcggcgcgggccgaggaggaggacaagaaggaggacgugggcacgguggucggcaucgaccuggggaccaccuacuccugcgucggcguguucaagaacggccgcguggagaucaucgccaacgaucagggcaaccgcaucacgccguccuaugucgccuucacuccugaaggggaacgucugauuggcgaugccgccaagaaccagcucaccuccaaccccgagaacacggucuuugacgccaagcggcucaucggccgcacguggaaugacccgucugugcagcaggacaucaaguucuugccguucaaggugguugaaaagaaaacuaaaccauacauucaaguugauauuggaggugggcaaacaaagacauuugcuccugaagaaauuucugccaugguucucacuaaaaugaaagaaaccgcugaggcuuauuugggaaagaagguuacccaugcaguuguuacuguaccagccuauuuuaaugaugcccaacgccaagcaaccaaagacgcuggaacuauugcuggccuaaauguuaugaggaucaucaacgagccuacggcagcugcuauugcuuauggccuggauaagagggagggggagaagaacauccugguguuugaccuggguggcggaaccuucgaugugucucuucucaccauugacaauggugucuucgaaguuguggccacuaauggagauacucaucuggguggagaagacuuugaccagcgugucauggaacacuucaucaaacuguacaaaaagaagacgggcaaagaugucaggaaagacaauagagcugugcagaaacuccggcgcgagguagaaaaggccaaacgggcccugucuucucagcaucaagcaagaauugaaauugaguccuucuaugaaggagaagacuuuucugagacccugacucgggccaaauuugaagagcucaacauggaucuguuccggucuacuaugaagcccguccagaaaguguuggaagauucugauuugaagaagucugauauugaugaaauuguucuuguugguggcucgacucgaauuccaaagauucagcaacugguuaaagaguucuucaauggcaaggaaccaucccguggcauaaacccagaugaagcuguagcguauggugcugcuguccaggcuggugugcucucuggugaucaagauacaggugaccugguacugcuugauguauguccccuuacacuugguauugaaacugugggaggugucaugaccaaacugauuccaaggaacacaguggugccuaccaagaagucucagaucuuuucuacagcuucugauaaucaaccaacuguuacaaucaaggucuaugaaggugaaagaccccugacaaaagacaaucaucuucuggguacauuugaucugacuggaauuccuccugcuccucguggggucccacagauugaagucaccuuugagauagaugugaaugguauucuucgagugacagcugaagacaaggguacagggaacaaaaauaagaucacaaucaccaaugaccagaaucgccugacaccugaagaaaucgaaaggaugguuaaugaugcugagaaguuugcugaggaagacaaaaagcucaaggagcgcauugauacuagaaaugaguuggaaagcuaugccuauucucuaaagaaucagauuggagauaaagaaaagcugggagguaaacuuuccucugaagauaaggagaccauggaaaaagcuguagaagaaaagauugaauggcuggaaagccaccaagaugcugacauugaagacuucaaagcuaagaagaaggaacuggaagaaauuguucaaccaauuaucagcaaacucuauggaagugcaggcccucccccaacuggugaagaggauacagcagaaaaagaugaguuguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2652 - RNA, 2314 nt, Artificial Sequence
  mRNA product Design2 comprising derived and/or modified sequence from Homo sapiens__NP_002146.2__HsHSPA6 (wt)
ggggcgcugccuacggagguggcagccaucuccuucucggcaucaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccggguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccgccuauuucaaugacucgcagcgccaggccaccaaggacgcgggggccaucgcggggcucaacguguugcggaucaucaaugagcccacggcagcugccaucgccuaugggcuggaccggcggggcgcgggagagcgcaacgugcucauuuuugaccugggugggggcaccuucgaugugucgguucucuccauugacgcuggugucuuugaggugaaagccacugcuggagauacccaccugggaggagaggacuucgacaaccggcucgugaaccacuucauggaagaauuccggcggaagcaugggaaggaccugagcgggaacaagcgugcccugcgcaggcugcgcacagccugugagcgcgccaagcgcacccuguccuccagcacccaggccacccuggagauagacucccuguucgagggcguggacuucuacacguccaucacucgugcccgcuuugaggaacugugcucagaccucuuccgcagcacccuggagccgguggagaaggcccugcgggaugccaagcuggacaaggcccagauucaugacgucguccugguggggggcuccacacgcauccccaaggugcagaaguugcugcaggacuucuucaacggcaaggagcugaacaagagcaucaacccugaugaggcuguggccuauggggcugcugugcaggcggccguguugaugggggacaaaugugagaaagugcaggaucuccugcugcuggauguggcuccccugucucuggggcuggagacagcagguggggugaugaccacgcugauccagaggaacgccacuauccccaccaagcagacccagacuuucaccaccuacucggacaaccagccuggggucuucauccagguguaugagggugagagggccaugaccaaggacaacaaccugcuggggcguuuugaacucaguggcaucccuccugccccacguggagucccccagauagaggugacuuuugacauugaugcuaauggcauccugagcgugacagccacugacaggagcacagguaaggcuaacaagaucaccaucaccaaugacaagggccggcugagcaaggaggagguggagaggaugguucaugaagccgagcaguacaaggcugaggaugaggcccagagggacagaguggcugccaaaaacucgcuggaggcccaugucuuccaugugaaagguucuuugcaagaggaaagccuuagggacaagauucccgaagaggacaggcgcaaaaugcaagacaagugucgggaaguccuugccuggcuggagcacaaccagcuggcagagaaggaggaguaugagcaucagaagagggagcuggagcaaaucugucgccccaucuucuccaggcucuauggggggccuggugucccugggggcagcaguuguggcacucaagcccgccagggggaccccagcaccggccccaucauugaggagguugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2653 - RNA, 1486 nt, Artificial Sequence
  mRNA product Design2 comprising derived and/or modified sequence from Homo sapiens__P48741__HsHSPA7 (wt)
ggggcgcugccuacggagguggcagccaucuccuucucggcaucaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccagguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccaccuauuucaguaacucgcagcgccaggccaccaaggacgcgggggccaucgcggggcucaaggugcugccgaucaucaaugaggccacggcagcagccaucgccuaugggcuggaccggcggggcgcgggaaagcgcaacgugcucauuuuugaccugggugggggcaccuucgaugugucgguucucuccauugacgccggugucuuugaggugaaagccacugcuggagauacccaccugggaggagaggacuucgacaaccggcucgugaaccacuucauggaagaauuccggcggaagcaugggaaggaccugagcgggaacaagcgugcccugcgcaggcugcgcacagccugugagcgcgccaagcgcaccccguccuccagcacccaggccacccuggagauagacucccuguucgagggcguggacuucuacaaguccaucacucgugcccgcuuugaggaacugugcucagaccucuuccgcagcacccuggagccgguggagaaggcccugcgggaugccaagcuggacaaggcccagauucaugacuucguccuggggggagggcuccacucgcauccccaaggugcagaaguugcugcaggacuucuucaacggcaaggagcugaacaagagcaucaacccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2654 - RNA, 2323 nt, Artificial Sequence
  mRNA product Design2 comprising derived and/or modified sequence from Homo sapiens__NP_006588.1 __HsHSPA8 (wt)
ggggcgcugccuacggagguggcagccaucuccuucucggcaucaagcuuaccauguccaagggaccugcaguugguauugaucuuggcaccaccuacucuuguguggguguuuuccagcacggaaaagucgagauaauugccaaugaucagggaaaccgaaccacuccaagcuaugucgccuuuacggacacugaacgguugaucggugaugccgcaaagaaucaaguugcaaugaaccccaccaacacaguuuuugaugccaaacgucugauuggacgcagauuugaugaugcuguuguccagucugauaugaaacauuggcccuuuaugguggugaaugaugcuggcaggcccaagguccaaguagaauacaagggagagaccaaaagcuucuauccagaggaggugucuucuaugguucugacaaagaugaaggaaauugcagaagccuaccuugggaagacuguuaccaaugcuguggucacagugccagcuuacuuuaaugacucucagcgucaggcuaccaaagaugcuggaacuauugcuggucucaauguacuuagaauuauuaaugagccaacugcugcugcuauugcuuacggcuuagacaaaaagguuggagcagaaagaaacgugcucaucuuugaccugggagguggcacuuuugaugugucaauccucacuauugaggauggaaucuuugaggucaagucuacagcuggagacacccacuuggguggagaagauuuugacaaccgaauggucaaccauuuuauugcugaguuuaagcgcaagcauaagaaggacaucagugagaacaagagagcuguaagacgccuccguacugcuugugaacgugcuaagcguacccucucuuccagcacccaggccaguauugagaucgauucucucuaugaaggaaucgacuucuauaccuccauuacccgugcccgauuugaagaacugaaugcugaccuguuccguggcacccuggacccaguagagaaagcccuucgagaugccaaacuagacaagucacagauucaugauauuguccugguuggugguucuacucguauccccaagauucagaagcuucuccaagacuucuucaauggaaaagaacugaauaagagcaucaacccugaugaagcuguugcuuauggugcagcuguccaggcagccaucuugucuggagacaagucugagaauguucaagauuugcugcucuuggaugucacuccucuuucccuugguauugaaacugcugguggagucaugacuguccucaucaagcguaauaccaccauuccuaccaagcagacacagaccuucacuaccuauucugacaaccagccuggugugcuuauucagguuuaugaaggcgagcgugccaugacaaaggauaacaaccugcuuggcaaguuugaacucacaggcauaccuccugcaccccgagguguuccucagauugaagucacuuuugacauugaugccaaugguauacucaaugucucugcuguggacaagaguacgggaaaagagaacaagauuacuaucacuaaugacaagggccguuugagcaaggaagacauugaacguaugguccaggaagcugagaaguacaaagcugaagaugagaagcagagggacaaggugucauccaagaauucacuugaguccuaugccuucaacaugaaagcaacuguugaagaugagaaacuucaaggcaagauuaacgaugaggacaaacagaagauucuggacaaguguaaugaaauuaucaacuggcuugauaagaaucagacugcugagaaggaagaauuugaacaucaacagaaagagcuggagaaaguuugcaaccccaucaucaccaagcuguaccagagugcaggaggcaugccaggaggaaugccugggggauuuccuggugguggagcuccucccucugguggugcuuccucagggcccaccauugaagagguugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2655 - RNA, 2422 nt, Artificial Sequence
  mRNA product Design2 comprising derived and/or modified sequence from Homo sapiens__NP_004125.3 __HsHSPA9 (wt)
ggggcgcugccuacggagguggcagccaucuccuucucggcaucaagcuuaccaugauaagugccagccgagcugcagcagcccgucucgugggcgccgcagccucccggggcccuacggccgcccgccaccaggauagcuggaauggccuuagucaugaggcuuuuagacuuguuucaaggcgggauuaugcaucagaagcaaucaagggagcaguuguugguauugauuuggguacuaccaacuccugcguggcaguuauggaagguaaacaagcaaaggugcuggagaaugccgaaggugccagaaccaccccuucaguuguggccuuuacagcagauggugagcgacuuguuggaaugccggccaagcgacaggcugucaccaacccaaacaauacauuuuaugcuaccaagcgucucauuggccggcgauaugaugauccugaaguacagaaagacauuaaaaauguucccuuuaaaauuguccgugccuccaauggugaugccuggguugaggcucaugggaaauuguauucuccgagucagauuggagcauuuguguugaugaagaugaaagagacugcagaaaauuacuuggggcacacagcaaaaaaugcugugaucacagucccagcuuauuucaaugacucgcagagacaggccacuaaagaugcuggccagauaucuggacugaaugugcuucgggugauuaaugagcccacagcugcugcucuugccuauggucuagacaaaucagaagacaaagucauugcuguauaugauuuaggugguggaacuuuugauauuucuauccuggaaauucagaaaggaguauuugaggugaaauccacaaauggggauaccuucuuagguggggaagacuuugaccaggccuugcuacggcacauugugaaggaguucaagagagagacagggguugauuugacuaaagacaacauggcacuucagaggguacgggaagcugcugaaaaggcuaaaugugaacucuccucaucugugcagacugacaucaauuugcccuaucuuacaauggauucuucuggacccaagcauuugaauaugaaguugacccgugcucaauuugaagggauugucacugaucuaaucagaaggacuaucgcuccaugccaaaaagcuaugcaagaugcagaagucagcaagagugacauaggagaagugauucuuguggguggcaugacuaggaugcccaagguucagcagacuguacaggaucuuuuuggcagagccccaaguaaagcugucaauccugaugaggcuguggccauuggagcugccauucagggagguguguuggccggcgaugucacggaugugcugcuccuugaugucacuccccugucucuggguauugaaacucuaggaggugucuuuaccaaacuuauuaauaggaauaccacuauuccaaccaagaagagccagguauucucuacugccgcugauggucaaacgcaaguggaaauuaaagugugucagggugaaagagagauggcuggagacaacaaacuccuuggacaguuuacuuugauuggaauuccaccagccccucguggaguuccucagauugaaguuacauuugacauugaugccaaugggauaguacauguuucugcuaaagauaaaggcacaggacgugagcagcagauuguaauccagucuucugguggauuaagcaaagaugauauugaaaauaugguuaaaaaugcagagaaauaugcugaagaagaccggcgaaagaaggaacgaguugaagcaguuaauauggcugaaggaaucauucacgacacagaaaccaagauggaagaauucaaggaccaauuaccugcugaugagugcaacaagcugaaagaagagauuuccaaaaugagggagcuccuggcuagaaaagacagcgaaacaggagaaaauauuagacaggcagcauccucucuucagcaggcaucacugaagcuguucgaaauggcauacaaaaagauggcaucugagcgagaaggcucuggaaguucuggcacuggggaacaaaaggaagaucaaaaggaggaaaaacaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2656 - RNA, 2410 nt, Artificial Sequence
  mRNA product Design2 comprising derived and/or modified sequence from Homo sapiens__NP_079291.2__HsHSPA12A (wt)
ggggcgcugccuacggagguggcagccaucuccuucucggcaucaagcuuaccauggcggacaaggaggccggcggcagcgacgggccccgagaaacggcucccacaucugcauauucaucuccagcccggagucuuggggacacaggaauaacgccucugucccccucccauauugugaacgacacugacuccaacgucucagaacagcagucauuucucguggugguggccgucgacuuugggaccacauccaguggcuaugccuacagcuucaccaaggagccggaaugcauccaugugaugaggcgaugggagggaggugacccugguguguccaaucagaagacuccaaccaccaucuugcugacucccgagaggaaguuccacagcuucggguaugccgccagggacuuuuaccaugaccuggaucccaaugaggccaagcaguggcuguaccuggagaaguucaagaugaagcugcacaccacuggggaccucaccauggauacagaccugacggcagcaaauggcaagaaagucaaagcccuugaaaucuuugcuuaugcccugcaguacuuuaaggagcaggcgcugaaggagcugagugaccaggcggguucggaguucgagaacucugaugucagaugggucaucacggugccugccaucuggaagcagccggccaagcaguucaugagacaagcugccuaccaggcaggccuggccucccccgagaacucggagcagcucaucauugccuuggagccugaggcagccucuaucuacugccgaaagcugcggcuacaccagaugauugagcugagcagcaaggcagccgucaauggguacagcggcagugacacaguaggagcuggguuuacacaggcuaaggaacacauacggcguaaucggcagagucggaccuuuuugguggagaaugucauaggagaaaucugguccgagcuggaggaaggugauaaguaugugguuguggacaguggcgguggcaccguagaccugacaguccaucagauccgguuaccggagggacaccuuaaggaacuguauaaagcaacaggcggacccuauggaucuuuaggaguagauuaugaguucgaaaaacuucuguauaaaauauuuggagaggauuuuauugaacaauucaaaaucaaacgcccugcagccuggguugacuuaaugauugcguuugagucucgcaaaagggcggcugccccagacagaacuaacccgcugaacaucacccugcccuucuccuucauugacuacuacaagaaguuccgcgggcacaguguggagcacgccuugcggaaaagcaauguggauuuugugaagugguccucgcaggggaugcugcggaugaguccagaugccaugaacgcccuuuuuaagccgaccaucgauagcaucauugagcaucuccgggaccuguuucagaagcccgagguguccaccgucaaguuccucuuucuggugggcggcuuugccgaggcgccccugcugcagcaggcggugcaggcugcuuuuggggaccagugccggaucaucaucccccaggacgugggccucaccauccucaagggugccguccucuuuggccuggaccccgcggucaucaaggugcgccggucgccgcucaccuacgggguaggcgugcugaaccgcuacguggagggcaagcacccgccugagaagcugcuggugaaggauggcacucgguggugcaccgacgucuuugacaaguucaucucugccgaccagucuguggcucugggugagcuggucaagcguagcuacaccccggccaagcccucccagcuggucauugucaucaacaucuacagcucugagcacgacaacgucagcuucaucacugaucccggggugaagaaguguggcacgcuccgccuggaucucacagggaccaguggcacugcggugcccgcccggagggagauccagacccuuaugcaguucggggacaccgagaucaaagccacagccauugauauagccacuucgaagagugucaaaguugggaucgacuucuuaaauuacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2657 - RNA, 2443 nt, Artificial Sequence
  mRNA product Design2 comprising derived and/or modified sequence from Homo sapiens__NP_443202.3 __HsHSPA12B (wt)
ggggcgcugccuacggagguggcagccaucuccuucucggcaucaagcuuaccauguuggcugucccggagaugggccugcaggggcuguacaucggcuccagcccggagcgguccccagugccuagcccacccggcuccccgaggacccaggaaagcugcggcauugccccccucacacccucgcagucuccaaaacccgagguccgagccccccagcaggccuccuucucuguggugguggccauugacuucggcaccacgucuaguggcuaugcuuucagcuuugccagugacccugaggccauccacaugaugaggaaaugggagggcggagacccgggcguggcccaccagaagaccccgaccugccugcugcugacuccggagggcgccuuccacagcuuuggcuacaccgcccgcgauuacuaccaugaccuggaccccgaagaggcgcgggacuggcucuacuucgagaaguucaagaugaagauccacagcgccacggaucucaccuugaagacccagcuagaggcaguaaauggaaagacgaugcccgcccuggagguguucgcccaugcccugcgcuucuucagggagcacgcccuucaggagcugagggagcagagcccaucgcugccagagaaggacacugugcgcuggguguugacggugccugccaucuggaaacagccagccaagcaguucaugcgggaggcugccuaccuggcuggacuagugucccgagagaaugcagagcagcuacucaucgcccuggagcccgaggccgccucgguauacugccgcaagcugcgccugcaccagcuccuggaccugaguggccgggccccagguggugggcgccugggugagcgccgcuccaucgacuccagcuuccgucaggcucgggagcagcugcgaaggucccgccacagccgcacguuccugguggagucaggcguaggagagcugugggcagagaugcaagcaggagaccgcuacgugguggccgacugcggcggaggcaccguggaccugacggugcaccagcuggagcagccccauggcacccucaaggagcucuacaaggcaucugggggcccuuauggcgcggugggcguggaccuggccuucgagcagcugcugugccgcaucuucggcgaggacuucaucgccaccuucaaaaggcaacggccggcagccuggguagaucugaccaucgccuucgaggcucgcaagcgcacugcuggcccacaccgugcaggggcgcucaacaucucgcugcccuucuccuucauugacuucuaccgcaagcagcggggccacaacguggagaccgcucugcgcaggagcagcgugaacuucgugaagugguccucacaggggaugcuccgaaugucuugugaagccaugaacgagcucuuucagcccaccgucagcgggaucauccagcacauagaggcccugcuggcacggccggaggugcagggugugaagcugcuguuccuagugggcggcuucgccgagucagcggugcugcagcacgcggugcaggcggcgcugggcgcccgcggucugcgugucguggucccgcacgacgugggccucaccauccucaaaggcgcggugcuguucggccaggcgccgggcguggugcggguccgccgcucgccgcucaccuauggcgugggcgugcucaaccgcuuugugccugggcgccacccgcccgaaaagcugcugguucgcgacggccgccgcuggugcaccgacgucuucgagcgcuucguggccgccgagcagucgguggcccugggcgaggaggugcggcgcagcuacugcccggcgcgucccggccagcggcgcguacucaucaaccuguacugcugcgcggcagaggaugcgcgcuucaucaccgaccccggcgugcgcaaaugcggcgcgcucagccucgagcuugagcccgccgacugcggccaggacaccgccggcgcgccucccggccgccgcgagauccgcgccgccaugcaguuuggcgacaccgaaauuaaggucaccgccgucgacgucagcaccaaucgcuccgugcgcgcguccaucgacuuucuuuccaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2658 - RNA, 1798 nt, Artificial Sequence
  mRNA product Design2 comprising derived and/or modified sequence from Homo sapiens__NP_008879.3__HsHSPA13 (wt)
ggggcgcugccuacggagguggcagccaucuccuucucggcaucaagcuuaccauggccagagagaugacgaucuuaggaucggcuguuuugacucuccuguuggccggcuauuuggcacaacaguauuuaccauugccuacuccuaaagugauugguauugaucuuggcaccaccuauuguucuguugggguguuuuuuccuggcacaggaaaaguaaaggugauuccagaugaaaaugggcauaucagcauacccagcauggugucuuuuacugacaaugauguauaugugggauaugaaagcguagagcuggcagauucaaauccucaaaacacaauauaugaugccaaaagauucauaggcaagauuuuuaccgcagaagaguuggaggcugaaauuggcagauacccauuuaagguuuuaaacaaaaauggaaugguugaguuuucugugacaaguaaugagaccaucacaguguccccagaauauguuggcucucgacuauuguugaaguuaaaggaaauggcagaggcauaucuuggaaugccaguugccaaugcugucauuucuguaccagcagaauuugaucuaaaacagagaaauucaacaauugaagcugcuaaccuugcaggacugaagauuuugaggguaauaaaugaacccacagcagcagcuauggccuauggucuccacaaggcugacgucuuccacgucuuggugauagacuugggcggaggaacucuagaugugucuuuacugaauaaacaaggagggauguuucuaacccgagcaaugucuggaaacaauaaacuuggaggacaggacuucaaucagagauugcuucaguacuuauauaaacagaucuaucaaacauauggcuucgugcccucuaggaaagaggaaauccacagauugagacaagcuguggaaauggucaaauuaaaucugacucuucaucaaucugcucaguugucaguauuacuaacgguggaggagcaggacaggaaggaaccucacaguagugacacugaacugccaaaagacaaacuuuccucagcagaugaccaucgcgugaacaguggguuuggacguggccuuucugauaagaaaaguggagaaagucagguuuuauuugaaacagaaauaucacggaaacucuuugauacccuuaaugaagaccucuuucagaaaauacugguacccauucagcaaguauugaaagaaggccaccuggaaaagacugagauugaugaggugguuuuaguugggggcuccacucguauuccucggauccgucaagucauucaagaguucuuuggaaaagaucccaacacaucuguagacccugaccuagcaguaguaacgggaguggcuauccaagcagggauugauggaggcucuuggccucuccaagucagugcuuuagaaauucccaauaagcauuuacaaaaaaccaacuucaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2659 - RNA, 1912 nt, Artificial Sequence
  mRNA product Design2 comprising derived and/or modified sequence from Homo sapiens__NP_057383.2__HsHSPA14 (wt)
ggggcgcugccuacggagguggcagccaucuccuucucggcaucaagcuuaccauggcggccaucggaguucaccugggcugcaccucagccuguguggccgucuauaaggauggccgggcuggugugguugcaaaugaugccggugaccgaguuacuccagcuguuguugcuuacucagaaaaugaagagauuguuggauuggcagcaaaacaaaguagaauaagaaauauuucaaauacaguaaugaaaguaaagcagauccugggcagaagcuccagugauccacaagcucagaaauacaucgcggaaaguaaauguuuagucauugaaaaaaaugggaaauuacgauaugaaauagauacuggagaagaaacaaaauuuguuaacccagaagauguugccagacugauauuuaguaaaaugaaagaaacggcacauucuguauugggcucagaugcaaaugauguaguuauuacugucccguuugauuuuggagaaaagcaaaaaaaugcucuuggagaagcagcuagagcugcuggauuuaauguuuugcgauuaauucacgaaccgucugcagcucuucuugcuuauggaauuggacaagacuccccuacuggaaaaagcaauauuuugguguuuaagcuuggaggaacauccuuaucucucagcgucauggaaguuaacaguggaauauaucggguucuuucaacaaacacugaugauaacaucgguggugcacauuucacagaaaccuuagcacaguaucuagcuucugaguuccaaagauccuucaaacaugaugugagaggaaaugcgcgagccaugaugaaauuaacgaacagugcugaaguagcgaaacauucuuugucaaccuugggaagugccaacuguuuucuugacucauuauaugaaggucaagauuuugauugcaauguguccagagcaagauuugaacuucuuuguucuccacuuuuuaauaaguguauagaagcaaucagaggacucuuagaucaaaauggauuuacagcagaugauaucaacaagguuguccuuuguggagggucuucucgaaucccaaagcuacagcaacugauuaaagaucuuuucccagcuguugagcuucucaauucuaucccuccugaugaagugaucccuauuggugcagcuauagaagcaggaauucuuauugggaaagaaaaccuguugguggaagacucucuuaugauagaguguucagccagagauauuuuaguuaaggguguggacgaaucaggagccaguagauucacagugcuguuuccaucagggacuccuuugccagcucgaagacaacacacauugcaagccccuggaagcauaucuucagugugccuugaacucuaugagucugaugggaagaacucugccaaagaggaaaccaaguuugcacagguuguacuccaggauuuagauaaaaaagaaaauggauuacgugauauauuagcuguucuuacuaugaaaagggauggaucuuuacaugugacaugcacagaucaagaaacuggaaaaugugaagcaaucucuauugagauagcaucuuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2660 - RNA, 2959 nt, Artificial Sequence
  mRNA product Design2 comprising derived and/or modified sequence from Homo sapiens__NP_006635.2 __HsHSPH1 (wt)
ggggcgcugccuacggagguggcagccaucuccuucucggcaucaagcuuaccaugucgguggugggguuggacgugggcucgcagagcugcuacaucgcgguagcccgggccgggggcaucgagaccaucgccaaugaguucagcgaccggugcaccccgucagucauaucauuuggaucaaaaaauagaacaaucggaguugcagccaaaaaucagcaaaucacucaugcaaacaauacggugucuaacuucaaaagauuucauggccgagcauucaaugaccccuucauucaaaaggagaaggaaaacuugaguuacgauuugguuccauugaaaaaugguggaguuggaauaaagguaauguacaugggugaagaacaucuauuuaguguggagcagauaacagccauguuguugacuaagcugaaggaaacugcugaaaacagccucaagaaaccaguaacagauuguguuauuucaguccccuccuucuuuacagaugcugagaggcgaucuguguuagaugcugcacagauuguuggccuaaacuguuuaagacuuaugaaugacaugacagcuguugcuuugaauuacggaauuuauaagcaggaucucccaagccuggaugagaaaccucggauagugguuuuuguugauaugggacauucagcuuuucaagugucugcuugugcuuuuaacaagggaaaauugaagguacugggaacagcuuuugauccuuucuuaggaggaaaaaacuucgaugaaaaguuaguggaacauuuuugugcagaauuuaaaacuaaguacaaguuggaugcaaaauccaaaauacgagcacuccuacgucuguaucaggaaugugaaaaacugaaaaagcuaaugagcucuaacagcacagaccuuccacugaauaucgaaugcuuuaugaaugauaaagauguuuccggaaagaugaacaggucacaauuugaagaacucugugcugaacuucugcaaaagauagaaguaccccuuuauucacuguuggaacaaacucaucucaaaguagaagaugugagugcaguugagauuguuggaggcgcuacacgaauuccagcugugaaggaaagaauugccaaauucuuuggaaaagauauuagcacaacacucaaugcagaugaagcaguagccagaggaugugcauuacagugugcaauacuuuccccggcauuuaaaguuagagaauuuuccgucacagaugcaguuccuuuuccaauaucucugaucuggaaccaugauucagaagauacugaagguguucaugaagucuuuagucgaaaccaugcugcuccuuucuccaaaguucucaccuuucugagaagggggccuuuugagcuagaagcuuucuauucugauccccaaggaguuccauauccagaagcaaaaauaggccgcuuuguaguucagaauguuucugcacagaaagauggagaaaaaucuagaguaaaagucaaagugcgagucaacacccauggcauuuucaccaucucuacggcaucuaugguggagaaagucccaacugaggagaaugaaaugucuucugaagcugacauggagugucugaaucagagaccaccagaaaacccagacacugauaaaaauguccagcaagacaacagugaagcuggaacacagccccagguacaaacugaugcucaacaaaccucacagucucccccuucaccugaacuuaccucagaagaaaacaaaaucccagaugcugacaaagcaaaugaaaaaaaaguugaccagccuccagaagcuaaaaagcccaaaauaaagguggugaauguugagcugccuauugaagccaacuuggucuggcaguuagggaaagaccuucuuaacauguauauugagacagaggguaagaugauaaugcaagauaaauuggaaaaagaaaggaaugaugcuaaaaaugcaguugaggaauauguguaugaguucagagacaagcuguguggaccauaugaaaaauuuauaugugagcaggaucaucaaaauuuuuugagacuccucacagaaacugaagacuggcuguaugaagaaggagaggaccaagcuaaacaagcauauguugacaaguuggaagaauuaaugaaaauuggcacuccaguuaaaguucgguuucaggaagcugaagaacggccaaaaauguuugaagaacuaggacagaggcugcagcauuaugccaagauagcagcugacuucagaaauaaggaugagaaauacaaccauauugaugagucugaaaugaaaaaaguggagaagucuguuaaugaagugauggaauggaugaauaaugucaugaaugcucaggcuaaaaagagucuugaucaggauccaguuguacgugcucaggaaauuaaaacaaaaaucaaggaauugaacaacacaugugaacccguuguaacacaaccgaaaccaaaaauugaaucacccaaacuggaaagaacuccaaauggcccaaauauugauaaaaaggaagaagauuuagaagacaaaaacaauuuuggugcugaaccuccacaucagaauggugaauguuacccuaaugagaaaaauucuguuaauauggacuuggacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2661 - RNA, 3382 nt, Artificial Sequence
  mRNA product Design2 comprising derived and/or modified sequence from Homo sapiens__NP_006380.1 __HsHYOU1 (wt)
ggggcgcugccuacggagguggcagccaucuccuucucggcaucaagcuuaccauggcagacaaaguuaggaggcagaggccgaggaggcgagucuguugggccuugguggcugugcucuuggcagaccuguuggcacugagugauacacuggcagugaugucuguggaccugggcagugaguccaugaagguggccauugucaaaccuggagugcccauggaaauugucuugaauaaggaaucucggaggaaaacaccggugaucgugacccugaaagaaaaugaaagauucuuuggagacagugcagcaagcauggcgauuaagaauccaaaggcuacgcuacguuacuuccagcaccuccuggggaagcaggcagauaacccccauguagcucuuuaccaggcccgcuucccggagcacgagcugacuuucgacccacagaggcagacugugcacuuucagaucagcucgcagcugcaguucucaccugaggaaguguugggcaugguucucaauuauucucguucucuagcugaagauuuugcagagcagcccaucaaggaugcagugaucaccgugccagucuucuucaaccaggccgagcgccgagcugugcugcaggcugcucguauggcuggccucaaagugcugcagcucaucaaugacaacaccgccacugcccucagcuauggugucuuccgccggaaagauauuaacaccacugcccagaauaucauguucuaugacaugggcucaggcagcaccguaugcaccauugugaccuaccagauggugaagacuaaggaagcugggaugcagccacagcugcagauccggggaguaggauuugaccguacccuggggggccuggagauggagcuccggcuucgagaacgccuggcugggcuuuucaaugagcagcgcaagggucagagagcaaaggaugugcgggagaacccgcgugccauggccaagcugcugcgugaggcuaaucggcucaaaaccguccucagugccaacgcugaccacauggcacagauugaaggccugauggaugauguggacuucaaggcaaaagugacucguguggaauuugaggaguugugugcagacuuguuugagcgggugccugggccuguacagcaggcccuccagagugccgaaaugagucuggaugagauugagcaggugauccugguggguggggccacucggguccccagaguucaggaggugcugcugaaggccgugggcaaggaggagcuggggaagaacaucaaugcagaugaagcagccgccaugggggcaguguaccaggcagcugcgcucagcaaagccuuuaaagugaagccauuugucguccgagaugcaguggucuaccccauccugguggaguucacgagggagguggaggaggagccugggauucacagccugaagcacaauaaacggguacucuucucucggauggggcccuacccucaacgcaaagucaucaccuuuaaccgcuacagccaugauuucaacuuccacaucaacuacggcgaccugggcuuccuggggccugaagaucuucggguauuuggcucccagaaucugaccacagugaagcuaaaaggggugggugacagcuucaagaaguauccugacuacgaguccaagggcaucaaggcucacuucaaccuggaugagaguggcgugcucagucuagacaggguggagucuguauuugagacacugguagaggacagcgcagaagaggaaucuacucucaccaaacuuggcaacaccauuuccagccuguuuggaggcgguaccacaccagaugccaaggagaaugguacugauacuguccaggaggaagaggagagcccugcagaggggagcaaggacgagccuggggagcagguggagcucaaggaggaagcugaggccccaguggaggauggcucucagcccccacccccugaaccuaagggagaugcaaccccugagggagaaaaggccacagaaaaagaaaauggggacaagucugaggcccagaaaccaagugagaaggcagaggcagggccugagggcgucgcuccagccccagagggagagaagaagcagaagcccgccaggaagcggcgaaugguagaggagaucgggguggagcugguuguucuggaccugccugacuugccagaggauaagcuggcucagucggugcagaaacuucaggacuugacacuccgagaccuggagaagcaggaacgggaaaaagcugccaacagcuuggaagcauucauauuugagacccaggacaagcuguaccagcccgaguaccaggaaguguccacagaggagcagcgugaggagaucucugggaagcucagcgccgcauccaccuggcuggaggaugaggguguuggagccaccacagugauguugaaggagaagcuggcugagcugaggaagcugugccaagggcuguuuuuucggguagaggagcgcaagaaguggcccgaacggcugucugcccucgauaaucuccucaaccauuccagcauguuccucaagggggcccggcucaucccagagauggaccagaucuucacugagguggagaugacaacguuagagaaagucaucaaugagaccugggccuggaagaaugcaacucuggccgagcaggcuaagcugcccgccacagagaagccuguguugcucucaaaagacauugaagcuaagaugauggcccuggaccgagaggugcaguaucugcucaauaaggccaaguuuaccaagccccggccccggccuaaggacaagaaugggacccgggcagagccaccccucaaugccagugccagugaccagggggagaaggucaucccuccagcaggccagacugaagaugcagagcccauuucagaaccugagaaaguagagacuggauccgagccaggagacacugagccuuuggaguuaggagguccuggagcagaaccugaacagaaagaacaaucgacaggacagaagcggccuuugaagaacgacgaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2662 - RNA, 2581 nt, Artificial Sequence
  mRNA product Design2 comprising derived and/or modified sequence from Homo sapiens__NP_005339.3 __HsHSP90AA1 (wt)
ggggcgcugccuacggagguggcagccaucuccuucucggcaucaagcuuaccaugccugaggaaacccagacccaagaccaaccgauggaggaggaggagguugagacguucgccuuucaggcagaaauugcccaguugaugucauugaucaucaauacuuucuacucgaacaaagagaucuuucugagagagcucauuucaaauucaucagaugcauuggacaaaauccgguaugaaagcuugacagaucccaguaaauuagacucugggaaagagcugcauauuaaccuuauaccgaacaaacaagaucgaacucucacuauuguggauacuggaauuggaaugaccaaggcugacuugaucaauaaccuugguacuaucgccaagucugggaccaaagcguucauggaagcuuugcaggcuggugcagauaucucuaugauuggccaguucgguguugguuuuuauucugcuuauuugguugcugagaaaguaacugugaucaccaaacauaacgaugaugagcaguacgcuugggaguccucagcagggggaucauucacagugaggacagacacaggugaaccuaugggucguggaacaaaaguuauccuacaccugaaagaagaccaaacugaguacuuggaggaacgaagaauaaaggagauugugaagaaacauucucaguuuauuggauaucccauuacucuuuuuguggagaaggaacgugauaaagaaguaagcgaugaugaggcugaagaaaaggaagacaaagaagaagaaaaagaaaaagaagagaaagagucggaagacaaaccugaaauugaagauguugguucugaugaggaagaagaaaagaaggauggugacaagaagaagaagaagaagauuaaggaaaaguacaucgaucaagaagagcucaacaaaacaaagcccaucuggaccagaaaucccgacgauauuacuaaugaggaguacggagaauucuauaagagcuugaccaaugacugggaagaucacuuggcagugaagcauuuuucaguugaaggacaguuggaauucagagcccuucuauuugucccacgacgugcuccuuuugaucuguuugaaaacagaaagaaaaagaacaacaucaaauuguauguacgcagaguuuucaucauggauaacugugaggagcuaaucccugaauaucugaacuucauuagaggggugguagacucggaggaucucccucuaaacauaucccgugagauguugcaacaaagcaaaauuuugaaaguuaucaggaagaauuuggucaaaaaaugcuuagaacucuuuacugaacuggcggaagauaaagagaacuacaagaaauucuaugagcaguucucuaaaaacauaaagcuuggaauacacgaagacucucaaaaucggaagaagcuuucagagcuguuaagguacuacacaucugccucuggugaugagaugguuucucucaaggacuacugcaccagaaugaaggagaaccagaaacauaucuauuauaucacaggugagaccaaggaccagguagcuaacucagccuuuguggaacgucuucggaaacauggcuuagaagugaucuauaugauugagcccauugaugaguacuguguccaacagcugaaggaauuugaggggaagacuuuagugucagucaccaaagaaggccuggaacuuccagaggaugaagaagagaaaaagaagcaggaagagaaaaaaacaaaguuugagaaccucugcaaaaucaugaaagacauauuggagaaaaaaguugaaaaggugguugugucaaaccgauuggugacaucuccaugcuguauugucacaagcacauauggcuggacagcaaacauggagagaaucaugaaagcucaagcccuaagagacaacucaacaauggguuacauggcagcaaagaaacaccuggagauaaacccugaccauuccauuauugagaccuuaaggcaaaaggcagaggcugauaagaacgacaagucugugaaggaucuggucaucuugcuuuaugaaacugcgcuccugucuucuggcuucagucuggaagauccccagacacaugcuaacaggaucuacaggaugaucaaacuuggucuggguauugaugaagaugacccuacugcugaugauaccagugcugcuguaacugaagaaaugccaccccuugaaggagaugacgacacaucacgcauggaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2663 - RNA, 721 nt, Artificial Sequence
  mRNA product Design2 comprising derived and/or modified sequence from Homo sapiens__NG_005218__HsHSP90AA3P (wt)
ggggcgcugccuacggagguggcagccaucuccuucucggcaucaagcuuaccauggauuccaguaaauuagacucugggaaagggcugcauauuaaccuuguaccaaacaaacaaaaucaaacccucacuauuguggacacuagaauuggaaugaccaagacugacuugaucaauaaccucgguacugucaccaagucugggaccaaagcauucauggaagcuuugcaggcugaugcagauaucucuaugauuggccauuucgggguugguuuuuauucugcuuauuugguugccaagaaaguaacugugaucagcaaacauaacaaugaugagcaguacaccugggaguccucagcagggggaucauucacagugaggacagacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2664 - RNA, 2557 nt, Artificial Sequence
  mRNA product Design2 comprising derived and/or modified sequence from Homo sapiens__NP_031381.2__HsHSP90AB1 (wt)
ggggcgcugccuacggagguggcagccaucuccuucucggcaucaagcuuaccaugccugaggaagugcaccauggagaggaggagguggagacuuuugccuuucaggcagaaauugcccaacucaugucccucaucaucaauaccuucuauuccaacaaggagauuuuccuucgggaguugaucucuaaugcuucugaugccuuggacaagauucgcuaugagagccugacagacccuucgaaguuggacagugguaaagagcugaaaauugacaucauccccaacccucaggaacguacccugacuuugguagacacaggcauuggcaugaccaaagcugaucucauaaauaauuugggaaccauugccaagucugguacuaaagcauucauggaggcucuucaggcuggugcagacaucuccaugauugggcaguuugguguuggcuuuuauucugccuacuugguggcagagaaagugguugugaucacaaagcacaacgaugaugaacaguaugcuugggagucuucugcuggagguuccuucacugugcgugcugaccauggugagcccauuggcagggguaccaaagugauccuccaucuuaaagaagaucagacagaguaccuagaagagaggcgggucaaagaaguagugaagaagcauucucaguucauaggcuaucccaucacccuuuauuuggagaaggaacgagagaaggaaauuagugaugaugaggcagaggaagagaaaggugagaaagaagaggaagauaaagaugaugaagaaaaacccaagaucgaagauguggguucagaugaggaggaugacagcgguaaggauaagaagaagaaaacuaagaagaucaaagagaaauacauugaucaggaagaacuaaacaagaccaagccuauuuggaccagaaacccugaugacaucacccaagaggaguauggagaauucuacaagagccucacuaaugacugggaagaccacuuggcagucaagcacuuuucuguagaaggucaguuggaauucagggcauugcuauuuauuccucgucgggcucccuuugaccuuuuugagaacaagaagaaaaagaacaacaucaaacucuauguccgccguguguucaucauggacagcugugaugaguugauaccagaguaucucaauuuuauccguggugugguugacucugaggaucugccccugaacaucucccgagaaaugcuccagcagagcaaaaucuugaaagucauucgcaaaaacauuguuaagaagugccuugagcucuucucugagcuggcagaagacaaggagaauuacaagaaauucuaugaggcauucucuaaaaaucucaagcuuggaauccacgaagacuccacuaaccgccgccgccugucugagcugcugcgcuaucauaccucccagucuggagaugagaugacaucucugucagaguauguuucucgcaugaaggagacacagaaguccaucuauuacaucacuggugagagcaaagagcagguggccaacucagcuuuuguggagcgagugcggaaacggggcuucgaggugguauauaugaccgagcccauugacgaguacugugugcagcagcucaaggaauuugaugggaagagccuggucucaguuaccaaggagggucuggagcugccugaggaugaggaggagaagaagaagauggaagagagcaaggcaaaguuugagaaccucugcaagcucaugaaagaaaucuuagauaagaagguugagaaggugacaaucuccaauagacuugugucuucaccuugcugcauugugaccagcaccuacggcuggacagccaauauggagcggaucaugaaagcccaggcacuucgggacaacuccaccaugggcuauaugauggccaaaaagcaccuggagaucaacccugaccaccccauuguggagacgcugcggcagaaggcugaggccgacaagaaugauaaggcaguuaaggaccugguggugcugcuguuugaaaccgcccugcuaucuucuggcuuuucccuugaggauccccagacccacuccaaccgcaucuaucgcaugaucaagcuaggucuagguauugaugaagaugaaguggcagcagaggaacccaaugcugcaguuccugaugagauccccccucucgagggcgaugaggaugcgucucgcauggaagaagucgauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2665 - RNA, 2794 nt, Artificial Sequence
  mRNA product Design2 comprising derived and/or modified sequence from Homo sapiens__NP_003290.1__HsHSP90B1 (wt)
ggggcgcugccuacggagguggcagccaucuccuucucggcaucaagcuuaccaugagggcccugugggugcugggccucugcugcguccugcugaccuucgggucggucagagcugacgaugaaguugauguggaugguacaguagaagaggaucuggguaaaaguagagaaggaucaaggacggaugaugaaguaguacagagagaggaagaagcuauucaguuggauggauuaaaugcaucacaaauaagagaacuuagagagaagucggaaaaguuugccuuccaagccgaaguuaacagaaugaugaaacuuaucaucaauucauuguauaaaaauaaagagauuuuccugagagaacugauuucaaaugcuucugaugcuuuagauaagauaaggcuaauaucacugacugaugaaaaugcucuuucuggaaaugaggaacuaacagucaaaauuaagugugauaaggagaagaaccugcugcaugucacagacaccgguguaggaaugaccagagaagaguugguuaaaaaccuugguaccauagccaaaucugggacaagcgaguuuuuaaacaaaaugacugaagcacaggaagauggccagucaacuucugaauugauuggccaguuuggugucgguuucuauuccgccuuccuuguagcagauaagguuauugucacuucaaaacacaacaacgauacccagcacaucugggagucugacuccaaugaauuuucuguaauugcugacccaagaggaaacacucuaggacggggaacgacaauuacccuugucuuaaaagaagaagcaucugauuaccuugaauuggauacaauuaaaaaucucgucaaaaaauauucacaguucauaaacuuuccuauuuauguauggagcagcaagacugaaacuguugaggagcccauggaggaagaagaagcagccaaagaagagaaagaagaaucugaugaugaagcugcaguagaggaagaagaagaagaaaagaaaccaaagacuaaaaaaguugaaaaaacugucugggacugggaacuuaugaaugauaucaaaccaauauggcagagaccaucaaaagaaguagaagaagaugaauacaaagcuuucuacaaaucauuuucaaaggaaagugaugaccccauggcuuauauucacuuuacugcugaaggggaaguuaccuucaaaucaauuuuauuuguacccacaucugcuccacguggucuguuugacgaauauggaucuaaaaagagcgauuacauuaagcucuaugugcgccguguauucaucacagacgacuuccaugauaugaugccuaaauaccucaauuuugucaagggugugguggacucagaugaucuccccuugaauguuucccgcgagacucuucagcaacauaaacugcuuaaggugauuaggaagaagcuuguucguaaaacgcuggacaugaucaagaagauugcugaugauaaauacaaugauacuuuuuggaaagaauuugguaccaacaucaagcuuggugugauugaagaccacucgaaucgaacacgucuugcuaaacuucuuagguuccagucuucucaucauccaacugacauuacuagccuagaccaguauguggaaagaaugaaggaaaaacaagacaaaaucuacuucauggcuggguccagcagaaaagaggcugaaucuucuccauuuguugagcgacuucugaaaaagggcuaugaaguuauuuaccucacagaaccuguggaugaauacuguauucaggcccuucccgaauuugaugggaagagguuccagaauguugccaaggaaggagugaaguucgaugaaagugagaaaacuaaggagagucgugaagcaguugagaaagaauuugagccucugcugaauuggaugaaagauaaagcccuuaaggacaagauugaaaaggcuguggugucucagcgccugacagaaucuccgugugcuuugguggccagccaguacggauggucuggcaacauggagagaaucaugaaagcacaagcguaccaaacgggcaaggacaucucuacaaauuacuaugcgagucagaagaaaacauuugaaauuaaucccagacacccgcugaucagagacaugcuucgacgaauuaaggaagaugaagaugauaaaacaguuuuggaucuugcugugguuuuguuugaaacagcaacgcuucggucaggguaucuuuuaccagacacuaaagcauauggagauagaauagaaagaaugcuucgccucaguuugaacauugacccugaugcaaagguggaagaagagcccgaagaagaaccugaagagacagcagaagacacaacagaagacacagagcaagacgaagaugaagaaauggaugugggaacagaugaagaagaagaaacagcaaaggaaucuacagcugaaaaagaugaauuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2666 - RNA, 2497 nt, Artificial Sequence
  mRNA product Design2 comprising derived and/or modified sequence from Homo sapiens__NP_057376.2__HsTRAP1 (wt)
ggggcgcugccuacggagguggcagccaucuccuucucggcaucaagcuuaccauggcgcgcgagcugcgggcgcugcugcuguggggccgccgccugcggccuuugcugcgggcgccggcgcuggcggccgugccgggaggaaaaccaauucuguguccucggaggaccacagcccaguugggccccaggcgaaacccagccuggagcuugcaggcaggacgacuguucagcacgcagaccgccgaggacaaggaggaaccccugcacucgauuaucagcagcacagagagcgugcaggguuccacuuccaaacaugaguuccaggccgagacaaagaagcuuuuggacauuguugcccggucccuguacucagaaaaagagguguuuauacgggagcugaucuccaaugccagcgaugccuuggaaaaacugcgucacaaacuggugucugacggccaagcacugccagaaauggagauucacuugcagaccaaugccgagaaaggcaccaucaccauccaggauacugguaucgggaugacacaggaagagcugguguccaaccuggggacgauugccagaucggggucaaaggccuuccuggaugcucugcagaaccaggcugaggccagcagcaagaucaucggccaguuuggaguggguuucuacucagcuuucaugguggcugacagaguggaggucuauucccgcucggcagccccggggagccuggguuaccaguggcuuucagaugguucuggaguguuugaaaucgccgaagcuucgggaguuagaaccgggacaaaaaucaucauccaccugaaauccgacugcaaggaguuuuccagcgaggcccgggugcgagaugugguaacgaaguacagcaacuucgucagcuuccccuuguacuugaauggaaggcggaugaacaccuugcaggccaucuggaugauggaccccaaggauguccgugaguggcaacaugaggaguucuaccgcuacgucgcgcaggcucacgacaagccccgcuacacccugcacuauaagacggacgcaccgcucaacauccgcagcaucuucuacgugcccgacaugaaaccguccauguuugaugugagccgggagcugggcuccagcguugcacuguacagccgcaaaguccucauccagaccaaggccacggacauccugcccaaguggcugcgcuucauccgaggugugguggacagugaggacauuccccugaaccucagccgggagcugcugcaggagagcgcacucaucaggaaacuccgggacguuuuacagcagaggcugaucaaauucuucauugaccagaguaaaaaagaugcugagaaguaugcaaaguuuuuugaagauuacggccuguucaugcgggagggcauugugaccgccaccgagcaggaggucaaggaggacauagcaaagcugcugcgcuacgaguccucggcgcugcccuccgggcagcuaaccagccucucagaauacgccagccgcaugcgggccggcacccgcaacaucuacuaccugugcgcccccaaccgucaccuggcagagcacucacccuacuaugaggccaugaagaagaaagacacagagguucucuucugcuuugagcaguuugaugagcucacccugcugcaccuucgugaguuugacaagaagaagcugaucucuguggagacggacauagucguggaucacuacaaggaggagaaguuugaggacagguccccagccgccgagugccuaucagagaaggagacggaggagcucauggccuggaugagaaaugugcuggggucgcgugucaccaacgugaaggugacccuccgacuggacacccacccugccauggucaccgugcuggagaugggggcugcccgccacuuccugcgcaugcagcagcuggccaagacccaggaggagcgcgcacagcuccugcagcccacgcuggagaucaaccccaggcacgcgcucaucaagaagcugaaucagcugcgcgcaagcgagccuggccuggcucagcugcugguggaucagauauacgagaacgccaugauugcugcuggacuuguugacgacccuagggccauggugggccgcuugaaugagcugcuugucaaggcccuggagcgacacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2667 - RNA, 844 nt, Artificial Sequence
  mRNA product Design2 comprising derived and/or modified sequence from Homo sapiens__NP_000609.1__HsIGF1 (wt)
ggggcgcugccuacggagguggcagccaucuccuucucggcaucaagcuuaccaugggaaaaaucagcagucuuccaacccaauuauuuaagugcugcuuuugugauuucuugaaggugaagaugcacaccauguccuccucgcaucucuucuaccuggcgcugugccugcucaccuucaccagcucugccacggcuggaccggagacgcucugcggggcugagcugguggaugcucuucaguucguguguggagacaggggcuuuuauuucaacaagcccacaggguauggcuccagcagucggagggcgccucagacaggcaucguggaugagugcugcuuccggagcugugaucuaaggaggcuggagauguauugcgcaccccucaagccugccaagucagcucgcucuguccgugcccagcgccacaccgacaugcccaagacccagaaggaaguacauuugaagaacgcaaguagagggagugcaggaaacaagaacuacaggauguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2668 - RNA, 925 nt, Artificial Sequence
  mRNA product Design2 comprising derived and/or modified sequence from Homo sapiens__NP_000603.1__HsIGF2 (wt)
ggggcgcugccuacggagguggcagccaucuccuucucggcaucaagcuuaccaugggaaucccaauggggaagucgaugcuggugcuucucaccuucuuggccuucgccucgugcugcauugcugcuuaccgccccagugagacccugugcggcggggagcugguggacacccuccaguucgucuguggggaccgcggcuucuacuucagcaggcccgcaagccgugugagccgucgcagccguggcaucguugaggagugcuguuuccgcagcugugaccuggcccuccuggagacguacugugcuacccccgccaaguccgagagggacgugucgaccccuccgaccgugcuuccggacaacuuccccagauaccccgugggcaaguucuuccaauaugacaccuggaagcaguccacccagcgccugcgcaggggccugccugcccuccugcgugcccgccggggucacgugcucgccaaggagcucgaggcguucagggaggccaaacgucaccguccccugauugcucuacccacccaagaccccgcccacgggggcgcccccccagagauggccagcaaucggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2669 - RNA, 1021 nt, Artificial Sequence
  mRNA product Design2 comprising derived and/or modified sequence from Homo sapiens__NP_000591.1__HsIL6 (wt)
ggggcgcugccuacggagguggcagccaucuccuucucggcaucaagcuuaccaugaacuccuucuccacaagcgccuucgguccaguugccuucucccuggggcugcuccugguguugccugcugccuucccugccccaguacccccaggagaagauuccaaagauguagccgccccacacagacagccacucaccucuucagaacgaauugacaaacaaauucgguacauccucgacggcaucucagcccugagaaaggagacauguaacaagaguaacaugugugaaagcagcaaagaggcacuggcagaaaacaaccugaaccuuccaaagauggcugaaaaagauggaugcuuccaaucuggauucaaugaggagacuugccuggugaaaaucaucacuggucuuuuggaguuugagguauaccuagaguaccuccagaacagauuugagaguagugaggaacaagccagagcugugcagaugaguacaaaaguccugauccaguuccugcagaaaaaggcaaagaaucuagaugcaauaaccaccccugacccaaccacaaaugccagccugcugacgaagcugcaggcacagaaccaguggcugcaggacaugacaacucaucucauucugcgcagcuuuaaggaguuccugcaguccagccugagggcucuucggcaaauguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2670 - RNA, 1663 nt, Artificial Sequence
  mRNA product Design2 comprising derived and/or modified sequence from Homo sapiens__NP_002183.1__HsINHBA (wt)
ggggcgcugccuacggagguggcagccaucuccuucucggcaucaagcuuaccaugcccuugcuuuggcugagaggauuucuguuggcaaguugcuggauuauagugaggaguucccccaccccaggauccgaggggcacagcgcggcccccgacuguccguccugugcgcuggccgcccucccaaaggauguacccaacucucagccagagaugguggaggccgucaagaagcacauuuuaaacaugcugcacuugaagaagagacccgaugucacccagccgguacccaaggcggcgcuucugaacgcgaucagaaagcuucaugugggcaaagucggggagaacggguauguggagauagaggaugacauuggaaggagggcagaaaugaaugaacuuauggagcagaccucggagaucaucacguuugccgagucaggaacagccaggaagacgcugcacuucgagauuuccaaggaaggcagugaccugucagugguggagcgugcagaagucuggcucuuccuaaaaguccccaaggccaacaggaccaggaccaaagucaccauccgccucuuccagcagcagaagcacccgcagggcagcuuggacacaggggaagaggccgaggaagugggcuuaaagggggagaggagugaacuguugcucucugaaaaaguaguagacgcucggaagagcaccuggcaugucuucccugucuccagcagcauccagcgguugcuggaccagggcaagagcucccuggacguucggauugccugugagcagugccaggagaguggcgccagcuugguucuccugggcaagaagaagaagaaagaagaggagggggaagggaaaaagaagggcggaggugaagguggggcaggagcagaugaggaaaaggagcagucgcacagaccuuuccucaugcugcaggcccggcagucugaagaccacccucaucgccggcgucggcggggcuuggagugugauggcaaggucaacaucugcuguaagaaacaguucuuugucaguuucaaggacaucggcuggaaugacuggaucauugcucccucuggcuaucaugccaacuacugcgagggugagugcccgagccauauagcaggcacguccggguccucacuguccuuccacucaacagucaucaaccacuaccgcaugcggggccauagccccuuugccaaccucaaaucgugcugugugcccaccaagcugagacccauguccauguuguacuaugaugauggucaaaacaucaucaaaaaggacauucagaacaugaucguggaggagugugggugcucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2671 - RNA, 1606 nt, Artificial Sequence
  mRNA product Design2 comprising derived and/or modified sequence from Homo sapiens__NP_002184.2__HsINHBB (wt)
ggggcgcugccuacggagguggcagccaucuccuucucggcaucaagcuuaccauggacgggcugcccggucgggcgcugggggccgccugccuucugcugcuggcggccggcuggcuggggccugaggccuggggcucacccacgcccccgccgacgccugccgcgccgccgccacccccgccacccggauccccggguggcucgcaggacaccuguacgucgugcggcggcuuccggcggccagaggagcucggccgaguggacggcgacuuccuggaggcggugaagcggcacaucuugagccgccugcagaugcggggccggcccaacaucacgcacgccgugccuaaggccgccauggucacggcccugcgcaagcugcacgcgggcaaggugcgcgaggacggccgcguggagaucccgcaccucgacggccacgccagcccgggcgccgacggccaggagcgcguuuccgaaaucaucagcuucgccgagacagauggccucgccuccucccggguccgccuauacuucuucaucuccaacgaaggcaaccagaaccuguuugugguccaggccagccuguggcuuuaccugaaacuccugcccuacguccuggagaagggcagccggcggaaggugcgggucaaaguguacuuccaggagcagggccacggugacagguggaacaugguggagaagaggguggaccucaagcgcagcggcuggcauaccuucccacucacggaggccauccaggccuuguuugagcggggcgagcggcgacucaaccuagacgugcagugugacagcugccaggagcuggccguggugccgguguucguggacccaggcgaagagucgcaccggcccuuugugguggugcaggcucggcugggcgacagcaggcaccgcauucgcaagcgaggccuggagugcgauggccggaccaaccucuguugcaggcaacaguucuucauugacuuccgccucaucggcuggaacgacuggaucauagcacccaccggcuacuacgggaacuacugugagggcagcugcccagccuaccuggcagggguccccggcucugccuccuccuuccacacggcuguggugaaccaguaccgcaugcggggucugaaccccggcacggugaacuccugcugcauucccaccaagcugagcaccauguccaugcuguacuucgaugaugaguacaacaucgucaagcgggacgugcccaacaugauuguggaggagugcggcugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2672 - RNA, 3841 nt, Artificial Sequence
  mRNA product Design2 comprising derived and/or modified sequence from Homo sapiens__NP_000623.2__HsITGAM (wt)
ggggcgcugccuacggagguggcagccaucuccuucucggcaucaagcuuaccauggcucucagaguccuucuguuaacagccuugaccuuaugucauggguucaacuuggacacugaaaacgcaaugaccuuccaagagaacgcaaggggcuucgggcagagcgugguccagcuucagggauccaggguggugguuggagccccccaggagauaguggcugccaaccaaaggggcagccucuaccagugcgacuacagcacaggcucaugcgagcccauccgccugcagguccccguggaggccgugaacaugucccugggccugucccuggcagccaccaccagccccccucagcugcuggccuguggucccaccgugcaccagacuugcagugagaacacguaugugaaagggcucugcuuccuguuuggauccaaccuacggcagcagccccagaaguucccagaggcccuccgaggguguccucaagaggauagugacauugccuucuugauugauggcucugguagcaucaucccacaugacuuucggcggaugaaggaguuugucucaacugugauggagcaauuaaaaaaguccaaaaccuuguucucuuugaugcaguacucugaagaauuccggauucacuuuaccuucaaagaguuccagaacaacccuaacccaagaucacuggugaagccaauaacgcagcugcuugggcggacacacacggccacgggcauccgcaaagugguacgagagcuguuuaacaucaccaacggagcccgaaagaaugccuuuaagauccuaguugucaucacggauggagaaaaguuuggcgaucccuugggauaugaggaugucaucccugaggcagacagagagggagucauucgcuacgucauuggggugggagaugccuuccgcagugagaaaucccgccaagagcuuaauaccaucgcauccaagccgccucgugaucacguguuccaggugaauaacuuugaggcucugaagaccauucagaaccagcuucgggagaagaucuuugcgaucgaggguacucagacaggaaguagcagcuccuuugagcaugagaugucucaggaaggcuucagcgcugccaucaccucuaauggccccuugcugagcacuguggggagcuaugacugggcugguggagucuuucuauauacaucaaaggagaaaagcaccuucaucaacaugaccagaguggauucagacaugaaugaugcuuacuuggguuaugcugccgccaucaucuuacggaaccgggugcaaagccugguucugggggcaccucgauaucagcacaucggccugguagcgauguucaggcagaacacuggcaugugggaguccaacgcuaaugucaagggcacccagaucggcgccuacuucggggccucccucugcuccguggacguggacagcaacggcagcaccgaccugguccucaucggggccccccauuacuacgagcagacccgagggggccagguguccgugugccccuugcccagggggagggcucgguggcagugugaugcuguucucuacggggagcagggccaacccuggggccgcuuuggggcagcccuaacagugcugggggacguaaauggggacaagcugacggacguggccauuggggccccaggagaggaggacaaccggggugcuguuuaccuguuucacggaaccucaggaucuggcaucagccccucccauagccagcggauagcaggcuccaagcucucucccaggcuccaguauuuuggucagucacugagugggggccaggaccucacaauggauggacugguagaccugacuguaggagcccaggggcacgugcugcugcucaggucccagccaguacugagagucaaggcaaucauggaguucaaucccagggaaguggcaaggaauguauuugaguguaaugaucagguggugaaaggcaaggaagccggagaggucagagucugccuccauguccagaagagcacacgggaucggcuaagagaaggacagauccagaguguugugacuuaugaccuggcucuggacuccggccgcccacauucccgcgccgucuucaaugagacaaagaacagcacacgcagacagacacaggucuuggggcugacccagacuugugagacccugaaacuacaguugccgaauugcaucgaggacccagugagccccauugugcugcgccugaacuucucucuggugggaacgccauugucugcuuucgggaaccuccggccagugcuggcggaggaugcucagagacucuucacagccuuguuucccuuugagaagaauuguggcaaugacaacaucugccaggaugaccucagcaucaccuucaguuucaugagccuggacugccucguggugggugggccccgggaguucaacgugacagugacugugagaaaugauggugaggacuccuacaggacacaggucaccuucuucuucccgcuugaccuguccuaccggaagguguccacgcuccagaaccagcgcucacagcgauccuggcgccuggccugugagucugccuccuccaccgaagugucuggggccuugaagagcaccagcugcagcauaaaccaccccaucuucccggaaaacucagaggucaccuuuaauaucacguuugauguagacucuaaggcuucccuuggaaacaaacugcuccucaaggccaaugugaccagugagaacaacaugcccagaaccaacaaaaccgaauuccaacuggagcugccggugaaauaugcugucuacaugguggucaccagccauggggucuccacuaaauaucucaacuucacggccucagagaauaccagucgggucaugcagcaucaauaucaggucagcaaccuggggcagaggagccuccccaucagccugguguucuuggugcccguccggcugaaccagacugucauaugggaccgcccccaggucaccuucuccgagaaccucucgaguacgugccacaccaaggagcgcuugcccucucacuccgacuuucuggcugagcuucggaaggcccccguggugaacugcuccaucgcugucugccagagaauccagugugacaucccguucuuuggcauccaggaagaauucaaugcuacccucaaaggcaaccucucguuugacugguacaucaagaccucgcauaaccaccuccugaucgugagcacagcugagaucuuguuuaacgauuccguguucacccugcugccgggacagggggcguuugugaggucccagacggagaccaaaguggagccguucgagguccccaacccccugccgcucaucgugggcagcucugucgggggacugcugcuccuggcccucaucaccgccgcgcuguacaagcucggcuucuucaagcggcaauacaaggacaugaugagugaagggggucccccgggggccgaaccccaguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2673 - RNA, 1786 nt, Artificial Sequence
  mRNA product Design2 comprising derived and/or modified sequence from Homo sapiens__NP_002415.1__HsMMP8 (wt)
ggggcgcugccuacggagguggcagccaucuccuucucggcaucaagcuuaccauguucucccugaagacgcuuccauuucugcucuuacuccaugugcagauuuccaaggccuuuccuguaucuucuaaagagaaaaauacaaaaacuguucaggacuaccuggaaaaguucuaccaauuaccaagcaaccaguaucagucuacaaggaagaauggcacuaaugugaucguugaaaagcuuaaagaaaugcagcgauuuuuuggguugaaugugacggggaagccaaaugaggaaacucuggacaugaugaaaaagccucgcuguggagugccugacaguggugguuuuauguuaaccccaggaaaccccaagugggaacgcacuaacuugaccuacaggauucgaaacuauaccccacagcugucagaggcugagguagaaagagcuaucaaggaugccuuugaacucuggaguguugcaucaccucucaucuucaccaggaucucacagggagaggcagauaucaacauugcuuuuuaccaaagagaucacggugacaauucuccauuugauggacccaauggaauccuugcucaugccuuucagccaggccaagguauuggaggagaugcucauuuugaugccgaagaaacauggaccaacaccuccgcaaauuacaacuuguuucuuguugcugcucaugaauuuggccauucuuuggggcucgcucacuccucugacccuggugccuugauguaucccaacuaugcuuucagggaaaccagcaacuacucacucccucaagaugacaucgauggcauucaggccaucuauggacuuucaagcaacccuauccaaccuacuggaccaagcacacccaaacccugugaccccaguuugacauuugaugcuaucaccacacuccguggagaaauacuuuucuuuaaagacagguacuucuggagaaggcauccucagcuacaaagagucgaaaugaauuuuauuucucuauucuggccaucccuuccaacugguauacaggcugcuuaugaagauuuugacagagaccucauuuuccuauuuaaaggcaaccaauacugggcucugaguggcuaugauauucugcaagguuaucccaaggauauaucaaacuauggcuuccccagcagcguccaagcaauugacgcagcuguuuucuacagaaguaaaacauacuucuuuguaaaugaccaauucuggagauaugauaaccaaagacaauucauggagccagguuaucccaaaagcauaucaggugccuuuccaggaauagagaguaaaguugaugcaguuuuccagcaagaacauuucuuccaugucuucaguggaccaagauauuacgcauuugaucuuauugcucagagaguuaccagaguugcaagaggcaauaaauggcuuaacuguagauauggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2674 - RNA, 2506 nt, Artificial Sequence
  mRNA product Design2 comprising derived and/or modified sequence from Homo sapiens__NP_004985.2__HsMMP9 (wt)
ggggcgcugccuacggagguggcagccaucuccuucucggcaucaagcuuaccaugagccucuggcagccccugguccuggugcuccuggugcugggcugcugcuuugcugcccccagacagcgccaguccacccuugugcucuucccuggagaccugagaaccaaucucaccgacaggcagcuggcagaggaauaccuguaccgcuaugguuacacucggguggcagagaugcguggagagucgaaaucucuggggccugcgcugcugcuucuccagaagcaacugucccugcccgagaccggugagcuggauagcgccacgcugaaggccaugcgaaccccacggugcggggucccagaccugggcagauuccaaaccuuugagggcgaccucaaguggcaccaccacaacaucaccuauuggauccaaaacuacucggaagacuugccgcgggcggugauugacgacgccuuugcccgcgccuucgcacuguggagcgcggugacgccgcucaccuucacucgcguguacagccgggacgcagacaucgucauccaguuuggugucgcggagcacggagacggguaucccuucgacgggaaggacgggcuccuggcacacgccuuuccuccuggccccggcauucagggagacgcccauuucgacgaugacgaguuguggucccugggcaagggcgucgugguuccaacucgguuuggaaacgcagauggcgcggccugccacuuccccuucaucuucgagggccgcuccuacucugccugcaccaccgacggucgcuccgacggcuugcccuggugcaguaccacggccaacuacgacaccgacgaccgguuuggcuucugccccagcgagagacucuacacccaggacggcaaugcugaugggaaacccugccaguuuccauucaucuuccaaggccaauccuacuccgccugcaccacggacggucgcuccgacggcuaccgcuggugcgccaccaccgccaacuacgaccgggacaagcucuucggcuucugcccgacccgagcugacucgacggugauggggggcaacucggcgggggagcugugcgucuuccccuucacuuuccuggguaaggaguacucgaccuguaccagcgagggccgcggagaugggcgccucuggugcgcuaccaccucgaacuuugacagcgacaagaaguggggcuucugcccggaccaaggauacaguuuguuccucguggcggcgcaugaguucggccacgcgcugggcuuagaucauuccucagugccggaggcgcucauguacccuauguaccgcuucacugaggggccccccuugcauaaggacgacgugaauggcauccggcaccucuaugguccucgcccugaaccugagccacggccuccaaccaccaccacaccgcagcccacggcucccccgacggucugccccaccggaccccccacuguccaccccucagagcgccccacagcuggccccacagguccccccucagcuggccccacagguccccccacugcuggcccuucuacggccacuacugugccuuugaguccgguggacgaugccugcaacgugaacaucuucgacgccaucgcggagauugggaaccagcuguauuuguucaaggaugggaaguacuggcgauucucugagggcagggggagccggccgcagggccccuuccuuaucgccgacaaguggcccgcgcugccccgcaagcuggacucggucuuugaggagcggcucuccaagaagcuuuucuucuucucugggcgccagguguggguguacacaggcgcgucggugcugggcccgaggcgucuggacaagcugggccugggagccgacguggcccaggugaccggggcccuccggaguggcagggggaagaugcugcuguucagcgggcggcgccucuggagguucgacgugaaggcgcagaugguggauccccggagcgccagcgagguggaccggauguuccccggggugccuuuggacacgcacgacgucuuccaguaccgagagaaagccuauuucugccaggaccgcuucuacuggcgcgugaguucccggagugaguugaaccagguggaccaagugggcuacgugaccuaugacauccugcagugcccugaggacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2675 - RNA, 1798 nt, Artificial Sequence
  mRNA product Design2 comprising derived and/or modified sequence from Homo sapiens__NP_002418.1__HsMMP13 (wt)
ggggcgcugccuacggagguggcagccaucuccuucucggcaucaagcuuaccaugcauccagggguccuggcugccuuccucuucuugagcuggacucauugucgggcccugccccuucccagugguggugaugaagaugauuugucugaggaagaccuccaguuugcagagcgcuaccugagaucauacuaccauccuacaaaucucgcgggaauccugaaggagaaugcagcaagcuccaugacugagaggcuccgagaaaugcagucuuucuucggcuuagaggugacuggcaaacuugacgauaacaccuuagaugucaugaaaaagccaagaugcgggguuccugaugugggugaauacaauguuuucccucgaacucuuaaaugguccaaaaugaauuuaaccuacagaauugugaauuacaccccugauaugacucauucugaagucgaaaaggcauucaaaaaagccuucaaaguuugguccgauguaacuccucugaauuuuaccagacuucacgauggcauugcugacaucaugaucucuuuuggaauuaaggagcauggcgacuucuacccauuugaugggcccucuggccugcuggcucaugcuuuuccuccugggccaaauuauggaggagaugcccauuuugaugaugaugaaaccuggacaaguaguuccaaaggcuacaacuuguuucuuguugcugcgcaugaguucggccacuccuuaggucuugaccacuccaaggacccuggagcacucauguuuccuaucuacaccuacaccggcaaaagccacuuuaugcuuccugaugacgauguacaagggauccagucucucuaugguccaggagaugaagaccccaacccuaaacauccaaaaacgccagacaaaugugacccuuccuuaucccuugaugccauuaccagucuccgaggagaaacaaugaucuuuaaagacagauucuucuggcgccugcauccucagcagguugaugcggagcuguuuuuaacgaaaucauuuuggccagaacuucccaaccguauugaugcugcauaugagcacccuucucaugaccucaucuucaucuucagagguagaaaauuuugggcucuuaaugguuaugacauucuggaagguuaucccaaaaaaauaucugaacugggucuuccaaaagaaguuaagaagauaagugcagcuguucacuuugaggauacaggcaagacucuccuguucucaggaaaccaggucuggagauaugaugauacuaaccauauuauggauaaagacuauccgagacuaauagaagaagacuucccaggaauuggugauaaaguagaugcugucuaugagaaaaaugguuauaucuauuuuuucaacggacccauacaguuugaauacagcaucuggaguaaccguauuguucgcgucaugccagcaaauuccauuuugugguguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2676 - RNA, 1450 nt, Artificial Sequence
  mRNA product Design2 comprising derived and/or modified sequence from Homo sapiens__NP_001286.1__HsCCR1 (wt)
ggggcgcugccuacggagguggcagccaucuccuucucggcaucaagcuuaccauggaaacuccaaacaccacagaggacuaugacacgaccacagaguuugacuauggggaugcaacuccgugccagaaggugaacgagagggccuuuggggcccaacugcugcccccucuguacuccuugguauuugucauuggccugguuggaaacauccuggugguccugguccuugugcaauacaagaggcuaaaaaacaugaccagcaucuaccuccugaaccuggccauuucugaccugcucuuccuguucacgcuucccuucuggaucgacuacaaguugaaggaugacuggguuuuuggugaugccauguguaagauccucucuggguuuuauuacacaggcuuguacagcgagaucuuuuucaucauccugcugacgauugacagguaccuggccaucguccacgccguguuugccuugcgggcacggaccgucacuuuuggugucaucaccagcaucaucauuugggcccuggccaucuuggcuuccaugccaggcuuauacuuuuccaagacccaaugggaauucacucaccacaccugcagccuucacuuuccucacgaaagccuacgagaguggaagcuguuucaggcucugaaacugaaccucuuugggcugguauugccuuuguuggucaugaucaucugcuacacagggauuauaaagauucugcuaagacgaccaaaugagaagaaauccaaagcuguccguuugauuuuugucaucaugaucaucuuuuuucucuuuuggacccccuacaauuugacuauacuuauuucuguuuuccaagacuuccuguucacccaugagugugagcagagcagacauuuggaccuggcugugcaagugacggaggugaucgccuacacgcacugcugugucaacccagugaucuacgccuucguuggugagagguuccggaaguaccugcggcaguuguuccacaggcguguggcugugcaccugguuaaauggcuccccuuccucuccguggacaggcuggagagggucagcuccacaucucccuccacaggggagcaugaacucucugcuggguucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2677 - RNA, 1018 nt, Artificial Sequence
  mRNA product Design2 comprising derived and/or modified sequence from Homo sapiens__NP_002598.4__HsPDGFA (wt)
ggggcgcugccuacggagguggcagccaucuccuucucggcaucaagcuuaccaugaggaccuuggcuugccugcugcuccucggcugcggauaccucgcccauguucuggccgaggaagccgagaucccccgcgaggugaucgagaggcuggcccgcagucagauccacagcauccgggaccuccagcgacuccuggagauagacuccguagggagugaggauucuuuggacaccagccugagagcucacgggguccaugccacuaagcaugugcccgagaagcggccccugcccauucggaggaagagaagcaucgaggaagcuguccccgcugucugcaagaccaggacggucauuuacgagauuccucggagucaggucgaccccacguccgccaacuuccugaucuggcccccgugcguggaggugaaacgcugcaccggcugcugcaacacgagcagugucaagugccagcccucccgcguccaccaccgcagcgucaagguggccaagguggaauacgucaggaagaagccaaaauuaaaagaaguccaggugagguuagaggagcauuuggagugcgccugcgcgaccacaagccugaauccggauuaucgggaagaggacacgggaaggccuagggagucagguaaaaaacggaaaagaaaaagguuaaaacccaccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2678 - RNA, 1108 nt, Artificial Sequence
  mRNA product Design2 comprising derived and/or modified sequence from Homo sapiens__NP_002599.1__HsPDGFB (wt)
ggggcgcugccuacggagguggcagccaucuccuucucggcaucaagcuuaccaugaaucgcugcugggcgcucuuccugucucucugcugcuaccugcgucuggucagcgccgagggggaccccauucccgaggagcuuuaugagaugcugagugaccacucgauccgcuccuuugaugaucuccaacgccugcugcacggagaccccggagaggaagauggggccgaguuggaccugaacaugacccgcucccacucuggaggcgagcuggagagcuuggcucguggaagaaggagccuggguucccugaccauugcugagccggccaugaucgccgagugcaagacgcgcaccgagguguucgagaucucccggcgccucauagaccgcaccaacgccaacuuccugguguggccgcccuguguggaggugcagcgcugcuccggcugcugcaacaaccgcaacgugcagugccgccccacccaggugcagcugcgaccuguccaggugagaaagaucgagauugugcggaagaagccaaucuuuaagaaggccacggugacgcuggaagaccaccuggcaugcaagugugagacaguggcagcugcacggccugugacccgaagcccgggggguucccaggagcagcgagccaaaacgccccaaacucgggugaccauucggacggugcgaguccgccggccccccaagggcaagcaccggaaauucaagcacacgcaugacaagacggcacugaaggagacccuuggagccuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2679 - RNA, 1420 nt, Artificial Sequence
  mRNA product Design2 comprising derived and/or modified sequence from Homo sapiens__NP_057289.1__HsPDGFC (wt)
ggggcgcugccuacggagguggcagccaucuccuucucggcaucaagcuuaccaugagccucuucgggcuucuccugcugacaucugcccuggccggccagagacaggggacucaggcggaauccaaccugaguaguaaauuccaguuuuccagcaacaaggaacagaacggaguacaagauccucagcaugagagaauuauuacugugucuacuaauggaaguauucacagcccaagguuuccucauacuuauccaagaaauacggucuugguauggagauuaguagcaguagaggaaaauguauggauacaacuuacguuugaugaaagauuugggcuugaagacccagaagaugacauaugcaaguaugauuuuguagaaguugaggaacccagugauggaacuauauuagggcgcuggugugguucugguacuguaccaggaaaacagauuucuaaaggaaaucaaauuaggauaagauuuguaucugaugaauauuuuccuucugaaccaggguucugcauccacuacaacauugucaugccacaauucacagaagcugugaguccuucagugcuacccccuucagcuuugccacuggaccugcuuaauaaugcuauaacugccuuuaguaccuuggaagaccuuauucgauaucuugaaccagagagauggcaguuggacuuagaagaucuauauaggccaacuuggcaacuucuuggcaaggcuuuuguuuuuggaagaaaauccagagugguggaucugaaccuucuaacagaggagguaagauuauacagcugcacaccucguaacuucucaguguccauaagggaagaacuaaagagaaccgauaccauuuucuggccagguugucuccugguuaaacgcuguggugggaacugugccuguugucuccacaauugcaaugaaugucaaugugucccaagcaaaguuacuaaaaaauaccacgagguccuucaguugagaccaaagaccggugucaggggauugcacaaaucacucaccgacguggcccuggagcaccaugaggagugugacugugugugcagagggagcacaggaggauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2680 - RNA, 1477 nt, Artificial Sequence
  mRNA product Design2 comprising derived and/or modified sequence from Homo sapiens__NP_149126.1__HsPDGFD (wt)
ggggcgcugccuacggagguggcagccaucuccuucucggcaucaagcuuaccaugcaccggcucaucuuugucuacacucuaaucugcgcaaacuuuugcagcugucgggacacuucugcaaccccgcagagcgcauccaucaaagcuuugcgcaacgccaaccucaggcgagaugacuuguaccgaagagaugagaccauccaggugaaaggaaacggcuacgugcagaguccuagauucccgaacagcuaccccaggaaccugcuccugacauggcggcuucacucucaggagaauacacggauacagcuaguguuugacaaucaguuuggauuagaggaagcagaaaaugauaucuguagguaugauuuuguggaaguugaagauauauccgaaaccaguaccauuauuagaggacgaugguguggacacaaggaaguuccuccaaggauaaaaucaagaacgaaccaaauuaaaaucacauucaaguccgaugacuacuuuguggcuaaaccuggauucaagauuuauuauucuuugcuggaagauuuccaacccgcagcagcuucagagaccaacugggaaucugucacaagcucuauuucagggguauccuauaacucuccaucaguaacggaucccacucugauugcggaugcucuggacaaaaaaauugcagaauuugauacaguggaagaucugcucaaguacuucaauccagagucauggcaagaagaucuugagaauauguaucuggacaccccucgguaucgaggcaggucauaccaugaccggaagucaaaaguugaccuggauaggcucaaugaugaugccaagcguuacaguugcacucccaggaauuacucggucaauauaagagaagagcugaaguuggccaauguggucuucuuuccacguugccuccucgugcagcgcuguggaggaaauuguggcuguggaacugucaacuggagguccugcacaugcaauucagggaaaaccgugaaaaaguaucaugagguauuacaguuugagccuggccacaucaagaggagggguagagcuaagaccauggcucuaguugacauccaguuggaucaccaugaacgaugugauuguaucugcagcucaagaccaccucgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2681 - RNA, 1060 nt, Artificial Sequence
  mRNA product Design2 comprising derived and/or modified sequence from Homo sapiens__NP_003946.3__HsSOCS3 (wt)
ggggcgcugccuacggagguggcagccaucuccuucucggcaucaagcuuaccauggucacccacagcaaguuucccgccgccgggaugagccgcccccuggacaccagccugcgccucaagaccuucagcuccaagagcgaguaccagcugguggugaacgcagugcgcaagcugcaggagagcggcuucuacuggagcgcagugaccggcggcgaggcgaaccugcugcucagugccgagcccgccggcaccuuucugauccgcgacagcucggaccagcgccacuucuucacgcucagcgucaagacccagucugggaccaagaaccugcgcauccagugugaggggggcagcuucucucugcagagcgauccccggagcacgcagcccgugccccgcuucgacugcgugcucaagcuggugcaccacuacaugccgcccccuggagcccccuccuuccccucgccaccuacugaacccuccuccgaggugcccgagcagccgucugcccagccacucccugggaguccccccagaagagccuauuacaucuacuccgggggcgagaagaucccccugguguugagccggccccucuccuccaacguggccacucuucagcaucucugucggaagaccgucaacggccaccuggacuccuaugagaaagucacccagcugccggggcccauucgggaguuccuggaccaguacgaugccccgcuuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2682 - RNA, 865 nt, Artificial Sequence
  mRNA product Design2 comprising derived and/or modified sequence from Homo sapiens__NP_003227.1__HsTGFA (wt)
ggggcgcugccuacggagguggcagccaucuccuucucggcaucaagcuuaccaugguccccucggcuggacagcucgcccuguucgcucuggguauuguguuggcugcgugccaggccuuggagaacagcacguccccgcugagugcagacccgcccguggcugcagcaguggugucccauuuuaaugacugcccagauucccacacucaguucugcuuccauggaaccugcagguuuuuggugcaggaggacaagccagcaugugucugccauucuggguacguuggugcacgcugugagcaugcggaccuccuggccgugguggcugccagccagaagaagcaggccaucaccgccuuggugguggucuccaucguggcccuggcuguccuuaucaucacaugugugcugauacacugcugccagguccgaaaacacugugaguggugccgggcccucaucugccggcacgagaagcccagcgcccuccugaagggaagaaccgcuugcugccacucagaaacaguggucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2683 - RNA, 1555 nt, Artificial Sequence
  mRNA product Design2 comprising derived and/or modified sequence from Homo sapiens__NP_000651.3__HsTGFB1 (wt)
ggggcgcugccuacggagguggcagccaucuccuucucggcaucaagcuuaccaugccgcccuccgggcugcggcugcugccgcugcugcuaccgcugcuguggcuacuggugcugacgccuggccggccggccgcgggacuauccaccugcaagacuaucgacauggagcuggugaagcggaagcgcaucgaggccauccgcggccagauccuguccaagcugcggcucgccagccccccgagccagggggaggugccgcccggcccgcugcccgaggccgugcucgcccuguacaacagcacccgcgaccggguggccggggagagugcagaaccggagcccgagccugaggccgacuacuacgccaaggaggucacccgcgugcuaaugguggaaacccacaacgaaaucuaugacaaguucaagcagaguacacacagcauauauauguucuucaacacaucagagcuccgagaagcgguaccugaacccguguugcucucccgggcagagcugcgucugcugaggcucaaguuaaaaguggagcagcacguggagcuguaccagaaauacagcaacaauuccuggcgauaccucagcaaccggcugcuggcacccagcgacucgccagagugguuaucuuuugaugucaccggaguugugcggcagugguugagccguggaggggaaauugagggcuuucgccuuagcgcccacugcuccugugacagcagggauaacacacugcaaguggacaucaacggguucacuaccggccgccgaggugaccuggccaccauucauggcaugaaccggccuuuccugcuucucauggccaccccgcuggagagggcccagcaucugcaaagcucccggcaccgccgagcccuggacaccaacuauugcuucagcuccacggagaagaacugcugcgugcggcagcuguacauugacuuccgcaaggaccucggcuggaaguggauccacgagcccaagggcuaccaugccaacuucugccucgggcccugccccuacauuuggagccuggacacgcaguacagcaagguccuggcccuguacaaccagcauaacccgggcgccucggcggcgccgugcugcgugccgcaggcgcuggagccgcugcccaucguguacuacgugggccgcaagcccaagguggagcagcuguccaacaugaucgugcgcuccugcaagugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2684 - RNA, 1627 nt, Artificial Sequence
  mRNA product Design2 comprising derived and/or modified sequence from Homo sapiens__NP_003229.1__HsTGFB2 (wt)
ggggcgcugccuacggagguggcagccaucuccuucucggcaucaagcuuaccaugcacuacugugugcugagcgcuuuucugauccugcaucuggucacggucgcgcucagccugucuaccugcagcacacucgauauggaccaguucaugcgcaagaggaucgaggcgauccgcgggcagauccugagcaagcugaagcucaccagucccccagaagacuauccugagcccgaggaaguccccccggaggugauuuccaucuacaacagcaccagggacuugcuccaggagaaggcgagccggagggcggccgccugcgagcgcgagaggagcgacgaagaguacuacgccaaggagguuuacaaaauagacaugccgcccuucuuccccuccgaaaaugccaucccgcccacuuucuacagacccuacuucagaauuguucgauuugacgucucagcaauggagaagaaugcuuccaauuuggugaaagcagaguucagagucuuucguuugcagaacccaaaagccagagugccugaacaacggauugagcuauaucagauucucaaguccaaagauuuaacaucuccaacccagcgcuacaucgacagcaaaguugugaaaacaagagcagaaggcgaauggcucuccuucgauguaacugaugcuguucaugaauggcuucaccauaaagacaggaaccugggauuuaaaauaagcuuacacugucccugcugcacuuuuguaccaucuaauaauuacaucaucccaaauaaaagugaagaacuagaagcaagauuugcagguauugauggcaccuccacauauaccaguggugaucagaaaacuauaaaguccacuaggaaaaaaaacagugggaagaccccacaucuccugcuaauguuauugcccuccuacagacuugagucacaacagaccaaccggcggaagaagcgugcuuuggaugcggccuauugcuuuagaaaugugcaggauaauugcugccuacguccacuuuacauugauuucaagagggaucuaggguggaaauggauacacgaacccaaaggguacaaugccaacuucugugcuggagcaugcccguauuuauggaguucagacacucagcacagcaggguccugagcuuauauaauaccauaaauccagaagcaucugcuucuccuugcugcgugucccaagauuuagaaccucuaaccauucucuacuacauuggcaaaacacccaagauugaacagcuuucuaauaugauuguaaagucuugcaaaugcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2685 - RNA, 1621 nt, Artificial Sequence
  mRNA product Design2 comprising derived and/or modified sequence from Homo sapiens__NP_003230.1__HsTGFB3 (wt)
ggggcgcugccuacggagguggcagccaucuccuucucggcaucaagcuuaccaugaagaugcacuugcaaagggcucuggugguccuggcccugcugaacuuugccacggucagccucucucuguccacuugcaccaccuuggacuucggccacaucaagaagaagaggguggaagccauuaggggacagaucuugagcaagcucaggcucaccagccccccugagccaacggugaugacccacguccccuaucagguccuggcccuuuacaacagcacccgggagcugcuggaggagaugcauggggagagggaggaaggcugcacccaggaaaacaccgagucggaauacuaugccaaagaaauccauaaauucgacaugauccaggggcuggcggagcacaacgaacuggcugucugcccuaaaggaauuaccuccaagguuuuccgcuucaauguguccucaguggagaaaaauagaaccaaccuauuccgagcagaauuccgggucuugcgggugcccaaccccagcucuaagcggaaugagcagaggaucgagcucuuccagauccuucggccagaugagcacauugccaaacagcgcuauaucgguggcaagaaucugcccacacggggcacugccgaguggcuguccuuugaugucacugacacugugcgugaguggcuguugagaagagaguccaacuuaggucuagaaaucagcauucacuguccaugucacaccuuucagcccaauggagauauccuggaaaacauucacgaggugauggaaaucaaauucaaaggcguggacaaugaggaugaccauggccguggagaucuggggcgccucaagaagcagaaggaucaccacaacccucaucuaauccucaugaugauucccccacaccggcucgacaacccgggccaggggggucagaggaagaagcgggcuuuggacaccaauuacugcuuccgcaacuuggaggagaacugcugugugcgcccccucuacauugacuuccgacaggaucugggcuggaaguggguccaugaaccuaagggcuacuaugccaacuucugcucaggcccuugcccauaccuccgcagugcagacacaacccacagcacggugcugggacuguacaacacucugaacccugaagcaucugccucgccuugcugcgugccccaggaccuggagccccugaccauccuguacuauguugggaggacccccaaaguggagcagcucuccaacaugguggugaagucuuguaaauguagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2686 - RNA, 1768 nt, Artificial Sequence
  mRNA product Design2 comprising derived and/or modified sequence from Homo sapiens__NP_001057.1__HsTNFRSF1B (wt)
ggggcgcugccuacggagguggcagccaucuccuucucggcaucaagcuuaccauggcgcccgucgccgucugggccgcgcuggccgucggacuggagcucugggcugcggcgcacgccuugcccgcccagguggcauuuacacccuacgccccggagcccgggagcacaugccggcucagagaauacuaugaccagacagcucagaugugcugcagcaaaugcucgccgggccaacaugcaaaagucuucuguaccaagaccucggacaccgugugugacuccugugaggacagcacauacacccagcucuggaacuggguucccgagugcuugagcuguggcucccgcuguagcucugaccagguggaaacucaagccugcacucgggaacagaaccgcaucugcaccugcaggcccggcugguacugcgcgcugagcaagcaggaggggugccggcugugcgcgccgcugcgcaagugccgcccgggcuucggcguggccagaccaggaacugaaacaucagacguggugugcaagcccugugccccggggacguucuccaacacgacuucauccacggauauuugcaggccccaccagaucuguaacgugguggccaucccugggaaugcaagcauggaugcagucugcacguccacgucccccacccggaguauggccccaggggcaguacacuuaccccagccaguguccacacgaucccaacacacgcagccaacuccagaacccagcacugcuccaagcaccuccuuccugcucccaaugggccccagccccccagcugaagggagcacuggcgacuucgcucuuccaguuggacugauugugggugugacagccuugggucuacuaauaauaggaguggugaacugugucaucaugacccaggugaaaaagaagcccuugugccugcagagagaagccaaggugccucacuugccugccgauaaggcccgggguacacagggccccgagcagcagcaccugcugaucacagcgccgagcuccagcagcagcucccuggagagcucggccagugcguuggacagaagggcgcccacucggaaccagccacaggcaccaggcguggaggccaguggggccggggaggcccgggccagcaccgggagcucagauucuuccccugguggccaugggacccaggucaaugucaccugcaucgugaacgucuguagcagcucugaccacagcucacagugcuccucccaagccagcuccacaaugggagacacagauuccagccccucggaguccccgaaggacgagcagguccccuucuccaaggaggaaugugccuuucggucacagcuggagacgccagagacccugcuggggagcaccgaagagaagccccugccccuuggagugccugaugcugggaugaagcccaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2687 - RNA, 895 nt, Artificial Sequence
  mRNA product Design2 comprising derived and/or modified sequence from Homo sapiens__NP_002623.2__HsPGF (wt)
ggggcgcugccuacggagguggcagccaucuccuucucggcaucaagcuuaccaugccggucaugaggcuguucccuugcuuccugcagcuccuggccgggcuggcgcugccugcugugcccccccagcagugggccuugucugcugggaacggcucgucagagguggaagugguacccuuccaggaaguguggggccgcagcuacugccgggcgcuggagaggcugguggacgucguguccgaguaccccagcgagguggagcacauguucagcccauccugugucucccugcugcgcugcaccggcugcugcggcgaugagaaucugcacugugugccgguggagacggccaaugucaccaugcagcuccuaaagauccguucuggggaccggcccuccuacguggagcugacguucucucagcacguucgcugcgaaugccggccucugcgggagaagaugaagccggaaaggaggagacccaagggcagggggaagaggaggagagagaagcagagacccacagacugccaccugugcggcgaugcuguuccccggagguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2688 - RNA, 1621 nt, Artificial Sequence
  mRNA product Design2 comprising derived and/or modified sequence from Homo sapiens__NP_001020537.2__HsVEGFA (wt)
ggggcgcugccuacggagguggcagccaucuccuucucggcaucaagcuuaccaugacggacagacagacagacaccgcccccagccccagcuaccaccuccuccccggccggcggcggacaguggacgcggcggcgagccgcgggcaggggccggagcccgcgcccggaggcgggguggagggggucggggcucgcggcgucgcacugaaacuuuucguccaacuucugggcuguucucgcuucggaggagccgugguccgcgcgggggaagccgagccgagcggagccgcgagaagugcuagcucgggccgggaggagccgcagccggaggagggggaggaggaagaagagaaggaagaggagagggggccgcaguggcgacucggcgcucggaagccgggcucauggacgggugaggcggcggugugcgcagacagugcuccagccgcgcgcgcuccccaggcccuggcccgggccucgggccggggaggaagaguagcucgccgaggcgccgaggagagcgggccgccccacagcccgagccggagagggagcgcgagccgcgccggccccggucgggccuccgaaaccaugaacuuucugcugucuugggugcauuggagccuugccuugcugcucuaccuccaccaugccaaguggucccaggcugcacccauggcagaaggaggagggcagaaucaucacgaaguggugaaguucauggaugucuaucagcgcagcuacugccauccaaucgagacccugguggacaucuuccaggaguacccugaugagaucgaguacaucuucaagccauccugugugccccugaugcgaugcgggggcugcugcaaugacgagggccuggagugugugcccacugaggaguccaacaucaccaugcagauuaugcggaucaaaccucaccaaggccagcacauaggagagaugagcuuccuacagcacaacaaaugugaaugcagaccaaagaaagauagagcaagacaagaaaaaaaaucaguucgaggaaagggaaaggggcaaaaacgaaagcgcaagaaaucccgguauaaguccuggagcguguacguuggugcccgcugcugucuaaugcccuggagccucccuggcccccaucccugugggccuugcucagagcggagaaagcauuuguuuguacaagauccgcagacguguaaauguuccugcaaaaacacagacucgcguugcaaggcgaggcagcuugaguuaaacgaacguacuugcagaugugacaagccgaggcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2689 - RNA, 1081 nt, Artificial Sequence
  mRNA product Design2 comprising derived and/or modified sequence from Homo sapiens__NP_001165094.1__HsVEGFA (wt)
ggggcgcugccuacggagguggcagccaucuccuucucggcaucaagcuuaccaugaacuuucugcugucuugggugcauuggagccuugccuugcugcucuaccuccaccaugccaaguggucccaggcugcacccauggcagaaggaggagggcagaaucaucacgaaguggugaaguucauggaugucuaucagcgcagcuacugccauccaaucgagacccugguggacaucuuccaggaguacccugaugagaucgaguacaucuucaagccauccugugugccccugaugcgaugcgggggcugcugcaaugacgagggccuggagugugugcccacugaggaguccaacaucaccaugcagauuaugcggaucaaaccucaccaaggccagcacauaggagagaugagcuuccuacagcacaacaaaugugaaugcagaccaaagaaagauagagcaagacaagaaaaaaaaucaguucgaggaaagggaaaggggcaaaaacgaaagcgcaagaaaucccgguauaaguccuggagcguguacguuggugcccgcugcugucuaaugcccuggagccucccuggcccccaucccugugggccuugcucagagcggagaaagcauuuguuuguacaagauccgcagacguguaaauguuccugcaaaaacacagacucgcguugcaaggcgaggcagcuugaguuaaacgaacguacuugcagaugugacaagccgaggcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2690 - RNA, 1006 nt, Artificial Sequence
  mRNA product Design2 comprising derived and/or modified sequence from Homo sapiens__NP_003368.1__HsVEGFB (wt)
ggggcgcugccuacggagguggcagccaucuccuucucggcaucaagcuuaccaugagcccucugcuccgccgccugcugcucgccgcacuccugcagcuggcccccgcccaggccccugucucccagccugaugccccuggccaccagaggaaaguggugucauggauagauguguauacucgcgcuaccugccagccccgggaggugguggugcccuugacuguggagcucaugggcaccguggccaaacagcuggugcccagcugcgugacugugcagcgcugugguggcugcugcccugacgauggccuggagugugugcccacugggcagcaccaaguccggaugcagauccucaugauccgguacccgagcagucagcugggggagaugucccuggaagaacacagccagugugaaugcagaccuaaaaaaaaggacagugcugugaagccagacagggcugccacuccccaccaccguccccagccccguucuguuccgggcugggacucugcccccggagcacccuccccagcugacaucacccaucccacuccagccccaggccccucugcccacgcugcacccagcaccaccagcgcccugacccccggaccugccgcugccgcugccgacgccgcagcuuccuccguugccaagggcggggcuuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2691 - RNA, 1642 nt, Artificial Sequence
  mRNA product Design2 comprising derived and/or modified sequence from Homo sapiens__NP_005420.1__HsVEGFC (wt)
ggggcgcugccuacggagguggcagccaucuccuucucggcaucaagcuuaccaugcacuugcugggcuucuucucuguggcguguucucugcucgccgcugcgcugcucccggguccucgcgaggcgcccgccgccgccgccgccuucgaguccggacucgaccucucggacgcggagcccgacgcgggcgaggccacggcuuaugcaagcaaagaucuggaggagcaguuacggucuguguccaguguagaugaacucaugacuguacucuacccagaauauuggaaaauguacaagugucagcuaaggaaaggaggcuggcaacauaacagagaacaggccaaccucaacucaaggacagaagagacuauaaaauuugcugcagcacauuauaauacagagaucuugaaaaguauugauaaugaguggagaaagacucaaugcaugccacgggagguguguauagauguggggaaggaguuuggagucgcgacaaacaccuucuuuaaaccuccauguguguccgucuacagauguggggguugcugcaauagugaggggcugcagugcaugaacaccagcacgagcuaccucagcaagacguuauuugaaauuacagugccucucucucaaggccccaaaccaguaacaaucaguuuugccaaucacacuuccugccgaugcaugucuaaacuggauguuuacagacaaguucauuccauuauuagacguucccugccagcaacacuaccacagugucaggcagcgaacaagaccugccccaccaauuacauguggaauaaucacaucugcagaugccuggcucaggaagauuuuauguuuuccucggaugcuggagaugacucaacagauggauuccaugacaucuguggaccaaacaaggagcuggaugaagagaccugucagugugucugcagagcggggcuucggccugccagcuguggaccccacaaagaacuagacagaaacucaugccagugugucuguaaaaacaaacucuuccccagccaauguggggccaaccgagaauuugaugaaaacacaugccaguguguauguaaaagaaccugccccagaaaucaaccccuaaauccuggaaaaugugccugugaauguacagaaaguccacagaaaugcuuguuaaaaggaaagaaguuccaccaccaaacaugcagcuguuacagacggccauguacgaaccgccagaaggcuugugagccaggauuuucauauagugaagaagugugucguugugucccuucauauuggaaaagaccacaaaugagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2692 - RNA, 1447 nt, Artificial Sequence
  mRNA product Design2 comprising derived and/or modified sequence from Homo sapiens__NP_004460.1__HsVEGFD (wt)
ggggcgcugccuacggagguggcagccaucuccuucucggcaucaagcuuaccauguacagagaguggguaguggugaauguuuucaugauguuguacguccagcuggugcagggcuccaguaaugaacauggaccagugaagcgaucaucucaguccacauuggaacgaucugaacagcagaucagggcugcuucuaguuuggaggaacuacuucgaauuacucacucugaggacuggaagcuguggagaugcaggcugaggcucaaaaguuuuaccaguauggacucucgcucagcaucccaucgguccacuagguuugcggcaacuuucuaugacauugaaacacuaaaaguuauagaugaagaauggcaaagaacucagugcagcccuagagaaacgugcguggagguggccagugagcuggggaagaguaccaacacauucuucaagcccccuugugugaacguguuccgaugugguggcuguugcaaugaagagagccuuaucuguaugaacaccagcaccucguacauuuccaaacagcucuuugagauaucagugccuuugacaucaguaccugaauuagugccuguuaaaguugccaaucauacagguuguaagugcuugccaacagccccccgccauccauacucaauuaucagaagauccauccagaucccugaagaagaucgcuguucccauuccaagaaacucuguccuauugacaugcuaugggauagcaacaaauguaaauguguuuugcaggaggaaaauccacuugcuggaacagaagaccacucucaucuccaggaaccagcucucugugggccacacaugauguuugacgaagaucguugcgagugugucuguaaaacaccaugucccaaagaucuaauccagcaccccaaaaacugcaguugcuuugagugcaaagaaagucuggagaccugcugccagaagcacaagcuauuucacccagacaccugcagcugugaggacagaugccccuuucauaccagaccaugugcaaguggcaaaacagcaugugcaaagcauugccgcuuuccaaaggagaaaagggcugcccaggggccccacagccgaaagaauccuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2693 - RNA, 1012 nt, Artificial Sequence
  mRNA product Design2 comprising derived and/or modified sequence from Homo sapiens__NP_061986.1__HsFGF21 (opt1)
ggggcgcugccuacggagguggcagccaucuccuucucggcaucaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcugcugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggcccucccagggccggagccccuccuacgccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2694 - RNA, 1792 nt, Artificial Sequence
  mRNA product Design2 comprising derived and/or modified sequence from Homo sapiens__NP_002412.1__HsMMP1 (opt1) R4749
ggggcgcugccuacggagguggcagccaucuccuucucggcaucaagcuuaccaugcacagcuucccgccccugcuccugcugcucuucuggggcguggucucccacagcuuccccgccacccuggagacccaggagcaggacguggaccuggugcagaaguaccucgagaaguacuacaaccugaagaacgacgggcgccaggucgagaagcggcgcaacuccggccccgugguggagaagcugaagcagaugcaggaguucuucgggcucaaggucacgggcaagcccgacgccgagacccugaaggugaugaagcagccgcggugcggggugcccgacgucgcgcaguucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2695 - RNA, 1552 nt, Artificial Sequence
  mRNA product Design2 comprising derived and/or modified sequence from Homo sapiens__NP_002412.1__HsMMP1(1-19,100-469) (opt1) R4751
ggggcgcugccuacggagguggcagccaucuccuucucggcaucaagcuuaccaugcacagcuucccgccccugcuccugcugcucuucuggggcguggucucccacagcuucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2696 - RNA, 3739 nt, Artificial Sequence
  mRNA product Design2 comprising derived and/or modified sequence from Clostridium histolyticum__BAA77453.1__ColG (opt1) R4537
ggggcgcugccuacggagguggcagccaucuccuucucggcaucaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2697 - RNA, 3463 nt, Artificial Sequence
  mRNA product Design2 comprising derived and/or modified sequence from Clostridium histolyticum__BAA77453.1__HsALB(1-18)_ColG(111-1118) (opt1) R4791
ggggcgcugccuacggagguggcagccaucuccuucucggcaucaagcuuaccaugaagugggugaccuucaucagccugcucuuccuguucuccagcgccuacuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2698 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt1) R4793
ggggcgcugccuacggagguggcagccaucuccuucucggcaucaagcuuaccaugaagugggugaccuucaucagccugcucuuccuguucuccagcgccuacuccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccucccgccggcgccggaagcgcaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2699 - RNA, 3487 nt, Artificial Sequence
  mRNA product Design2 comprising derived and/or modified sequence from Clostridium histolyticum__BAA34542.1__ColH (opt1)
ggggcgcugccuacggagguggcagccaucuccuucucggcaucaagcuuaccaugaacuuccugaagaucauccucaaccgcggcaagaccaugaagcggaagugccugagcaagcgccugaugcucgccaucaccauggccacgaucuucaccgugaacuccacccugcccaucuacgcggccgucgacaagaacaacgccaccgccgccgugcagaacgagagcaagcgguacacgguguccuaccugaagacccucaacuacuacgaccuggucgaccugcucgugaagaccgagaucgagaaccugccggaccuguuccaguacagcuccgacgcgaaggaguucuacgggaacaagacccgcaugagcuucaucauggacgagaucggccggcgcgcgccccaguacacggagaucgaccacaaggggauccccacccucguggaggucgugcgggccggcuucuaccugggguuccacaacaaggagcugaacgagaucaacaagcgcuccuucaaggagcgggugauccccagcauccucgccauccagaagaacccgaacuucaagcugggcaccgagguccaggacaagaucguguccgccaccggccugcucgccgggaacgagacggccccgcccgagguggucaacaacuucacccccauccugcaggacugcaucaagaacaucgaccgcuacgcccuggacgaccucaagagcaaggcccuguucaacgugcuggcggccccgaccuacgacaucaccgaguaccuccgggccacgaaggagaagcccgagaacacccccugguacggcaagaucgacggguucaucaacgagcugaagaagcuggcccucuacggcaagaucaacgacaacaacuccuggaucaucgacaacgggaucuaccacaucgcgccccugggcaagcugcacagcaacaacaagaucggcaucgagacccucaccgaggugaugaaggucuacccguaccuguccaugcagcaccuccagagcgccgaccagaucaagcgccacuacgacuccaaggacgccgaggggaacaagaucccccuggacaaguucaagaaggagggcaaggagaaguacugccccaagacguacaccuucgacgacgggaaggugaucaucaaggccggcgcccggguggaggaggagaaggucaagcgccuguacugggccagcaaggaggugaacucccaguucuuccggguguacggcaucgacaagccccuggaggaggggaacccggacgacauccucaccauggucaucuacaacagccccgaggaguacaagcugaacuccgugcuguacggcuacgacaccaacaacgggggcauguacaucgagcccgaggggacguucuucaccuacgagcgcgaggcgcaggagagcaccuacacccucgaggagcuguuccggcacgaguacacgcacuaccugcagggccgcuacgccgugcccggccagugggggcggaccaagcucuacgacaacgaccgccugaccugguacgaggagggcggggccgagcuguucgccggcagcacccggacguccgggauccucccgcgcaagagcaucgucuccaacauccacaacaccacccgcaacaaccgguacaagcugagcgacaccgugcacuccaaguacggcgccagcuucgaguucuacaacuacgcgugcauguucauggacuacauguacaacaaggacaugggcauccugaacaagcucaacgaccuggccaagaacaacgacgucgacggguacgacaacuacauccgcgaccuguccagcaacuacgcccugaacgacaaguaccaggaccacaugcaggagcggaucgacaacuacgagaaccucacggugcccuucguggccgacgacuaccugguccgccacgcguacaagaaccccaacgagaucuacuccgagaucagcgagguggccaagcugaaggacgccaaguccgaggugaagaagucccaguacuucagcaccuucacccuccggggcagcuacaccgggggcgccuccaaggggaagcuggaggaccagaaggccaugaacaaguucaucgacgacagccugaagaagcucgacaccuacuccuggagcggcuacaagacgcugaccgcguacuucaccaacuacaaggucgacuccagcaaccgcgugaccuacgacguggucuuccacggcuaccugcccaacgagggggacagcaagaacucccucccguacggcaagaucaacgggacguacaagggcaccgagaaggagaagaucaaguucagcuccgagggcagcuucgaccccgacgggaagaucguguccuacgagugggacuucggcgacgggaacaagagcaacgaggagaaccccgagcacuccuacgacaaggugggcaccuacaccgucaagcugaaggugacggacgacaagggggagagcuccgugagcaccaccaccgccgagaucaaggaccuguccgagaacaagcuccccgucaucuacaugcacgugcccaagagcggcgcccugaaccagaagguggucuucuacggcaaggggacguacgaccccgacggcuccaucgccggguaccagugggacuucggcgacgggagcgacuucuccagcgagcagaaccccucccacguguacaccaagaagggcgaguacaccgugacccugcgggucauggacagcagcggccagauguccgagaagacgaugaagaucaagaucaccgacccgguguaccccaucgggaccgagaaggagcccaacaacagcaaggagaccgccuccggccccaucgugccggggauccccgucagcggcacgaucgagaacaccuccgaccaggacuacuucuacuucgacgugaucacccccggggaggugaagaucgacaucaacaagcucggcuacggcggggcgaccugggucguguacgacgagaacaacaacgccgugagcuacgccacggacgacggccagaaccuguccgggaaguucaaggccgacaagcccggccgcuacuacauccaccuguacauguucaacgggagcuacaugccguaccggaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2700 - RNA, 3448 nt, Artificial Sequence
  mRNA product Design2 comprising derived and/or modified sequence from Clostridium histolyticum__BAA34542.1__ColH (opt1) R4538
ggggcgcugccuacggagguggcagccaucuccuucucggcaucaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2701 - RNA, 3382 nt, Artificial Sequence
  mRNA product Design2 comprising derived and/or modified sequence from Clostridium histolyticum__BAA34542.1__HsALB(1-18)_ColH(41-1021) (opt1) R4790
ggggcgcugccuacggagguggcagccaucuccuucucggcaucaagcuuaccaugaagugggugaccuucaucagccugcucuuccuguucuccagcgccuacuccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2702 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt1) R4792
ggggcgcugccuacggagguggcagccaucuccuucucggcaucaagcuuaccaugaagugggugaccuucaucagccugcucuuccuguucuccagcgccuacuccaugaagcgcaagugccugagcaagcggcucaugcuggccaucaccauggccaccaucuucacggugaacuccacccugcccaucuacgcggccgucgacaagaacaacgccaccgccgcccgccggcgccggaagcgcgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2703 - RNA, 958 nt, Artificial Sequence
  mRNA product Design2 comprising derived and/or modified sequence from Homo sapiens__NP_001133.1__HsAMELX (opt1)
ggggcgcugccuacggagguggcagccaucuccuucucggcaucaagcuuaccaugggcaccuggauccuguucgccugccuccugggggccgcguucgccaugccccugccgccccaccccggccaccccggguacaucaacuucagcuacgaggugcucaccccgcugaagugguaccaguccauccgcccgcccuaccccagcuacggcuacgagcccaugggcggguggcugcaccaccagaucauccccguccucucccagcagcacccgcccacgcacacccugcagccgcaccaccacauccccguggugcccgcccagcagcccgucaucccccagcagcccaugaugcccgugcccggccagcacagcaugaccccgauccagcaccaccagcccaaccugcccccgccggcccagcagcccuaccagccccagcccgugcagccccagccccaccagcccaugcagccgcagccgcccguccaccccaugcagccgcucccgccccagcccccgcugccgcccauguuccccaugcagccccugccgcccaugcuccccgaccugacccuggaggccuggcccuccacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2704 - RNA, 517 nt, Artificial Sequence
  mRNA product Design2 comprising derived and/or modified sequence from Homo sapiens__NP_001133.1__HsAMELX-TRAP (opt1)
ggggcgcugccuacggagguggcagccaucuccuucucggcaucaagcuuaccaugccccugccgccccaccccggccaccccggguacaucaacuucagcuacgaggugcucaccccgcugaagugguaccaguccauccgcccgcccuaccccagcuacggcuacgagcccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2705 - RNA, 550 nt, Artificial Sequence
  mRNA product Design2 comprising derived and/or modified sequence from Homo sapiens__NP_001133.1__HsAMELX-LRAP (opt1)
ggggcgcugccuacggagguggcagccaucuccuucucggcaucaagcuuaccaugccccugccgccccaccccggccaccccggguacaucaacuucagcuacgaggugcucaccccgcugaagugguaccaguccauccgcccgccgcccaugcuccccgaccugacccuggaggccuggcccuccacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2706 - RNA, 589 nt, Artificial Sequence
  mRNA product Design2 comprising derived and/or modified sequence from Homo sapiens__NP_001133.1__HLA-A2-SP_HsAMELX(17-60) (opt1)
ggggcgcugccuacggagguggcagccaucuccuucucggcaucaagcuuaccauggccgugauggccccgcggacccugguccuccugcugagcggcgcgcucgcccugacccagacgugggccaugccccugccgccccaccccggccaccccggguacaucaacuucagcuacgaggugcucaccccgcugaagugguaccaguccauccgcccgcccuaccccagcuacggcuacgagcccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2707 - RNA, 622 nt, Artificial Sequence
  mRNA product Design2 comprising derived and/or modified sequence from Homo sapiens__NP_001133.1__HLA-A2-SP_HsAMELX(17-47,168-191) (opt1)
ggggcgcugccuacggagguggcagccaucuccuucucggcaucaagcuuaccauggccgugauggccccgcggacccugguccuccugcugagcggcgcgcucgcccugacccagacgugggccaugccccugccgccccaccccggccaccccggguacaucaacuucagcuacgaggugcucaccccgcugaagugguaccaguccauccgcccgccgcccaugcuccccgaccugacccuggaggccuggcccuccacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2708 - RNA, 961 nt, Artificial Sequence
  mRNA product Design2 comprising derived and/or modified sequence from Homo sapiens__NP_001134.1__HsAMELY (opt1)
ggggcgcugccuacggagguggcagccaucuccuucucggcaucaagcuuaccaugggcaccuggauccuguucgccugccucgugggggccgcguucgccaugccccugccgccccaccccggccaccccggguacaucaacuucagcuacgagguccugaccccgcucaagugguaccaguccaugauccgcccgcccuacagcuccuacggcuacgagcccaugggcggguggcugcaccaccagaucauccccguggugagccagcagcacccccugacgcacacccuccagucccaccaccacauccccgucgugcccgcccagcagccgcgggugcgccagcaggcccugaugcccguccccggccagcagagcaugacccccacccagcaccaccagccgaaccugccccuccccgcccagcagcccuuccagccgcagcccgugcagccccagccccaccagccgaugcagccccagccgcccgugcagcccaugcagccccugcugccccagccgccccucccgcccauguucccccugcggccccugccgcccauccuccccgaccugcaccuggaggcguggcccgccacggacaagaccaagcaggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2709 - RNA, 520 nt, Artificial Sequence
  mRNA product Design2 comprising derived and/or modified sequence from Homo sapiens__NP_001134.1__HsAMELY-TRAP (opt1)
ggggcgcugccuacggagguggcagccaucuccuucucggcaucaagcuuaccaugccccugccgccccaccccggccaccccggguacaucaacuucagcuacgagguccugaccccgcucaagugguaccaguccaugauccgcccgcccuacagcuccuacggcuacgagcccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2710 - RNA, 553 nt, Artificial Sequence
  mRNA product Design2 comprising derived and/or modified sequence from Homo sapiens__NP_001134.1__HsAMELY-LRAP (opt1)
ggggcgcugccuacggagguggcagccaucuccuucucggcaucaagcuuaccaugccccugccgccccaccccggccaccccggguacaucaacuucagcuacgagguccugaccccgcucaagugguaccaguccaugauccgcccgccgcccauccuccccgaccugcaccuggaggcguggcccgccacggacaagaccaagcaggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2711 - RNA, 592 nt, Artificial Sequence
  mRNA product Design2 comprising derived and/or modified sequence from Homo sapiens__NP_001134.1__HLA-A2-SP_HsAMELY(17-61) (opt1)
ggggcgcugccuacggagguggcagccaucuccuucucggcaucaagcuuaccauggccgugauggccccgcggacccugguccuccugcugagcggcgcgcucgcccugacccagacgugggccaugccccugccgccccaccccggccaccccggguacaucaacuucagcuacgagguccugaccccgcucaagugguaccaguccaugauccgcccgcccuacagcuccuacggcuacgagcccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2712 - RNA, 625 nt, Artificial Sequence
  mRNA product Design2 comprising derived and/or modified sequence from Homo sapiens__NP_001134.1__HLA-A2-SP_HsAMELY(17-48,169-192) (opt1)
ggggcgcugccuacggagguggcagccaucuccuucucggcaucaagcuuaccauggccgugauggccccgcggacccugguccuccugcugagcggcgcgcucgcccugacccagacgugggccaugccccugccgccccaccccggccaccccggguacaucaacuucagcuacgagguccugaccccgcucaagugguaccaguccaugauccgcccgccgcccauccuccccgaccugcaccuggaggcguggcccgccacggacaagaccaagcaggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2713 - RNA, 952 nt, Artificial Sequence
  mRNA product Design2 comprising derived and/or modified sequence from Sus scrofa__NP_999071.1__SsAMELX-001-1 (opt1)
ggggcgcugccuacggagguggcagccaucuccuucucggcaucaagcuuaccaugggcaccuggauccuguucgccugccuccugggggccgcguucagcaugccccugccgccccaccccggccaccccggguacaucaacuucuccuacgaggugcucaccccgcugaagugguaccagaacaugauccgccaccccuacacgagcuacggcuacgagcccaugggcggguggcugcaccaccagaucauccccgucgugucccagcagaccccgcagagccacgcccuccagccccaccaccacauccccauggugcccgcccagcagccgggcaucccccagcagcccaugaugccccugccggggcagcacuccaugacccccacccagcaccaccagcccaaccugccccucccggcccagcagcccuuccagccccagcccguccagccgcagccccaccagccccugcagccccagagcccgaugcaccccauccagccccugcucccgcagccgccccugcccccgauguucuccaugcagagccugcuccccgaccugccccuggaggccuggcccgcgacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2714 - RNA, 520 nt, Artificial Sequence
  mRNA product Design2 comprising derived and/or modified sequence from Sus scrofa__NP_999071.1__SsAMELX-TRAP (opt1)
ggggcgcugccuacggagguggcagccaucuccuucucggcaucaagcuuaccaugccccugccgccccaccccggccaccccggguacaucaacuucuccuacgaggugcucaccccgcugaagugguaccagaacaugauccgccaccccuacacgagcuacggcuacgagcccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2715 - RNA, 553 nt, Artificial Sequence
  mRNA product Design2 comprising derived and/or modified sequence from Sus scrofa__NP_999071.1__SsAMELX-LRAP (opt1)
ggggcgcugccuacggagguggcagccaucuccuucucggcaucaagcuuaccaugccccugccgccccaccccggccaccccggguacaucaacuucuccuacgaggugcucaccccgcugaagugguaccagaacaugauccgccaccccagccugcuccccgaccugccccuggaggccuggcccgcgacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2716 - RNA, 592 nt, Artificial Sequence
  mRNA product Design2 comprising derived and/or modified sequence from Sus scrofa__NP_999071.1__HLA-A2-SP_SsAMEL(17-61) (opt1)
ggggcgcugccuacggagguggcagccaucuccuucucggcaucaagcuuaccauggccgugauggccccgcggacccugguccuccugcugagcggcgcgcucgcccugacccagacgugggccaugccccugccgccccaccccggccaccccggguacaucaacuucuccuacgaggugcucaccccgcugaagugguaccagaacaugauccgccaccccuacacgagcuacggcuacgagcccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2717 - RNA, 625 nt, Artificial Sequence
  mRNA product Design2 comprising derived and/or modified sequence from Sus scrofa__NP_999071.1__HLA-A2-SP_SsAMEL(17-49,167-189) (opt1)
ggggcgcugccuacggagguggcagccaucuccuucucggcaucaagcuuaccauggccgugauggccccgcggacccugguccuccugcugagcggcgcgcucgcccugacccagacgugggccaugccccugccgccccaccccggccaccccggguacaucaacuucuccuacgaggugcucaccccgcugaagugguaccagaacaugauccgccaccccagccugcuccccgaccugccccuggaggccuggcccgcgacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2718 - RNA, 916 nt, Artificial Sequence
  mRNA product Design2 comprising derived and/or modified sequence from Sus scrofa__P45561-2__SsAMELX-001-2 (opt1)
ggggcgcugccuacggagguggcagccaucuccuucucggcaucaagcuuaccaugggcaccuggauccuguucgccugccuccugggggccgcguucagcaugccccugccgccccaccccggccaccccggguacaucaacuucuccuacauccgccacccguacaccagcuacggcuacgagcccaugggcggguggcuccaccaccagaucauccccguggucucccagcagacgccccagagccacgcccugcagccgcaccaccacauccccauggugcccgcccagcagcccggcaucccgcagcagcccaugaugccccugcccgggcagcacuccaugaccccgacccagcaccaccagcccaaccucccccugcccgcccagcagccguuccagccccagcccgugcagccccagccgcaccagccccugcagccccagagccccaugcacccgauccagccccuccugccccagccgccccugccgcccauguucuccaugcagagccuccugcccgaccugccccucgaggccuggcccgcgaccgacaagacgaagcgggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2719 - RNA, 952 nt, Artificial Sequence
  mRNA product Design2 comprising derived and/or modified sequence from Sus scrofa__NP_998965.1__SsAMELX-001-3 (opt1)
ggggcgcugccuacggagguggcagccaucuccuucucggcaucaagcuuaccaugggcaccuggaucuucuucgccugccugcucggggccagccuggcgaugccccugccgccccaccccggccaccccggguacaucaacuucuccuacgaggugcucacgccccugaagugguaccagaacaugauccgccaccccuacaccagcuacggcuacgagcccaugggcggguggcugcaccaccagaucauccccgucgugucccagcagaccccgcagagccacgcccuccagccccaccaccacauccccauggugcccgcccagcagccgggcaucccccagcagcccaugaugccccugccggggcagcacuccaugacccccacccagcaccaccagcccaaccugccccucccggcccagcagcccuuccagccccagcccguccagccgcagccccaccagccccugcagccccagagcccgaugcaccccauccagccccugcucccgcagccgccccugccgcccauguucuccaugcagagccugcuccccgaccugccccuggaggccuggcccgcgacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2720 - RNA, 601 nt, Artificial Sequence
  mRNA product Design2 comprising derived and/or modified sequence from Sus scrofa__K7GPB2__SsAMELX-002 (opt1)
ggggcgcugccuacggagguggcagccaucuccuucucggcaucaagcuuaccaugggcaccuggauccuguucgccugccuccugggggccgcguucagcaugccccugccgccccaccccggccaccccggguacaucaacuucuccuacgaggugcucaccccgcugaagugguaccagaacaugauccgccaccccagccugcuccccgaccugccccuggaggccuggccggccacggacaagaccaagcgggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2721 - RNA, 994 nt, Artificial Sequence
  mRNA product Design2 comprising derived and/or modified sequence from Sus scrofa__K7GLD0__SsAMELX-003 (opt1)
ggggcgcugccuacggagguggcagccaucuccuucucggcaucaagcuuaccaugggcaccuggauccuguucgccugccuccugggggccgcguucagcaugccccugccgccccaccccggccaccccggguacaucaacuucuccuacgaggaccucuaccuggaggccauccgcaucgaccggaccgccuucgugcugacgccccucaagugguaccagaacaugauccgccaccccuacaccagcuacggcuacgagcccaugggcggguggcugcaccaccagaucauccccgucgugucccagcagaccccgcagagccacgcccugcagccccaccaccacauccccauggugcccgcccagcagccgggcaucccccagcagcccaugaugccccucccggggcagcacuccaugacccccacgcagcaccaccagcccaaccugccccugccggcgcagcagcccuuccagccccagcccguccagccgcagccccaccagccccuccagccccagagcccgaugcaccccauccagccccugcugccgcagccgccccugccgcccauguucuccaugcagagccuccugcccgaccucccccuggaggccuggcccgccaccgacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2722 - RNA, 880 nt, Artificial Sequence
  mRNA product Design2 comprising derived and/or modified sequence from Sus scrofa__K7GPE9__SsAMELX-004 (opt1)
ggggcgcugccuacggagguggcagccaucuccuucucggcaucaagcuuaccaugggcaccuggauccuguucgccugccuccugggggccgcguucagcaugccccugccgccccaccccggccaccccggguacaucaacuucuccuacgaggugcucaccccgcugaagugguaccagaacaugauccgccaccccacgccccagagccacgcccugcagccccaccaccacaucccgaugguccccgcccagcagcccggcaucccccagcagccgaugaugccccuccccgggcagcacuccaugacccccacccagcaccaccagccgaaccugccccugcccgcccagcagcccuuccagccgcagcccgugcagccccagccccaccagccgcuccagccccagagccccaugcaccccauccagccgcugcugccccagcccccgcucccgcccauguucuccaugcagagccugcugcccgaccucccccuggaggccuggcccgcgaccgacaagacgaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2723 - RNA, 904 nt, Artificial Sequence
  mRNA product Design2 comprising derived and/or modified sequence from Sus scrofa__J9JIM4__SsAMELX-201 (opt1)
ggggcgcugccuacggagguggcagccaucuccuucucggcaucaagcuuaccaugccccugccgccccaccccggccaccccggguacaucaacuucagcuacgaggugcucaccccgcugaagugguaccagaacaugauccgccaccccuacaccuccuacggcuacgagcccaugggcggguggcugcaccaccagaucauccccgucgugagccagcagacgccgcagucccacgcccuccagccccaccaccacauccccauggugcccgcccagcagcccgggaucccccagcagcccaugaugccccugccgggccagcacagcaugacccccacccagcaccaccagcccaaccugccccucccggcgcagcagcccuuccagccccagcccguccagccgcagccccaccagccccugcagccccaguccccgaugcaccccauccagccccugcucccgcagccgccccugccgcccauguucagcaugcagucccugcuccccgaccugccccuggaggccuggcccgccaccgacaagacgaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2724 - RNA, 3343 nt, Artificial Sequence
  mRNA product Design2 comprising derived and/or modified sequence from Homo sapiens__NP_006120.1__HsBMP1 (opt1)
ggggcgcugccuacggagguggcagccaucuccuucucggcaucaagcuuaccaugcccggcguggcccgccugccgcuccugcuggggcuccugcugcucccccggcccggccgcccccuggaccuggccgacuacaccuacgaccucgccgaggaggacgacagcgagccgcugaacuacaaggaccccugcaaggccgccgccuuccugggggacaucgcccucgacgaggaggaccugcgggcguuccagguccagcaggccguggaccugcgccggcacaccgcccgcaaguccagcaucaaggccgcggugcccggcaacacguccacccccagcugccaguccaccaacgggcagccgcagcggggcgccugcggccgcuggcgggggcgcagccggucccgccgggccgccaccagccgccccgagcgggucuggcccgacggcgugauccccuucgugaucgggggcaacuucacggggucccagcgcgccgucuuccggcaggcgaugcgccacugggagaagcacacgugcgugaccuuccucgagcggaccgacgaggacagcuacaucguguucaccuaccgcccgugcggcugcugcuccuacgucggccggcgcgggggcgggccccaggccaucagcaucggcaagaacugcgacaaguucggcaucguggugcacgagcuggggcacgucgugggcuucuggcacgagcacacccgccccgaccgggaccgccacguguccaucguccgggagaacauccagcccgggcaggaguacaacuuccugaagauggagccgcaggagguggagagccucggcgagaccuacgacuucgacuccaucaugcacuacgcccgcaacaccuucagccgggggaucuuccuggacacgaucgugcccaaguacgaggucaacggcgugaagccgcccaucggccagcgcacccggcuguccaagggggacaucgcccaggcccgcaagcucuacaagugccccgcgugcggcgagacccugcaggacagcaccgggaacuucuccagccccgaguaccccaacggcuacagcgcccacaugcacugcguguggcggaucuccgucacgcccggggagaagaucauccugaacuucaccagccucgaccuguaccgcucccggcugugcugguacgacuacguggaggugcgcgacggcuucuggcggaaggccccgcuccgcggccgguucugcgggagcaagcugcccgagcccaucgucuccaccgacagccgccuguggguggaguuccgguccagcuccaacugggucggcaagggguucuucgccguguacgaggccaucugcggcggggacgugaagaaggacuacggccacauccagagccccaacuacccggacgacuaccgccccuccaaggucugcaucuggcggauccaggugagcgagggcuuccacguggggcucaccuuccaguccuucgagaucgagcgccacgacagcugcgcguacgacuaccuggagguccgcgacggccacuccgagagcuccacgcugaucgggcgguacugcggcuacgagaagcccgacgacaucaagagcaccuccagccgccucuggcugaaguucgugagcgacggcuccaucaacaaggccggguucgccgugaacuucuucaaggaggucgacgagugcagccggccgaaccgcggcgggugcgagcagcggugccugaacacccucggcuccuacaagugcagcugcgaccccggguacgagcuggcccccgacaagcgccggugcgaggccgcgugcggcggcuuccugaccaagcucaacggguccaucacgagccccggcuggccgaaggaguacccgcccaacaagaacugcaucuggcagcugguggcccccacccaguaccgcaucucccugcaguucgacuucuucgagaccgaggggaacgacgugugcaaguacgacuucgucgaggugcggagcggccucaccgccgacuccaagcugcacgggaaguucugcggcagcgagaagcccgaggugaucacgucccaguacaacaacaugcgcgucgaguucaagagcgacaacaccguguccaagaagggcuucaaggcccacuucuucagcgacaaggacgagugcuccaaggacaacgggggcugccagcaggacugcgugaacaccuucgggagcuacgagugccagugccgguccggcuucguccugcacgacaacaagcacgacugcaaggaggcggggugcgaccacaaggugaccagcacgagcggcaccaucaccucccccaacuggcccgacaaguaccccagcaagaaggagugcaccugggccaucuccagcacgccgggccaccgcgugaagcucaccuucauggagauggacaucgagucccagcccgagugcgccuacgaccaccuggaggucuucgacgggcgggacgccaaggcccccgugcugggccgcuucugcgggagcaagaagcccgagccggugcucgcgaccggcucccggauguuccugcgcuucuacagcgacaacuccguccagcggaagggguuccaggccagccacgccaccgagugcggcggccaggugcgcgccgacgugaagaccaaggaccuguacucccacgcccaguucggggacaacaacuaccccggcggggucgacugcgagugggugaucguggcggaggagggcuacggcgucgagcugguguuccagacguucgagguggaggaggagaccgacugcggguacgacuacauggagcuguucgacggcuacgacagcaccgcgccccggcucgggcgcuacugcggcuccgggcccccggaggaggucuacagcgccggcgacuccgugcuggugaaguuccacagcgacgacaccaucacgaagaagggcuuccaccuccgguacaccuccaccaaguuccaggacacccugcacagccgcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2725 - RNA, 1573 nt, Artificial Sequence
  mRNA product Design2 comprising derived and/or modified sequence from Homo sapiens__NP_001191.1__HsBMP2 (opt1)
ggggcgcugccuacggagguggcagccaucuccuucucggcaucaagcuuaccaugguggccggcacccgcugccugcucgcccugcugcucccccagguccugcucgggggcgcggccgggcuggugccggagcugggccggcgcaaguucgccgccgccagcuccgggcggcccagcucccagcccagcgacgaggugcuguccgaguucgagcuccgccugcugagcauguucggccucaagcagcggcccaccccgucccgcgacgcggucgugccgcccuacaugcuggaccuguaccggcgccacagcggccagcccgggucccccgcccccgaccaccggcucgagcgcgccgccagccgggcgaacacggugcgcuccuuccaccacgaggagagccuggaggagcugcccgagaccuccggcaagaccacccggcgcuucuucuucaaccucagcuccauccccacggaggaguucaucaccagcgccgagcugcaggucuuccgggagcagaugcaggacgcccuggggaacaacuccagcuuccaccaccgcaucaacaucuacgagaucaucaagccggccaccgccaacuccaaguuccccgugacccggcuccuggacacgcgccuggugaaccagaacgcgagccggugggagagcuucgacgucacccccgccgugaugcgcuggaccgcccagggccacgccaaccacggguucguggucgagguggcccaccucgaggagaagcagggcguguccaagcggcacguccgcaucagccgcucccugcaccaggacgagcacagcuggucccagauccggccccugcucgugaccuucggccacgacgggaagggccacccgcugcacaagcgcgagaagcggcaggcgaagcacaagcagcgcaagcggcucaagagcuccugcaagcgccacccccuguacguggacuucagcgacgucggguggaacgacuggaucguggccccgcccggcuaccacgccuucuacugccacggcgagugccccuucccccuggccgaccaccugaacuccacgaaccacgccaucgugcagacccucgucaacagcgugaacuccaagauccccaaggcgugcugcgugcccaccgagcugagcgccaucuccaugcuguaccucgacgagaacgagaaggucgugcugaagaacuaccaggacauggucguggaggggugcggcugccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2726 - RNA, 1609 nt, Artificial Sequence
  mRNA product Design2 comprising derived and/or modified sequence from Homo sapiens__NP_001193.2__HsBMP4 (opt1)
ggggcgcugccuacggagguggcagccaucuccuucucggcaucaagcuuaccaugauccccggcaaccgcaugcugauggugguccuccugugccaggugcugcucgggggcgccagccacgccucccugaucccggagaccgggaagaagaagguggcggagauccagggccacgccgggggccggcgcagcggccagucccacgagcugcuccgggacuucgaggccacccugcugcagauguucgggcuccgccggcgcccccagcccagcaaguccgccgucauccccgacuacaugcgggaccuguaccgccugcagagcggcgaggaggaggaggagcagauccacuccacggggcucgaguacccggagcggcccgccagccgcgcgaacaccgugcgguccuuccaccacgaggagcaccuggagaacauccccggcaccagcgagaacuccgccuuccgcuuccuguucaaccucagcuccauccccgagaacgaggugaucagcuccgccgagcugcggcuguuccgcgagcaggucgaccaggggccggacugggagcggggcuuccaccgcaucaacaucuacgaggugaugaagccgcccgccgaggugguccccggccaccucaucacccggcugcuggacacgcgccucgugcaccacaacgugacccggugggagaccuucgacgucagccccgcggugcugcgcuggacccgggagaagcagcccaacuacgggcuggccaucgaggugacgcaccuccaccagacccgcacccaccagggccagcacguccgcaucucccggagccugccccagggguccggcaacugggcccagcugcgcccccuccuggugaccuucggccacgacgggcggggccacgcccugacgcgccggcgccgggccaagcgcagcccgaagcaccacagccagcgggcgcgcaagaagaacaagaacugccggcgccacucccucuacguggacuucagcgacgucggguggaacgacuggaucguggccccgcccggcuaccaggccuucuacugccacggggacugccccuucccccuggccgaccaccugaacuccaccaaccacgccaucgugcagacccucgucaacagcgugaacuccagcauccccaaggcgugcugcgugcccaccgagcuguccgccaucagcaugcuguaccucgacgaguacgacaaggucgugcugaagaacuaccaggagauggucguggagggcugcggcugccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2727 - RNA, 1924 nt, Artificial Sequence
  mRNA product Design2 comprising derived and/or modified sequence from Homo sapiens__NP_001709.1__HsBMP6 (opt1)
ggggcgcugccuacggagguggcagccaucuccuucucggcaucaagcuuaccaugcccggccuggggcgccgggcccaguggcucugcuggugguggggccugcugugcagcugcugcgggccgccgccccuccggccgccccugcccgccgcggccgccgccgccgcgggcgggcagcugcucggcgacggcgggucccccggccggaccgagcagcccccgcccagcccccaguccagcuccggguuccuguaccgccggcugaagacccaggagaagcgcgagaugcagaaggagauccucagcgugcugggccugccccaccggccccgcccccuccacgggcugcagcagccccagcccccggcccugcggcagcaggaggagcagcagcagcagcagcagcucccccgcggcgagcccccgcccggccggcugaaguccgcgccccuguucaugcucgaccuguacaacgcccugagcgccgacaacgacgaggacggggccuccgagggcgagcgccagcagagcuggccccacgaggccgccuccagcucccagcggcgccagcccccgcccggggccgcgcacccccucaaccgcaagagccugcuggcccccggcuccggcagcgggggcgccuccccgcucacgagcgcccaggacuccgccuuccugaacgacgcggacauggucaugagcuucgugaaccugguggaguacgacaaggaguucagcccccgccagcggcaccacaaggaguucaaguucaaccucucccagauccccgagggggaggucgugaccgccgccgaguuccgcaucuacaaggacugcgugaugggcagcuucaagaaccagaccuuccugaucuccaucuaccagguccugcaggagcaccagcaccgggacagcgaccucuuccugcuggacacccgcguggugugggccuccgaggagggguggcucgaguucgacaucacggccaccagcaaccugugggucgugaccccgcagcacaacaugggccugcagcucuccguggucacccgggacggcgugcacgugcacccccgcgcggccgggcuggucggccgcgacgggcccuacgacaagcagcccuucaugguggccuucuucaaggugagcgagguccacgugcggacgacccgcuccgccagcucccggcgccggcagcagagccgcaaccgguccacccagagccaggacguggcccgcgucuccagcgcguccgacuacaacagcuccgagcugaagaccgccugccggaagcacgagcucuacgugagcuuccaggaccugggcuggcaggacuggaucaucgccccgaagggguacgccgcgaacuacugcgacggcgagugcagcuucccccugaacgcccacaugaacgccacgaaccacgccaucgugcagacccucguccaccugaugaaccccgaguacgugcccaagccgugcugcgcccccaccaagcugaacgcgaucuccguccucuacuucgacgacaacagcaacgugauccugaagaaguaccgcaacauggugguccgggccugcggcugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2728 - RNA, 1678 nt, Artificial Sequence
  mRNA product Design2 comprising derived and/or modified sequence from Homo sapiens__NP_001710.1__HsBMP7 (opt1)
ggggcgcugccuacggagguggcagccaucuccuucucggcaucaagcuuaccaugcacgugcgcagccugcgggccgccgcgccccacuccuucgucgcccucugggccccgcuguuccugcuccgcagcgcccuggccgacuucucccuggacaacgaggugcacagcuccuucauccaccggcgccuccggagccaggagcgccgggagaugcagcgcgagauccuguccauccugggccucccccaccggccccgcccccaccuccaggggaagcacaacagcgcgccgauguucaugcuggaccuguacaacgccauggccguggaggagggcgggggccccgggggccagggcuucuccuaccccuacaaggccgucuucagcacccaggggcccccgcuggcgucccugcaggacagccacuuccucaccgacgccgacauggugauguccuucgugaaccuggucgagcacgacaaggaguucuuccacccccgguaccaccaccgcgaguuccgguucgaccugagcaagauccccgagggcgaggccgugacggccgccgaguuccgcaucuacaaggacuacauccgggagcgcuucgacaacgagaccuuccggaucuccguguaccagguccuccaggagcaccuggggcgcgagagcgaccuguuccuccuggacucccggacccugugggcgagcgaggagggcuggcucguguucgacaucaccgccacguccaaccacuggguggucaacccccgccacaaccuggggcugcagcucagcguggagacccuggacggccagagcaucaacccgaagcuggccggccucaucgggcggcacggcccccagaacaagcagcccuucaugguggccuucuucaaggccaccgagguccacuuccgcuccauccgcagcaccggguccaagcagcggagccagaaccgcuccaagacgcccaagaaccaggaggcgcugcggauggccaacguggccgagaacagcuccagcgaccagcgccaggccugcaagaagcacgagcuguacguguccuuccgggaccucggcuggcaggacuggaucaucgccccggagggcuacgcggccuacuacugcgagggggagugcgccuucccccugaacagcuacaugaacgccaccaaccacgccaucguccagacccuggugcacuucaucaaccccgagaccgugcccaagccgugcugcgcgcccacgcagcucaacgccaucuccguccuguacuucgacgacagcuccaacgugauccugaagaaguaccgcaacauggugguccgggccugcggcugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2729 - RNA, 682 nt, Artificial Sequence
  mRNA product Design2 comprising derived and/or modified sequence from Homo sapiens__NP_006264.2__HsCCL7 (opt1)
ggggcgcugccuacggagguggcagccaucuccuucucggcaucaagcuuaccaugaaggccagcgccgcgcugcucugccugcugcucaccgccgccgccuucagcccccagggccuggcccagccgguggggaucaacaccuccacgaccugcugcuaccgcuucaucaacaagaagauccccaagcagcggcuggaguccuaccgccggaccaccagcucccacugcccccgcgaggcggucaucuucaagacgaagcucgacaaggagaucugcgccgaccccacccagaagugggugcaggacuucaugaagcaccuggacaagaagacccagaccccgaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2730 - RNA, 4006 nt, Artificial Sequence
  mRNA product Design2 comprising derived and/or modified sequence from Homo sapiens__NP_001954.2__HsEGF (opt1)
ggggcgcugccuacggagguggcagccaucuccuucucggcaucaagcuuaccaugcugcucacccugaucauccugcuccccguggucagcaaguucuccuucgugagccuguccgcgccccagcacuggagcugccccgagggcacccuggccgggaacggcaacuccacgugcguggggcccgcccccuuccucaucuucagccacggcaacuccaucuuccgcaucgacaccgaggggaccaacuacgagcagcuggucguggacgccggcgugagcgucaucauggacuuccacuacaacgagaagcggaucuacuggguggaccuggagcgccagcuccugcagcggguguuccugaacggcucccgccaggagcgggucugcaacaucgagaagaacgugagcgggauggccaucaacuggaucaacgaggaggugaucugguccaaccagcaggagggcaucaucaccgucacggacaugaaggggaacaacagccacauccuccuguccgcccugaaguacccggccaacguggcgguggaccccgucgagcgcuucaucuucuggagcuccgagguggccggcagccucuaccgggccgaccuggacggggugggcgucaaggcccugcucgagaccuccgagaagaucaccgcggugagccuggacgugcuggacaagcgccucuucuggauccaguacaaccgggagggcuccaacagccugaucugcagcugcgacuacgacgggggcuccguccacaucagcaagcaccccacccagcacaaccuguucgccaugucccucuucggggaccgcaucuucuacagcacguggaagaugaagaccaucuggaucgccaacaagcacaccggcaaggacauggugcggaucaaccugcacuccagcuucgugccccugggcgagcucaaggucgugcacccgcuggcccagcccaaggccgaggacgacaccugggagcccgagcagaagcugugcaagcuccgcaaggggaacugcuccagcacggucugcggccaggaccugcagucccaccugugcaugugcgcggagggguacgcccucagccgggaccgcaaguacugcgaggacgugaacgagugcgccuucuggaaccacggcugcacccuggggugcaagaacacccccggcuccuacuacugcacgugcccggugggcuucguccugcuccccgacgggaagcggugccaccagcuggugagcugcccccgcaacguguccgagugcagccacgacugcguccugaccuccgagggcccccucugcuucugcccggaggggagcgugcuggagcgggacggcaagaccugcuccgggugcagcucccccgacaacggcggcugcagccagcugugcgugccccucagccccgucuccugggagugcgacugcuucccgggguacgaccugcagcuggacgagaaguccugcgccgccagcggcccccagcccuuccuccuguucgcgaacagccaggacauccgccacaugcacuucgacgggaccgacuacggcacccugcucucccagcagauggggaugguguacgcccuggaccacgaccccguggagaacaagaucuacuucgcccacacggcccugaaguggaucgagcgggccaacauggacggcagccagcgcgagcggcugaucgaggagggcgucgacgugccggaggggcucgcgguggacuggaucggccgccgcuucuacuggaccgaccgggggaagucccugaucggccgcagcgaccugaacggcaagcgguccaagaucaucaccaaggagaacaucagccagccccgcgggaucgccguccaccccauggccaagcgccucuucuggaccgacacgggcaucaacccccggaucgaguccagcucccugcaggggcugggccggcucgugaucgccagcuccgaccugaucuggccgagcgggaucaccaucgacuuccugaccgacaagcucuacuggugcgacgccaagcaguccgugaucgagauggcgaaccuggacggcagcaagcgccggcgccugacccagaacgacgucggccaccccuucgccguggccguguucgaggacuacgucugguucagcgacugggccaugcccuccgugaugcgggugaacaagcgcacggggaaggaccggguccgccuccagggcagcaugcugaagccguccagccugguggugguccacccccucgcgaagcccggggccgaccccugccuguaccagaacggcgggugcgagcacaucugcaagaagcggcugggcaccgccuggugcuccugccgcgagggcuucaugaaggccagcgacgggaagaccugccucgcccuggacggccaccagcugcucgccgggggcgagguggaccugaagaaccaggugaccccgcuggacauccucuccaagacgcgggucagcgaggacaacaucaccgagucccagcacaugcugguggccgagaucauggugagcgaccaggacgacugcgcccccgucgggugcuccauguacgcccgcugcaucagcgagggcgaggacgcgaccugccagugccugaagggcuucgcgggggacggcaagcucugcuccgacaucgacgagugcgagaugggggugcccgugugcccgccggccagcuccaagugcaucaacaccgagggcggguacgucugccggugcagcgagggcuaccagggcgacgggauccacugccuggacaucgacgagugccagcugggcgagcacuccugcggggagaacgccagcugcacgaacaccgagggcggcuacacgugcaugugcgccgggcgccucuccgagcccggccugaucugccccgacagcacgcccccgccccaccuccgcgaggacgaccaccacuacagcgugcggaacuccgacagcgagugcccccugucccacgacggguacugccugcacgacggcgugugcauguacaucgaggcccuggacaaguacgcgugcaacugcgucgugggguacaucggcgagcgcugccaguaccgggaccucaaguggugggagcugcgccacgccggccacgggcagcagcagaaggugaucgucguggccgugugcgucguggugcuggucaugcuccugcugcucagccuguggggcgcccacuacuaccggacccagaagcugcucuccaagaaccccaagaacccguacgaggagagcucccgcgacgugcggagccgccggcccgcggacaccgaggacgggauguccagcugcccccagcccugguucguggucaucaaggagcaccaggaccugaagaacggcgggcagccgguggccggcgaggacggccaggccgccgacggguccaugcagcccaccagcuggcgccaggagccccagcugugcggcauggggaccgagcagggcugcuggauccccgucuccagcgacaagggguccugcccccaggugauggagcggagcuuccacaugcccuccuacggcacccagacccucgagggcgggguggagaagccccacagccugcuguccgccaacccgcucuggcagcagcgcgcgcuggacccgccccaccagauggagcugacccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2731 - RNA, 892 nt, Artificial Sequence
  mRNA product Design2 comprising derived and/or modified sequence from Homo sapiens__NP_001423.1__HsEREG (opt1)
ggggcgcugccuacggagguggcagccaucuccuucucggcaucaagcuuaccaugaccgccggccgccggauggagaugcugugcgccgggcgcgugcccgcgcuccugcugugccucggcuuccaccuccugcaggccguccugagcaccacggugaucccguccugcauccccggggagagcuccgacaacugcaccgcccuggugcagaccgaggacaacccccgggucgcccaggugagcaucaccaagugcuccagcgacaugaacggcuacugccugcacgggcagugcaucuaccucguggacaugucccagaacuacugccgcugcgaggucggcuacacgggcgugcggugcgagcacuucuuccugaccgugcaccagccccugagcaaggaguacgucgcccucaccgugauccugaucauccuguuccucaucaccguggucggguccacguacuacuucugccgcugguaccggaaccgcaagagcaaggagccgaagaaggaguacgagcgggugaccuccggcgaccccgagcugccccaggugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2732 - RNA, 850 nt, Artificial Sequence
  mRNA product Design2 comprising derived and/or modified sequence from Homo sapiens__NP_000791.1__HsFGF1 (opt1)
ggggcgcugccuacggagguggcagccaucuccuucucggcaucaagcuuaccauggccgagggcgagaucaccaccuucacggcccugaccgagaaguucaaccugcccccggggaacuacaagaagcccaagcuccuguacugcagcaacggcgggcacuuccuccgcauccugcccgacggcaccguggacgggacccgggaccgcuccgaccagcacauccagcugcagcucagcgcggaguccgucggcgagguguacaucaagagcacggagaccggccaguaccuggccauggacaccgacgggcugcucuacggcucccagacccccaacgaggagugccuguuccuggagcggcucgaggagaaccacuacaacacguacaucagcaagaagcacgccgagaagaacugguucguggggcugaagaagaacggcuccugcaagcgcgggccgcggacccacuacggccagaaggccauccuguuccucccccugcccgucagcuccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2733 - RNA, 1249 nt, Artificial Sequence
  mRNA product Design2 comprising derived and/or modified sequence from Homo sapiens__NP_001997.5__HsFGF2 (opt1)
ggggcgcugccuacggagguggcagccaucuccuucucggcaucaagcuuaccauggugggcgucgggggcggggacguggaggacgugaccccgcgcccgggcgggugccagaucagcggccggggcgcccgcgggugcaacggcauccccggggccgcggccugggaggccgcccugccccggcgccggccccgccggcacccguccgucaacccccgcagccgggccgcgggcagcccccgcacccgggggcgccggacggaggagcgccccuccggcucccggcucggcgaccgcgggcggggccgcgcccugcccgggggccggcugggcgggcgcggccgggggcgcgcccccgagcgcgugggcgggcggggccgcggccgggggaccgccgcgccccgcgccgcccccgccgcccggggcagccgcccggggcccgcgggcaccauggccgccggguccaucaccacgcuccccgcccugcccgaggacggcggcagcggggccuucccgcccggccacuucaaggaccccaagcggcuguacugcaagaacgggggcuucuuccuccgcauccaccccgacgggcggguggacggcguccgcgagaaguccgacccgcacaucaagcugcagcugcaggcggaggagcggggcguggugagcaucaagggggucugcgccaaccgcuaccucgccaugaaggaggacggccggcugcuggccuccaagugcgugaccgacgagugcuucuucuucgagcgccucgagagcaacaacuacaacaccuaccggucccgcaaguacaccagcugguacguggcccugaagcggacggggcaguacaagcugggcuccaagaccggccccgggcagaaggcgauccucuuccugcccaugagcgccaaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2734 - RNA, 967 nt, Artificial Sequence
  mRNA product Design2 comprising derived and/or modified sequence from Homo sapiens__NP_002000.1__HsFGF7 (opt1)
ggggcgcugccuacggagguggcagccaucuccuucucggcaucaagcuuaccaugcacaaguggauccugaccuggauccuccccacccugcuguaccgcagcugcuuccacaucaucugccucgugggcacgaucucccuggccugcaacgacaugaccccggagcagauggccaccaacgucaacugcagcucccccgagcggcacacccgcagcuacgacuacauggagggcggggacauccgggugcgccggcuguucugccgcacgcagugguaccuccggaucgacaagcgcgggaaggugaagggcacccaggagaugaagaacaacuacaacaucauggagauccggaccgucgcgguggggaucguggccaucaagggcgucgaguccgaguucuaccuggccaugaacaaggagggcaagcuguacgccaagaaggagugcaacgaggacugcaacuucaaggagcucauccuggagaaccacuacaacaccuacgccagcgcgaaguggacgcacaacgggggcgagauguucguggcccugaaccagaaggggauccccgugcgcggcaagaagaccaagaaggagcagaagaccgcccacuuccuccccauggccaucaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2735 - RNA, 1009 nt, Artificial Sequence
  mRNA product Design2 comprising derived and/or modified sequence from Homo sapiens__NP_001936.1__HsHBEGF (opt1)
ggggcgcugccuacggagguggcagccaucuccuucucggcaucaagcuuaccaugaagcugcuccccagcgugguccugaagcuguuccucgccgccgugcuguccgcgcuggugaccggcgagagccucgagcggcugcggcgcgggcuggccgccggcaccuccaacccggacccgcccacggucagcaccgaccagcuccugccccucgggggcgggcgggaccgcaaggugcgggaccugcaggaggccgaccuggaccugcuccgcgugacccuguccagcaagccccaggcccuggcgacccccaacaaggaggagcacggcaagcggaagaagaagggcaaggggcucggcaagaagcgcgaccccugccugcggaaguacaaggacuucugcauccacggggagugcaaguacgucaaggagcugcgcgcccccuccugcaucugccacccgggcuaccacggggagcggugccacggccucagccugcccguggagaaccgccuguacacguacgaccacaccaccauccucgccguggucgccguggugcuguccagcgucugccugcucgugaucgugggccugcugauguuccgguaccaccgccgcgggggcuacgacgucgagaacgaggagaaggugaagcucgggaugaccaacucccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2736 - RNA, 2569 nt, Artificial Sequence
  mRNA product Design2 comprising derived and/or modified sequence from Homo sapiens__NP_000592.3__HsHGF (opt1)
ggggcgcugccuacggagguggcagccaucuccuucucggcaucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaaguccgccaagacgacccugaucaagaucgaccccgcccugaagaucaagaccaagaaggugaacaccgccgaccagugcgccaaccggugcacgcgcaacaaggggcuccccuucacgugcaaggcguucguguucgacaaggcccggaagcagugccugugguucccguucaacagcaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucaccagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccucaccuacaaggugccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2737 - RNA, 2308 nt, Artificial Sequence
  mRNA product Design2 comprising derived and/or modified sequence from Homo sapiens__NP_005336.3 __HsHSPA1A (opt1)
ggggcgcugccuacggagguggcagccaucuccuucucggcaucaagcuuaccauggccaaggccgcggccaucggcaucgaccuggggaccaccuacagcugcgugggcguguuccagcacgggaagguggagaucaucgccaacgaccagggcaaccgcacgacccccuccuacguggccuucaccgacaccgagcggcucaucggggacgccgcgaagaaccaggucgcccugaacccgcagaacacgguguucgacgccaagcgccugaucggccggaaguucggcgaccccgugguccagagcgacaugaagcacuggcccuuccaggugaucaacgacggggacaagcccaaggugcaggucuccuacaagggcgagaccaaggccuucuacccggaggagaucagcuccauggugcucaccaagaugaaggagaucgcggaggccuaccugggguaccccgugaccaacgccgucaucacggugcccgccuacuucaacgacagccagcgccaggccaccaaggacgcgggcgugaucgccgggcugaacguccuccggaucaucaacgagcccaccgccgccgccaucgcguacggccuggaccgcaccggcaagggggagcggaacgugcugaucuucgaccucggcgggggcacguucgacguguccauccugaccaucgacgacggcaucuucgaggucaaggccaccgccggggacacccaccugggcggggaggacuucgacaaccgccucgugaaccacuucguggaggaguucaagcggaagcacaagaaggacaucagccagaacaagcgcgccguccggcgccugcggacggccugcgagcgcgcgaagcggacccuguccagcuccacccaggccagccucgagaucgacucccuguucgagggcaucgacuucuacaccagcaucacgcgcgcccgguucgaggagcugugcuccgaccucuuccgcagcacccuggagccgguggagaaggcccugcgggacgccaagcucgacaaggcgcagauccacgaccuggugcuggucgggggcuccacccgcauccccaaggugcagaagcuccugcaggacuucuucaacggccgggaccugaacaagagcaucaaccccgacgaggccgucgccuacggggccgcggugcaggccgccauccucaugggcgacaaguccgagaacgugcaggaccugcugcuccuggacgucgcgccccugagccucgggcuggagaccgccggcggggugaugacggcccugaucaagcgcaacagcaccaucccgaccaagcagacccagaucuucacgaccuacuccgacaaccagcccggcgugcucauccaggucuacgagggcgagcgcgccaugaccaaggacaacaaccugcuggggcgguucgagcucagcggcaucccgcccgcgccccgcggggugccccagaucgaggugaccuucgacaucgacgccaacggcauccugaacgucacggccaccgacaaguccaccgggaaggccaacaagaucaccaucacgaacgacaagggccggcugagcaaggaggagaucgagcgcauggugcaggaggccgagaaguacaaggccgaggacgaggugcagcgggagcgcgucuccgccaagaacgcccucgagagcuacgcguucaacaugaaguccgccguggaggacgagggccugaaggggaagaucagcgaggccgacaagaagaaggugcuggacaagugccaggaggucaucuccuggcucgacgccaacacccuggcggagaaggacgaguucgagcacaagcggaaggagcuggagcaggucugcaaccccaucaucagcggccucuaccagggggccggcggccccgggccgggcggguucggcgcccaggggcccaagggcggcuccgggagcggccccaccaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2738 - RNA, 2308 nt, Artificial Sequence; identical to SEQ ID NO: 2737
  mRNA product Design2 comprising derived and/or modified sequence from Homo sapiens__NP_005337.2 __HsHSPA1B (opt1)

SEQ ID NO: 2739 - RNA, 2308 nt, Artificial Sequence
  mRNA product Design2 comprising derived and/or modified sequence from Homo sapiens__NP_005518.3 __HsHSPA1L (opt1)
ggggcgcugccuacggagguggcagccaucuccuucucggcaucaagcuuaccauggccaccgccaagggcaucgcgaucgggaucgaccugggcaccacguacagcugcgugggggucuuccagcacggcaagguggagaucaucgccaacgaccaggggaaccgcaccacccccuccuacguggccuucaccgacacggagcggcucaucggcgacgccgccaagaaccaggucgcgaugaacccgcagaacaccguguucgacgccaagcgccugaucggccggaaguucaacgaccccgugguccaggccgacaugaagcuguggcccuuccaggugaucaacgagggcgggaagcccaaggugcucgucagcuacaagggggagaacaaggccuucuacccggaggagaucuccagcauggugcugaccaagcugaaggagaccgcggaggccuuccucggccaccccgugacgaacgccgucaucaccgugcccgccuacuucaacgacucccagcgccaggccaccaaggacgcgggggugaucgccggccugaacguccugcggaucaucaacgagcccaccgccgccgccaucgcguacggccucgacaagggcgggcagggggagcgccacgugcugaucuucgaccugggcggcgggacguucgacgugagcauccucaccaucgacgacggcaucuucgaggucaaggccaccgccggggacacccaccugggcggggaggacuucgacaaccggcuggugucccacuucguggaggaguucaagcgcaagcacaagaaggacaucagccagaacaagcgggccguccgccggcuccgcacggccugcgagcgggcgaagcgcacccuguccagcuccacccaggccaaccuggagaucgacagccucuacgagggcaucgacuucuacaccuccaucacgcgggcccgcuucgaggagcugugcgccgaccuguuccggggcacccucgagccgguggagaaggcccugcgcgacgcgaagauggacaaggccaagauccacgacaucgugcuggucgggggcagcacccggauccccaaggugcagcgccuccugcaggacuacuucaacgggcgggaccugaacaaguccaucaaccccgacgaggccgucgccuacggcgcggccgugcaggccgccauccucaugggggacaagagcgagaaggugcaggaccugcugcuccuggacgucgcgccccugucccucggccuggagaccgccggcggggugaugacggcccugaucaagcgcaacagcaccaucccgaccaagcagacccagaucuucacgaccuacuccgacaaccagcccggcgugcucauccaggucuacgagggggagcgcgccaugaccaaggacaacaaccugcugggccgguucgaccucaccgggaucccgcccgcgccccgcggcgugccccagaucgaggugacguucgacaucgacgccaacggcauccugaacgucaccgccaccgacaagagcaccgggaaggugaacaagaucacgaucaccaacgacaagggccggcugagcaaggaggagaucgagcgcauggugcucgacgccgagaaguacaaggccgaggacgagguccagcgggagaagaucgccgccaagaacgcgcuggaguccuacgccuucaacaugaaguccguggugagcgacgaggggcugaagggcaagaucagcgaguccgacaagaacaagauccucgacaagugcaacgagcugcugagcuggcucgaggucaaccagcuggccgagaaggacgaguucgaccacaagcgcaaggagcuggagcagaugugcaaccccaucaucaccaagcuguaccagggcgggugcaccggccccgccugcgggaccggcuacgugccggggcggcccgcgacgggccccaccaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2740 - RNA, 2302 nt, Artificial Sequence
  mRNA product Design2 comprising derived and/or modified sequence from Homo sapiens__NP_068814.2 __HsHSPA2 (opt1)
ggggcgcugccuacggagguggcagccaucuccuucucggcaucaagcuuaccaugagcgcccgcggccccgccaucgggaucgaccugggcaccaccuacuccugcgugggggucuuccagcacggcaagguggagaucaucgcgaacgaccaggggaaccggacgaccccgagcuacguggccuucaccgacaccgagcgccucaucggcgacgccgccaagaaccaggucgccaugaaccccacgaacaccaucuucgacgcgaagcggcugaucggccgcaaguucgaggacgccaccgugcaguccgacaugaagcacuggcccuuccggguggucagcgagggcgggaagcccaagguccagguggaguacaagggggagaccaagacguucuucccggaggagaucuccagcauggugcugaccaagaugaaggagaucgccgaggccuaccucggcgggaaggugcacuccgcggugaucaccguccccgccuacuucaacgacagccagcgccaggccaccaaggacgccggcacgaucaccggccugaacgugcugcggaucaucaacgagcccaccgccgcggccaucgccuacgggcucgacaagaagggcugcgccgggggcgagaagaacgugcugaucuucgaccugggcgggggcaccuucgacgucuccauccucacgaucgaggacgggaucuucgaggucaagagcaccgccggcgacacccaccucgggggcgaggacuucgacaaccgcauggugucccaccuggcggaggaguucaagcggaagcacaagaaggacaucggccccaacaagcgcgccgugcggcgccugcggaccgccugcgagcgcgccaagcggacgcugagcuccagcacccaggccuccaucgagaucgacagccuguacgaggggguggacuucuacaccuccaucacccgcgcgcgguucgaggagcucaacgccgaccuguuccgcggcacgcuggagccgguggagaaggcccuccgggacgccaagcuggacaaggggcagauccaggagaucguccuggugggcgggagcacccgcauccccaagauccagaagcuccugcaggacuucuucaacggcaaggagcugaacaaguccaucaaccccgacgaggccguggcguacggcgccgccguccaggccgcgauccucaucggggacaagagcgagaacgugcaggaccugcugcuccuggacgucacgccccugagccucggcaucgagaccgccgggggcgugaugaccccgcugaucaagcggaacaccaccauccccaccaagcagacgcagaccuucaccaccuacuccgacaaccagagcuccgugcugguccagguguacgagggggagcgcgccaugacgaaggacaacaaccuccugggcaaguucgaccugaccggcaucccgcccgcgccccgcggggugccccagaucgaggucaccuucgacaucgacgccaacggcauccucaacgugaccgccgccgacaagagcaccgggaaggagaacaagaucacgaucaccaacgacaagggccggcuguccaaggacgacaucgaccgcauggugcaggaggccgagcgguacaagagcgaggacgaggccaaccgcgaccgggucgccgcgaagaacgcccuggaguccuacaccuacaacaucaagcagaccguggaggacgagaagcuccgcggcaagaucagcgagcaggacaagaacaagauccuggacaagugccaggaggugaucaacuggcuggaccggaaccagauggccgagaaggacgaguacgagcacaagcagaaggagcucgagcgcgucugcaaccccaucaucuccaagcuguaccagggcgggcccgggggcgggagcggcggcgggggcuccggggccagcggcgggccgacgaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2741 - RNA, 2905 nt, Artificial Sequence
  mRNA product Design2 comprising derived and/or modified sequence from Homo sapiens__NP_002145.3 __HsHSPA4 (opt1)
ggggcgcugccuacggagguggcagccaucuccuucucggcaucaagcuuaccaugagcguggucggcaucgaccugggguuccaguccugcuacguggccguggcccgcgcgggcgggaucgagaccaucgccaacgaguacagcgaccggugcacccccgccugcaucuccuucggcccgaagaaccgcagcaucggggccgccgcgaagucccaggucaucagcaacgccaagaacacggugcagggcuucaagcgguuccacggccgcgccuucuccgaccccuucguggaggccgagaaguccaaccucgcguacgacaucguccagcugcccaccgggcugaccggcaucaaggugaccuacauggaggaggagcggaacuucacgaccgagcaggucaccgccaugcuccugagcaagcugaaggagaccgccgagagcgugcucaagaagcccgugguggacugcgucguguccgugccgugcuucuacacggacgccgagcgccggagcgucauggacgccacccagaucgcggggcugaacugccugcgccucaugaacgagaccaccgccguggcccuggccuacggcaucuacaagcaggaccugcccgcccucgaggagaagccccggaacguggucuucguggacauggggcacuccgcguaccaggugagcgucugcgccuucaaccgcggcaagcugaaggugcuggccacggccuucgacaccacccucggcgggcggaaguucgacgaggugcuggucaaccacuucugcgaggaguucggcaagaaguacaagcuggacaucaaguccaagauccgcgcccuccugcggcugagccaggagugcgagaagcucaagaagcugauguccgcgaacgccagcgaccugccccucuccaucgagugcuucaugaacgacguggacgucagcgggaccaugaaccgcggcaaguuccuggagaugugcaacgaccugcucgcccggguggagccgccccugcgcagcgugcuggagcagacgaagcucaagaaggaggacaucuacgccgucgagaucgugggcggggccacccggauccccgcggugaaggagaagaucuccaaguucuucggcaaggagcugagcaccacccugaacgccgacgaggccgucacgcgcgggugcgcccuccagugcgcgauccugucccccgccuucaaggugcgggaguucagcaucaccgacguggucccguaccccaucucccugcgcuggaacagccccgccgaggagggcuccagcgacugcgagguguucuccaagaaccacgccgcccccuucagcaaggugcucaccuucuaccggaaggagccguucacccuggaggcguacuacuccagcccccaggaccugcccuaccccgacccggccaucgcccaguucuccguccagaaggugacgccccagagcgacggguccagcuccaaggugaaggucaaggugcgcgugaacguccacggcaucuucagcguguccagcgccagccucguggagguccacaaguccgaggagaacgaggagcccauggagaccgaccagaacgccaaggaggaggagaagaugcaggucgaccaggaggagccccacguggaggagcagcagcagcagaccccggcggagaacaaggccgagagcgaggagauggagaccucccaggccggcagcaaggacaagaagauggaccagccgccccaggccaagaaggccaaggugaagacguccaccguggaccugcccaucgagaaccagcugcucuggcagaucgaccgcgagaugcugaaccuguacaucgagaacgaggggaagaugaucaugcaggacaagcucgagaaggagcggaacgacgcgaagaacgccguggaggaguacgucuacgagaugcgcgacaagcugagcggcgaguacgagaaguucguguccgaggacgaccggaacagcuucacccugaagcucgaggacaccgagaacuggcuguacgaggacggggaggaccagcccaagcaggucuacguggacaagcuggccgagcugaagaaccucggccagcccaucaagauccgcuuccaggaguccgaggagcggcccaagcuguucgaggagcuggggaagcagauccagcaguacaugaagaucaucagcuccuucaagaacaaggaggaccaguacgaccaccucgacgccgcggacaugacgaagguggagaaguccaccaacgaggccauggaguggaugaacaacaagcugaaccugcagaacaagcagagccucaccauggacccgguggucaagagcaaggagaucgaggccaagaucaaggagcugaccuccacgugcagccccaucaucuccaagcccaagcccaagguggagccgcccaaggaggagcagaagaacgccgagcagaacggccccguggacggccagggggacaaccccggcccgcaggccgcggagcaggggaccgacaccgccguccccagcgacagcgacaagaagcugcccgagauggacaucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2742 - RNA, 2902 nt, Artificial Sequence
  mRNA product Design2 comprising derived and/or modified sequence from Homo sapiens__NP_055093.2 __HsHSPA4L (opt1)
ggggcgcugccuacggagguggcagccaucuccuucucggcaucaagcuuaccaugagcguggucggcaucgaccugggguuccucaacugcuacaucgccguggcccgcuccggcgggaucgagaccaucgcgaacgaguacagcgaccggugcacccccgccugcaucucccugggcagccgcacgcgggccaucgggaacgccgccaagucccagaucgugaccaacguccgcaacaccauccacggcuucaagaagcugcacggccggagcuucgacgacccgaucgugcagaccgagcgcauccggcuccccuacgagcugcagaagaugcccaacggguccgcgggcgugaagguccgcuaccuggaggaggagcggcccuucgccaucgagcaggucacggggaugcuccuggccaagcugaaggagaccagcgagaacgcccucaagaagccgguggcggacugcgugaucuccauccccagcuucuucaccgacgccgagcgccgguccgugauggccgccgcccagguggcgggccugaacugccugcgccucaugaacgagaccacggccgucgcccuggccuacgggaucuacaagcaggaccugccgccccucgacgagaagccccggaacgugguguucaucgacaugggccacagcgccuaccagguccuggugugcgcguucaacaagggcaagcugaaggugcucgccaccaccuucgaccccuaccucgggggccgcaacuucgacgaggcccuggucgacuacuucugcgacgaguucaagaccaaguacaagaucaacgugaaggagaacucccgggcccugcugcgccuguaccaggagugcgagaagcucaagaagcugaugagcgccaacgcguccgaccugccccucaacaucgagugcuucaugaacgaccuggacgugagcuccaagaugaaccgggcccaguucgagcagcugugcgccagccuccuggcccgcgucgagcccccgcugaaggccgugauggagcaggcgaaccuccagcgggaggacaucuccagcaucgagaucgucgggggcgccacgcgcauccccgccgugaaggagcagaucaccaaguucuuccugaaggacaucagcaccacccugaacgccgacgaggcgguggcccggggcugcgcccuccagugcgccauccugucccccgccuucaagguccgcgaguucagcaucacggaccuggugcccuacuccaucacccuccgcuggaagaccagcuucgaggacggguccggcgagugcgagguguucugcaagaaccacccggcgcccuucagcaaggucaucaccuuccacaagaaggagcccuucgagcuggaggccuucuacacgaaccugcacgaggugcccuacccggacgcccggaucggguccuucaccauccagaacguguucccccagagcgacggcgacuccagcaaggucaaggugaaggugcgcgucaacauccacgggaucuucuccguggccagcgccuccgugaucgagaagcagaaccucgagggcgaccacagcgacgcgcccauggagaccgagaccuccuucaagaacgagaacaaggacaacauggacaagaugcaggucgaccaggaggagggccaccagaagugccacgccgagcacacgcccgaggaggagaucgaccacaccggggccaagaccaagagcgccguguccgacaagcaggaccggcugaaccagacccugaagaagggcaaggucaagagcaucgaccucccgauccaguccagccugugccgccagcuggggcaggaccuccugaacagcuacaucgagaacgagggcaagaugaucaugcaggacaagcuggagaaggagcggaacgacgccaagaacgcgguggaggaguacguguacgacuuccgcgaccggcuggggacgguguacgagaaguucaucacccccgaggaccucuccaagcugagcgccguccuggaggacaccgagaacuggcucuacgaggacggcgaggaccagcccaagcaggucuacguggacaagcugcaggagcugaagaaguacggccagcccauccagaugaaguacauggagcacgaggagcgcccgaaggcccucaacgaccuggggaagaagauccagcuggugaugaaggugaucgaggccuaccggaacaaggacgagcgcuacgaccaccucgaccccaccgagauggagaagguggagaagugcaucuccgacgcgaugagcuggcugaacuccaagaugaacgcccagaacaagcugagccucacgcaggaccccgucgugaagguguccgagaucgucgccaagagcaaggagcuggacaacuucugcaacccgaucaucuacaagcccaagcccaaggccgaggugcccgaggacaagccgaaggccaacuccgagcacaacggccccauggacgggcagagcggcaccgagaccaaguccgacagcaccaaggacuccagccagcacacgaaguccagcggggagauggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2743 - RNA, 2347 nt, Artificial Sequence
  mRNA product Design2 comprising derived and/or modified sequence from Homo sapiens__NP_005338.1__HsHSPA5 (opt1)
ggggcgcugccuacggagguggcagccaucuccuucucggcaucaagcuuaccaugaagcugagccucguggccgccaugcugcugcuccuguccgcggcccgcgccgaggaggaggacaagaaggaggacgucggcaccgugguggggaucgaccugggcaccacguacagcugcgucgggguguucaagaacggccggguggagaucaucgccaacgaccaggggaaccgcaucacccccuccuacgucgccuucaccccggagggcgagcggcucaucggcgacgcggccaagaaccagcugaccagcaaccccgagaacacgguguucgacgccaagcgccugaucgggcggaccuggaacgaccccuccgugcagcaggacaucaaguuccuccccuucaaggucguggagaagaagaccaagccguacauccagguggacaucggcgggggccagaccaagacguucgcccccgaggagaucagcgcgaugguccugaccaagaugaaggagaccgccgaggccuaccuggggaagaaggugacccacgccguggucacggugcccgccuacuucaacgacgcgcagcgccaggccaccaaggacgccggcaccaucgccggccucaacgugaugcggaucaucaacgagcccaccgccgcggccaucgccuacgggcuggacaagcgcgagggcgagaagaacauccuggucuucgaccucgggggcggcacguucgacgugucccugcugaccaucgacaacgggguguucgaggucguggccaccaacggcgacacccaccucgggggcgaggacuucgaccagcgggugauggagcacuucaucaagcuguacaagaagaagacggggaaggacguccgcaaggacaaccgggccgugcagaagcugcgccgggaggucgagaaggcgaagcgcgcccucagcucccagcaccaggcccggaucgagaucgagagcuucuacgagggcgaggacuucuccgagacccugacccgcgccaaguucgaggagcugaacauggaccucuuccggagcaccaugaagccggugcagaaggugcuggaggacuccgaccugaagaaguccgacaucgacgagaucguccucgugggcgggagcacgcgcauccccaagauccagcagcuggugaaggaguucuucaacggcaaggagcccagccgggggaucaaccccgacgaggccgucgcguacggcgccgccgugcaggccggggugcuguccggcgaccaggacaccggcgaccucguccugcuggacgugugcccgcucacccuggggaucgagaccgugggcggggucaugacgaagcugaucccccgcaacaccguggugcccaccaagaagucccagaucuucagcaccgcgagcgacaaccagcccacggucaccaucaagguguacgagggcgagcggccgcucaccaaggacaaccaccuccuggggaccuucgaccugacgggcaucccgcccgcgccccgcggcgugccccagaucgaggucaccuucgagaucgacgugaacgggauccugcgcgugaccgccgaggacaagggcaccgggaacaagaacaagaucaccaucacgaacgaccagaaccggcugacccccgaggagaucgagcgcauggucaacgacgccgagaaguucgccgaggaggacaagaagcucaaggagcggaucgacacccgcaacgagcuggagagcuacgccuacucccugaagaaccagaucggcgacaaggagaagcucggcgggaagcugagcuccgaggacaaggagaccauggagaaggccguggaggagaagaucgaguggcuggagagccaccaggacgccgacaucgaggacuucaaggccaagaagaaggagcucgaggagaucgugcagcccaucaucuccaagcuguacggcagcgccgggcccccgcccacgggcgaggaggacaccgcggagaaggacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2744 - RNA, 2314 nt, Artificial Sequence
  mRNA product Design2 comprising derived and/or modified sequence from Homo sapiens__NP_002146.2__HsHSPA6 (opt1)
ggggcgcugccuacggagguggcagccaucuccuucucggcaucaagcuuaccaugcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagagccaggccgcgcucaacccccacaacacgguguucgacgccaagcgccugaucggccggaaguucgccgacaccaccguccaguccgacaugaagcacuggcccuuccgcguggugagcgagggcgggaagcccaagguccgggugugcuaccgcggcgaggacaagaccuucuacccggaggagaucuccagcauggugcuguccaagaugaaggagacggccgaggcguaccucgggcagcccgucaagcacgccgugaucaccgugcccgccuacuucaacgacagccagcggcaggccaccaaggacgccggcgcgaucgccgggcugaacguccugcgcaucaucaacgagcccaccgccgccgccaucgcguacggccucgaccggcgcggcgccggggagcggaacgugcugaucuucgaccugggcgggggcacguucgacguguccguccucagcaucgacgccggcguguucgaggugaaggccaccgccggggacacccaccugggcggggaggacuucgacaaccgccuggucaaccacuucauggaggaguuccggcgcaagcacggcaaggaccucuccgggaacaagcgggcgcugcgccggcugcgcaccgccugcgagcgggccaagcgcacgcucagcuccagcacccaggccacccuggagaucgacucccuguucgagggcguggacuucuacaccagcaucacgcgcgcccgguucgaggagcucugcuccgaccuguuccgcagcacccuggagccgguggagaaggcgcuccgggacgccaagcuggacaaggcccagauccacgacgucgugcuggucggcggguccacccgcauccccaaggugcagaagcuccugcaggacuucuucaacggcaaggagcugaacaagagcaucaaccccgacgaggccguggcguacggggccgccguccaggccgccgugcucaugggcgacaagugcgagaaggugcaggaccugcugcuccuggacgucgcgccccugagccucgggcuggagaccgccggcggcgugaugacgacccugauccagcggaacgccaccaucccgaccaagcagacgcagaccuucaccaccuacuccgacaaccagcccgggguguucauccaggucuacgagggcgagcgcgccaugacgaaggacaacaaccuccuggggcgguucgagcugagcggcaucccgcccgcgccccgcggggugccccagaucgaggugaccuucgacaucgacgccaacggcauccucuccgucaccgccaccgaccggagcacgggcaaggccaacaagaucaccaucaccaacgacaaggggcgccuguccaaggaggagguggagcggauggugcacgaggccgagcaguacaaggccgaggacgaggcgcagcgcgaccgggucgccgccaagaacagccuggaggcccacguguuccacgugaagggcucccuccaggaggagagccugcgcgacaagauccccgaggaggaccggcgcaagaugcaggacaagugccgggagguccuggcguggcucgagcacaaccagcuggccgagaaggaggaguacgagcaccagaagcgcgagcuggagcagaucugccggcccaucuucucccgccuguacgggggcccgggcgugcccgggggcagcuccugcgggacccaggcccgccagggcgaccccagcaccgggcccaucaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2745 - RNA, 1486 nt, Artificial Sequence
  mRNA product Design2 comprising derived and/or modified sequence from Homo sapiens__P48741__HsHSPA7 (opt1)
ggggcgcugccuacggagguggcagccaucuccuucucggcaucaagcuuaccaugcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagagccaggccgcgcucaacccccacaacacgguguucgacgccaagcgccugaucggccggaaguucgccgacaccaccguccaguccgacaugaagcacuggcccuuccagguggugagcgagggcgggaagcccaagguccgcgugugcuaccggggcgaggacaagaccuucuacccggaggagaucuccagcauggugcuguccaagaugaaggagacggccgaggcguaccucgggcagcccgucaagcacgccgugaucaccgugcccaccuacuucagcaacucccagcgccaggccaccaaggacgccggcgccaucgcggggcugaagguccugcccaucaucaacgaggccacggccgccgccaucgcguacggccucgaccggcgcggcgccgggaagcggaacgugcugaucuucgaccugggcgggggcaccuucgacgugagcguccucuccaucgacgccggcguguucgaggugaaggccaccgccggggacacccaccugggcggggaggacuucgacaaccgccuggucaaccacuucauggaggaguuccggcgcaagcacggcaaggaccucagcgggaacaagcgggcgcugcgccggcugcgcacggccugcgagcgggccaagcgcaccccguccagcuccacccaggccacccucgagaucgacagccuguucgagggcguggacuucuacaaguccaucacgcgggcccgcuucgaggagcugugcagcgaccucuuccgcuccacccuggagcccguggagaaggcgcugcgggacgccaagcucgacaaggcccagauccacgacuucguccugggcgggggccugcacagccacccccagggggccgagguggcggccggccuccugcagcgccagggggccgagcaggagcaccagcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2746 - RNA, 2323 nt, Artificial Sequence
  mRNA product Design2 comprising derived and/or modified sequence from Homo sapiens__NP_006588.1 __HsHSPA8 (opt1)
ggggcgcugccuacggagguggcagccaucuccuucucggcaucaagcuuaccaugagcaagggccccgccguggggaucgaccugggcaccaccuacuccugcgucgggguguuccagcacggcaagguggagaucaucgccaacgaccaggggaaccgcacgacccccagcuacgucgcguucaccgacaccgagcggcucaucggcgacgccgccaagaaccagguggccaugaaccccacgaacaccguguucgacgccaagcgccugaucggccggcgcuucgacgacgcggucgugcaguccgacaugaagcacuggcccuucaugguggucaacgacgccgggcggcccaagguccagguggaguacaagggcgagaccaagagcuucuacccggaggagguguccagcauggugcugaccaagaugaaggagaucgccgaggccuaccucgggaagacggugaccaacgcggucgugaccgugcccgccuacuucaacgacucccagcgccaggccaccaaggacgccggcacgaucgccgggcugaacguccugcggaucaucaacgagcccaccgcggccgccaucgccuacggccucgacaagaaggugggcgccgagcgcaacgugcugaucuucgaccucgggggcgggaccuucgacgucagcauccugaccaucgaggacggcaucuucgaggugaaguccacggcgggcgacacccaccucgggggcgaggacuucgacaaccggauggugaaccacuucaucgccgaguucaagcgcaagcacaagaaggacaucagcgagaacaagcgggccguccgccggcugcgcaccgccugcgagcgggccaagcgcacccuguccagcuccacgcaggcgagcaucgagaucgacucccuguacgaggggaucgacuucuacaccagcaucacccgggcccgcuucgaggagcugaacgccgaccucuuccggggcacccuggaccccguggagaaggcccugcgcgacgccaagcucgacaagucccagauccacgacaucguccuggucgggggcagcacgcggaucccgaagauccagaagcugcuccaggacuucuucaacggcaaggagcugaacaaguccaucaaccccgacgaggcgguggccuacggggccgccgugcaggcggccauccugagcggcgacaagagcgagaacgugcaggaccuccugcugcucgacgugacgccccugucccuggggaucgagaccgccggcggggucaugaccgugcucaucaagcgcaacaccaccauccccaccaagcagacccagacguucaccaccuacagcgacaaccagccgggcgugcugauccaggucuacgagggcgagcgcgccaugaccaaggacaacaaccugcucgggaaguucgagcugacgggcaucccgcccgcgccccgcggggugccccagaucgaggugaccuucgacaucgacgccaacggcauccugaacgucuccgccguggacaagagcaccgggaaggagaacaagaucaccaucaccaacgacaagggccggcucuccaaggaggacaucgagcggauggugcaggaggccgagaaguacaaggccgaggacgagaagcagcgcgacaaggucagcuccaagaacagccuggaguccuacgccuucaacaugaaggcgacgguggaggacgagaagcugcagggcaagaucaacgacgaggacaagcagaagauccucgacaagugcaacgagaucaucaacuggcuggacaagaaccagaccgccgagaaggaggaguucgagcaccagcagaaggagcuggagaaggugugcaaccccaucaucaccaagcucuaccagagcgccgggggcaugcccgggggcaugcccggcggguucccgggcgggggcgccccgcccuccgggggcgccagcuccggccccaccaucgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2747 - RNA, 2422 nt, Artificial Sequence
  mRNA product Design2 comprising derived and/or modified sequence from Homo sapiens__NP_004125.3 __HsHSPA9 (opt1)
ggggcgcugccuacggagguggcagccaucuccuucucggcaucaagcuuaccaugaucagcgccucccgcgccgcggccgcccggcuggugggcgccgccgcgagccgcgggcccaccgccgcccggcaccaggacuccuggaacggccucagccacgaggccuuccgccuggucucccggcgcgacuacgcgagcgaggccaucaagggggccguggugggcaucgaccuggggaccacgaacuccugcgucgccgugauggagggcaagcaggccaaggugcucgagaacgcggagggcgcccggaccaccccgagcgucguggccuucaccgccgacggggagcgccuggugggcaugcccgccaagcggcaggcggucacgaaccccaacaacaccuucuacgccaccaagcgccugaucgggcggcgcuacgacgaccccgaggugcagaaggacaucaagaacgugccguucaagaucguccgggccuccaacggcgacgccuggguggaggcccacgggaagcucuacagccccucccagaucggcgcguucgugcugaugaagaugaaggagaccgccgagaacuaccugggccacacggccaagaacgccgucaucaccgugcccgccuacuucaacgacagccagcgccaggcgaccaaggacgccgggcagaucuccggccucaacgugcugcgggucaucaacgagcccaccgccgccgcgcuggccuacgggcucgacaagagcgaggacaaggugaucgccguguacgaccugggcggcgggacguucgacaucuccauccuggagauccagaagggcgucuucgaggucaagagcaccaacggggacaccuuccucggcggggaggacuucgaccaggcccugcugcgccacaucgugaaggaguucaagcgggagaccggcguggaccucacgaaggacaacauggcccugcagcgcgugcgggaggcggccgagaaggccaagugcgagcuguccagcuccguccagaccgacaucaaccucccguaccugaccauggacagcagcggccccaagcaccugaacaugaagcucacccgcgcccaguucgaggggaucgugacggaccugauccggcgcaccaucgcccccugccagaaggcgaugcaggacgccgagguguccaagagcgacaucggcgaggucauccuggucgggggcaugacccgcaugcccaaggugcagcagaccgugcaggaccucuucgggcgggccccguccaaggccgugaaccccgacgaggccguggcgaucggcgccgccauccagggcgggguccuggccggcgacgugacggacgugcugcuccuggacgucacgccccugagccucgggaucgagacccugggcgggguguucaccaagcugaucaaccgcaacaccaccauccccaccaagaagucccagguguucagcaccgcggccgacggccagacgcaggucgagaucaaggugugccagggcgagcgggagauggccggggacaacaagcuccugggccaguucacccugaucgggaucccgcccgcgccccgcggcgugccccagaucgaggucaccuucgacaucgacgccaacggcaucgugcacguguccgccaaggacaaggggaccggccgggagcagcagaucgucauccagagcuccgggggccucagcaaggacgacaucgagaacauggugaagaacgccgagaaguacgccgaggaggaccgccggaagaaggagcgcguggaggccgucaacauggccgaggggaucauccacgacacggagaccaagauggaggaguucaaggaccagcugccggcggacgagugcaacaagcugaaggaggagaucuccaagaugcgggagcuccuggcccgcaaggacagcgagaccggcgagaacauccggcaggccgccuccagccugcagcaggccucccucaagcuguucgagauggcguacaagaagauggccagcgagcgcgagggcuccgggagcuccggcaccggggagcagaaggaggaccagaaggaggagaagcagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2748 - RNA, 2410 nt, Artificial Sequence
  mRNA product Design2 comprising derived and/or modified sequence from Homo sapiens__NP_079291.2__HsHSPA12A (opt1)
ggggcgcugccuacggagguggcagccaucuccuucucggcaucaagcuuaccauggccgacaaggaggccggcgggagcgacggcccccgcgagaccgcgccgaccuccgccuacagcucccccgcccggagccugggggacacgggcaucacgccccucucccccagccacaucgugaacgacaccgacuccaacgucagcgagcagcaguccuuccuggugguggucgccguggacuucgggaccaccagcuccggcuacgccuacagcuucaccaaggagccggagugcauccacgugaugcgccggugggagggcggggaccccggcgucuccaaccagaagacccccaccacgauccugcucacccccgagcgcaaguuccacagcuucggguacgcggcccgggacuucuaccacgaccuggacccgaacgaggccaagcaguggcuguaccucgagaaguucaagaugaagcugcacaccaccggcgaccugacgauggacaccgaccucaccgccgcgaacgggaagaaggugaaggcccuggagaucuucgccuacgcccugcaguacuucaaggagcaggcccucaaggagcuguccgaccaggcgggcagcgaguucgagaacuccgacgugcgcugggucaucaccgugcccgccaucuggaagcagcccgccaagcaguucaugcggcaggccgccuaccaggcgggccuggccagccccgagaacuccgagcagcucaucaucgcccuggagccggaggccgccagcaucuacugccgcaagcugcggcuccaccagaugaucgagcugagcuccaaggcggccgugaacggguacagcggcuccgacacggucggggccggcuucacccaggccaaggagcacauccgccggaaccgccagagccggaccuuccugguggagaacgugaucggcgagaucugguccgagcucgaggagggggacaaguacgucgugguggacagcggcgggggcaccgucgaccugacggugcaccagauccgccugcccgaggggcaccucaaggagcuguacaaggccaccggcggccccuacgggucccugggcguggacuacgaguucgagaagcuccuguacaagaucuucggggaggacuucaucgagcaguucaagaucaagcggcccgcggccugggucgaccugaugaucgccuucgagagccgcaagcgggccgcggccccggaccgcaccaacccccucaacaucacccugcccuucuccuucaucgacuacuacaagaaguuccggggccacagcguggagcacgcccugcgcaaguccaacguggacuucgucaaguggagcucccaggggaugcuccggaugagccccgacgccaugaacgcccuguucaagccgacgaucgacuccaucaucgagcaccuccgcgaccuguuccagaagcccgaggugagcaccgucaaguuccuguuccuggugggcggcuucgcggaggcgccccuccugcagcaggccgugcaggccgccuucggggaccagugccgcaucaucaucccccaggacgucggccugaccauccucaagggggccgugcuguucggccuggacccggccgugaucaagguccggcgcagcccccucaccuacggggugggcgugcugaaccgguacgucgagggcaagcacccgcccgagaagcugcucgugaaggacgggacgcgcuggugcaccgacguguucgacaaguucaucuccgccgaccaguccgucgcccugggcgagcuggugaagcggagcuacacccccgccaagcccagccagcuggugaucgucaucaacaucuacuccagcgagcacgacaacguguccuucaucaccgaccccggggugaagaagugcggcacgcuccgccuggaccugaccggcaccagcgggaccgcggucccggcccggcgcgagauccagacgcucaugcaguucggcgacaccgagaucaaggccaccgccaucgacaucgcgaccuccaagagcgugaagguggggaucgacuuccugaacuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2749 - RNA, 2443 nt, Artificial Sequence
  mRNA product Design2 comprising derived and/or modified sequence from Homo sapiens__NP_443202.3 __HsHSPA12B (opt1)
ggggcgcugccuacggagguggcagccaucuccuucucggcaucaagcuuaccaugcuggccgugcccgagaugggccuccaggggcuguacaucggcagcucccccgagcgcagccccguccccuccccgcccgggagcccccggacccaggaguccugcggcaucgccccgcugacccccagccagucccccaagcccgaggugcgcgcgccccagcaggccagcuucuccguggucguggccaucgacuucgggacgaccagcuccggcuacgccuucagcuucgccuccgaccccgaggcgauccacaugaugcggaagugggagggcggggacccgggcguggcccaccagaagaccccgaccugccuccugcugacgcccgagggggccuuccacagcuucggcuacaccgcccgcgacuacuaccacgaccucgaccccgaggaggcgcgggacuggcuguacuucgagaaguucaagaugaagauccacuccgccaccgaccugacccucaagacgcagcuggaggccgucaacgggaagaccaugcccgcccuggagguguucgcccacgcgcuccgcuucuuccgggagcacgcccugcaggagcugcgcgagcagagccccucccuccccgagaaggacaccgugcgguggguccugaccgugcccgccaucuggaagcagccggccaagcaguucaugcgcgaggccgcguaccuggccggccucgugagccgggagaacgccgagcagcugcugaucgcccucgagcccgaggccgcguccgucuacugccgcaagcugcggcugcaccagcuccuggaccugagcggccgcgcccccgggggcgggcggcucggcgagcgccggagcaucgacuccagcuuccgccaggcccgggagcagcugcgccggucccgccacagccgcacguuccugguggaguccggcgugggggagcucugggccgagaugcaggccggcgaccgguacgucguggcggacugcgggggcgggaccguggaccugaccguccaccagcuggagcagccccacggcacccucaaggagcuguacaaggccagcggcgggccguacggcgccguggggguggaccuggccuucgagcagcuccugugccgcaucuucggcgaggacuucaucgcgacguucaagcggcagcgccccgccgccugggucgaccugaccaucgccuucgaggcccggaagcgcaccgcggggccccaccgggccggcgcccucaacaucucccugcccuucagcuucaucgacuucuaccgcaagcagcggggccacaacguggagaccgcccugcgccgguccagcgugaacuucgucaagugguccagccaggggaugcuccgcauguccugcgaggccaugaacgagcuguuccagccgacggugagcggcaucauccagcacaucgaggcgcugcucgcccggcccgagguccagggggugaagcugcuguuccucgugggcggguucgccgaguccgccguccugcagcacgccgugcaggcggcccugggcgcccgcggccugcggguggucgugccccacgacguggggcucaccauccugaagggcgccguccuguucgggcaggcgccgggcguggugcgcguccggcgcagcccccucaccuacggcgugggggugcugaaccgguucguccccggccgccacccgcccgagaagcugcucgugcgcgacgggcggcgcuggugcaccgacguguucgagcgguucgucgccgccgagcaguccguggcccugggcgaggaggugcgccggagcuacugccccgcccgccccgggcagcggcgcguccugaucaaccucuacugcugcgcggccgaggacgcccgguucaucacggaccccggcgugcgcaagugcggcgcccugucccuggagcucgagccggccgacugcgggcaggacaccgcgggcgccccgcccgggcggcgcgagauccgggccgccaugcaguucggcgacaccgagaucaaggugaccgccgucgacgugagcacgaaccgcagcgugcgggcguccaucgacuuccugagcaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2750 - RNA, 1798 nt, Artificial Sequence
  mRNA product Design2 comprising derived and/or modified sequence from Homo sapiens__NP_008879.3__HsHSPA13 (opt1)
ggggcgcugccuacggagguggcagccaucuccuucucggcaucaagcuuaccauggcccgggagaugaccauccugggcagcgccgugcucacccugcugcucgcgggguaccuggcccagcaguaccugccccucccgacgcccaaggucaucggcaucgaccuggggaccaccuacugcuccgugggcguguucuuccccgggaccggcaaggucaaggugauccccgacgagaacggccacaucagcaucccguccauggugagcuucacggacaacgacgucuacgugggguacgaguccguggagcuggccgacagcaacccccagaacaccaucuacgacgccaagcgguucaucggcaagaucuucaccgccgaggagcucgaggcggagaucgggcgcuaccccuucaagguccugaacaagaacggcaugguggaguucuccgugaccagcaacgagacgaucaccgucucccccgaguacguggggagccggcugcuccugaagcugaaggagauggccgaggccuaccucggcaugccgguggccaacgcggucaucuccgugcccgccgaguucgaccugaagcagcgcaacagcaccaucgaggccgccaaccuggccggccucaagauccugcgggugaucaacgagcccaccgcggccgccauggccuacgggcugcacaaggccgacgucuuccacgugcucgugaucgaccugggcgggggcacgcuggacgucucccuccugaacaagcagggcgggauguuccugacccgcgcgaugagcggcaacaacaagcucgggggccaggacuucaaccagcggcugcugcaguaccucuacaagcagaucuaccagaccuacggguucgugcccucccgcaaggaggagauccaccggcugcgccaggccguggagauggucaagcugaaccucacccugcaccagagcgcccagcuguccgugcuccugacggucgaggagcaggaccggaaggagccgcacagcuccgacaccgagcugcccaaggacaagcucagcagcgccgacgaccaccgcgugaacuccggcuucggccgggggcugagcgacaagaaguccggcgagagccaggugcuguucgagaccgagaucucccgcaagcuguucgacacccugaacgaggaccuguuccagaagauccucguccccauccagcagguccugaaggaggggcaccuggagaagacggagaucgacgagguggugcucgugggcgggagcacccggaucccccgcauccgccaggugauccaggaguucuucggcaaggacccgaacaccuccgucgaccccgaccuggccguggugaccggcgucgcgauccaggccgggaucgacggcgggagcuggccccuccagguguccgcccuggagauccccaacaagcaccuccagaagacgaacuucaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2751 - RNA, 1912 nt, Artificial Sequence
  mRNA product Design2 comprising derived and/or modified sequence from Homo sapiens__NP_057383.2__HsHSPA14 (opt1)
ggggcgcugccuacggagguggcagccaucuccuucucggcaucaagcuuaccauggccgccaucggcgugcaccuggggugcaccagcgcgugcgucgccguguacaaggacggccgcgccgggguggucgccaacgacgccggcgaccgggugacccccgcgguggucgccuacuccgagaacgaggagaucguggggcucgccgccaagcagagccgcauccggaacaucuccaacacggugaugaaggucaagcagauccugggccgcagcuccagcgacccgcaggcgcagaaguacaucgccgaguccaagugccuggugaucgagaagaacggcaagcuccgguacgagaucgacaccggggaggagaccaaguucgugaaccccgaggacgucgcccgccugaucuucagcaagaugaaggagaccgcccacuccgugcugggcagcgacgccaacgacguggucaucacggugcccuucgacuucggggagaagcagaagaacgcgcucggcgaggccgcccgggccgccggguucaacgugcugcgccugauccacgagcccuccgcggcccuccuggccuacggcaucggccaggacagcccgaccgggaaguccaacauccuggucuucaagcucggcgggaccagccugucccugagcgugauggaggugaacuccggcaucuaccggguccucagcaccaacacggacgacaacaucggcggggcccacuucaccgagacccuggcccaguaccuggcguccgaguuccagcgcagcuucaagcacgacgugcggggcaacgcccgcgccaugaugaagcucaccaacagcgccgagguggccaagcacucccugagcacgcugggguccgcgaacugcuuccucgacagccuguacgagggccaggacuucgacugcaacgucucccgggcccgcuucgagcugcucugcagcccccuguucaacaagugcaucgaggccauccgggggcugcucgaccagaacggcuucaccgccgacgacaucaacaaggugguccugugcggcggguccagccgcauccccaagcugcagcagcucaucaaggaccuguuccccgcgguggagcugcucaacuccaucccgcccgacgaggugauccccaucggcgccgccaucgaggccgggauccugaucggcaaggagaaccugcucgucgaggacagccugaugaucgagugcuccgcccgggacauccuggugaaggggguggacgagagcggcgcgucccgcuucaccguccucuuccccagcggcaccccgcugcccgcccggcgccagcacacgcugcaggcccccggguccaucagcuccgugugccucgagcuguacgagagcgacggcaagaacuccgccaaggaggagaccaaguucgcccaggugguccugcaggaccucgacaagaaggagaacgggcugcgggacauccuggcggugcucaccaugaagcgcgacggcagccugcacgugaccugcacggaccaggagaccgggaagugcgaggccaucagcaucgagaucgccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2752 - RNA, 2959 nt, Artificial Sequence
  mRNA product Design2 comprising derived and/or modified sequence from Homo sapiens__NP_006635.2 __HsHSPH1 (opt1)
ggggcgcugccuacggagguggcagccaucuccuucucggcaucaagcuuaccaugagcguggucggccuggacguggggucccagagcugcuacaucgccguggcccgcgcgggcgggaucgagaccaucgccaacgaguucuccgaccggugcacccccagcgucaucuccuucggcagcaagaaccgcaccaucgggguggccgccaagaaccagcagaucacccacgccaacaacaccguguccaacuucaagcgguuccacggccgcgcguucaacgacccguucauccagaaggagaaggagaaccucagcuacgaccuggucccccugaagaacggcggggugggcaucaaggugauguacaugggggaggagcaccucuucuccgucgagcagaucaccgccaugcugcugacgaagcucaaggagaccgccgagaacagccugaagaagcccgugaccgacugcgugaucuccguccccagcuucuucaccgacgccgagcggcgcuccgugcuggacgcggcccagaucgugggccucaacugccugcggcugaugaacgacaugacggccgucgcccucaacuacgggaucuacaagcaggaccugccgagccuggacgagaagccccgcaucgugguguucgucgacaugggccacuccgccuuccaggugagcgcgugcgccuucaacaagggcaagcucaaggugcuggggaccgccuucgaccccuuccugggcgggaagaacuucgacgagaagcucgucgagcacuucugcgccgaguucaagaccaaguacaagcuggacgccaaguccaagauccgggcgcugcuccgccuguaccaggagugcgagaagcugaagaagcucaugagcuccaacagcaccgaccugccccugaacaucgagugcuucaugaacgacaaggacgugagcggcaagaugaaccggucccaguucgaggagcucugcgccgagcugcugcagaagaucgaggugccgcucuacagccugcuggagcagacgcaccucaaggucgaggacguguccgccgucgagaucgugggcggggccacccgcauccccgccgugaaggagcggaucgcgaaguucuucggcaaggacaucagcaccacccugaacgccgacgaggccgucgcccgcgggugcgcccugcagugcgcgauccucucccccgccuucaaggugcgggaguucagcgugacggacgccguccccuucccgaucucccugaucuggaaccacgacagcgaggacaccgagggcgugcacgagguguucucccgcaaccacgccgcgcccuucagcaagguccugaccuuccuccggcgcgggcccuucgagcuggaggccuucuacuccgacccccagggcgugccguaccccgaggccaagaucggccgguucgugguccagaacgugagcgcccagaaggacggggagaagucccgcgugaaggucaaggugcgggugaacacccacggcaucuucacgaucagcaccgccuccauggucgagaaggugcccaccgaggagaacgagaugagcuccgaggcggacauggagugccugaaccagcggcccccggagaaccccgacaccgacaagaacgugcagcaggacaacagcgaggccgggacgcagccccagguccagaccgacgcccagcagaccucccagagcccgcccagccccgagcucaccuccgaggagaacaagauccccgacgccgacaaggccaacgagaagaagguggaccagcccccggaggcgaagaagcccaagaucaagguggucaacguggagcugcccaucgaggccaaccugguguggcagcucggcaaggaccugcugaacauguacaucgagacggaggggaagaugaucaugcaggacaagcucgagaaggagcgcaacgacgccaagaacgccgucgaggaguacguguacgaguuccgcgacaagcugugcggcccguacgagaaguucaucugcgagcaggaccaccagaacuuccugcgccugcucaccgagaccgaggacuggcuguacgaggagggcgaggaccaggccaagcaggcguacguggacaagcuggaggagcucaugaagaucgggacccccgucaaggugcgguuccaggaggccgaggagcgccccaagauguucgaggagcugggccagcggcugcagcacuacgccaagaucgccgcggacuuccgcaacaaggacgagaaguacaaccacaucgacgagagcgagaugaagaagguggagaaguccgucaacgaggugauggaguggaugaacaacgugaugaacgcccaggccaagaagucccucgaccaggaccccgucgugcgggcccaggagaucaagacgaagaucaaggagcugaacaacacgugcgagccgguggucacccagcccaagcccaagaucgagagccccaagcuggagcgcaccccgaacgggcccaacaucgacaagaaggaggaggaccucgaggacaagaacaacuucggcgccgagccgccccaccagaacggggagugcuaccccaacgagaagaacagcgugaacauggaccuggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2753 - RNA, 3382 nt, Artificial Sequence
  mRNA product Design2 comprising derived and/or modified sequence from Homo sapiens__NP_006380.1 __HsHYOU1 (opt1)
ggggcgcugccuacggagguggcagccaucuccuucucggcaucaagcuuaccauggccgacaaggugcgccggcagcgcccccggcgccgggucugcugggcccugguggcggugcuccuggccgaccugcucgcccugagcgacacccuggccgucauguccguggaccucggcagcgaguccaugaagguggccaucgucaagccgggggugcccauggagaucgugcugaacaaggagagccgccggaagacccccgucaucgugacgcugaaggagaacgagcgcuucuucggcgacuccgcggccagcauggccaucaagaaccccaaggccacccuccgguacuuccagcaccuccuggggaagcaggcggacaacccgcacguggcccuguaccaggcccgcuuccccgagcacgagcugaccuucgacccccagcggcagaccguccacuuccagaucuccagccagcugcaguucucccccgaggaggugcucggcauggugcugaacuacagccgcucccuggccgaggacuucgccgagcagccgaucaaggacgcggucaucacggugcccguguucuucaaccaggccgagcggcgcgccguccuccaggccgcccggauggcggggcugaaggugcugcagcucaucaacgacaacaccgccaccgcccugagcuacggcguguuccgccggaaggacaucaacaccacggcccagaacaucauguucuacgacaugggcuccgggagcaccgucugcaccaucgugaccuaccagauggugaagacgaaggaggccggcaugcagccccagcugcagauccgcggggucggcuucgaccggacccucgggggccuggagauggagcugcgccuccgggagcgccuggcgggccuguucaacgagcagcgcaaggggcagcgggccaaggacgugcgcgagaacccccgggccauggccaagcuccugcgcgaggccaaccggcugaagaccguccucuccgcgaacgccgaccacauggcccagaucgagggccugauggacgacguggacuucaaggccaaggugacccgcgucgaguucgaggagcugugcgcggaccucuucgagcgggugccggggcccgugcagcaggcccugcagagcgccgagaugucccuggacgagaucgagcaggucauccucgugggcggcgccacgcgcgugccccggguccaggaggugcugcugaaggccguggggaaggaggagcucggcaagaacaucaacgcggacgaggccgccgccaugggggccgucuaccaggcggccgcccugagcaaggccuucaaggugaagcccuucgugguccgcgacgccgugguguacccgauccuggucgaguucacccgggagguggaggaggagcccggcauccacucccucaagcacaacaagcgcgugcuguucagccggauggggcccuacccccagcgcaaggucaucaccuucaaccgguacagccacgacuucaacuuccacaucaacuacggcgaccugggcuuccucgggccggaggaccugcgcguguucggcucccagaaccugaccacggugaagcugaagggggucggcgacagcuucaagaaguaccccgacuacgaguccaaggggaucaaggcgcacuucaaccucgacgagagcggcgugcugucccuggaccggguggagagcgucuucgagacccucguggaggacuccgccgaggaggagagcacccugaccaagcugggcaacacgaucuccagccucuucgggggcgggaccacccccgacgccaaggagaacggcaccgacacggugcaggaggaggaggagucccccgccgaggggagcaaggacgagccgggcgagcaggucgagcugaaggaggaggcggaggcccccguggaggacggcucccagccgccgccgcccgagcccaagggggacgccacccccgagggcgagaaggccaccgagaaggagaacggggacaagagcgaggcccagaagcccuccgagaaggcggaggccggccccgagggcguggcccccgcccccgagggggagaagaagcagaagcccgcccgcaagcggcgcauggucgaggagaucggcguggagcuggugguccucgaccugcccgaccugcccgaggacaagcucgcgcagagcgugcagaagcugcaggaccugacccuccgcgaccuggagaagcaggagcgggagaaggccgccaacucccuggaggccuucaucuucgagacgcaggacaagcucuaccagccggaguaccaggaggugagcaccgaggagcagcgcgaggagaucuccgggaagcugagcgccgcgagcaccuggcuggaggacgagggcgucggggccaccacggugaugcucaaggagaagcuggccgagcugcggaagcucugccagggccuguucuuccgcguggaggagcggaagaaguggcccgagcgccuguccgcccucgacaaccugcugaaccacagcuccauguuccucaagggcgcgcggcugauccccgagauggaccagaucuucaccgaggucgagaugaccacccuggagaaggugaucaacgagaccugggccuggaagaacgccacgcucgccgagcaggccaagcugcccgcgaccgagaagccggugcugcucagcaaggacaucgaggccaagaugauggcccuggaccgcgagguccaguaccugcucaacaaggccaaguucaccaagccccggccccgccccaaggacaagaacgggacccgggccgagccgccccugaacgcguccgccagcgaccagggcgagaaggugaucccgcccgccgggcagacggaggacgccgagcccaucuccgagcccgagaagguggagaccggcagcgagcccggggacaccgagccccuggagcucggcggcccgggggccgagcccgagcagaaggagcaguccaccggccagaagcgcccccugaagaacgacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2754 - RNA, 2581 nt, Artificial Sequence
  mRNA product Design2 comprising derived and/or modified sequence from Homo sapiens__NP_005339.3 __HsHSP90AA1 (opt1)
ggggcgcugccuacggagguggcagccaucuccuucucggcaucaagcuuaccaugcccgaggagacccagacccaggaccagcccauggaggaggaggagguggagacguucgccuuccaggccgagaucgcgcagcugaugagccucaucaucaacaccuucuacuccaacaaggagaucuuccugcgcgagcugaucagcaacuccagcgacgcccucgacaagauccgguacgagucccugaccgaccccagcaagcuggacuccggcaaggagcuccacaucaaccugauccccaacaagcaggaccgcacccugacgaucgucgacaccgggaucggcaugaccaaggccgaccucaucaacaaccuggggaccaucgccaagagcggcacgaaggccuucauggaggcgcugcaggccggggccgacaucuccaugaucggccaguucggcgugggguucuacagcgccuaccucguggcggagaaggucaccgugaucaccaagcacaacgacgacgagcaguacgccugggaguccagcgccggcggguccuucaccgugcggacggacaccggcgagcccauggggcgcggcaccaaggucauccugcaccugaaggaggaccagaccgaguaccucgaggagcggcgcaucaaggagaucgugaagaagcacagccaguucaucggcuacccgaucacgcuguucguggagaaggagcgggacaaggaggucuccgacgacgaggccgaggagaaggaggacaaggaggaggagaaggagaaggaggagaaggagagcgaggacaagcccgagaucgaggacgugggguccgacgaggaggaggagaagaaggacggcgacaagaagaagaagaagaagaucaaggagaaguacaucgaccaggaggagcugaacaagaccaagcccaucuggacccgcaaccccgacgacaucaccaacgaggaguacggggaguucuacaagagccucacgaacgacugggaggaccaccuggccgugaagcacuucuccgucgagggccagcuggaguuccgggcgcuccuguucgugccgcgccgggcccccuucgaccuguucgagaaccgcaagaagaagaacaacaucaagcucuacgugcggcgcgucuucaucauggacaacugcgaggagcugauccccgaguaccugaacuucauccggggcgugguggacagcgaggaccucccccugaacaucagccgcgagaugcugcagcaguccaagauccucaaggucauccggaagaaccuggugaagaagugccuggagcuguucaccgagcucgccgaggacaaggagaacuacaagaaguucuacgagcaguucagcaagaacaucaagcuggggauccacgaggacucccagaaccgcaagaagcucagcgagcugcugcgguacuacaccuccgccagcggcgacgagauggugucccucaaggacuacugcacccgcaugaaggagaaccagaagcacaucuacuacaucacgggggagaccaaggaccaggucgccaacagcgcguucguggagcggcugcgcaagcacggccuggaggugaucuacaugaucgagccgaucgacgaguacugcguccagcagcucaaggaguucgaggggaagacccugguguccgucaccaaggagggccuggagcuccccgaggacgaggaggagaagaagaagcaggaggagaagaagacgaaguucgagaaccugugcaagaucaugaaggacauccuggagaagaagguggagaagguggucgugagcaaccgccucgugaccucccccugcugcaucgucaccagcaccuacggcuggacggccaacauggagcggaucaugaaggcccaggcccugcgcgacaacuccaccaugggguacauggccgcgaagaagcaccuggagaucaaccccgaccacagcaucaucgagacccugcggcagaaggccgaggccgacaagaacgacaaguccgugaaggaccucgugauccugcuguacgagaccgcccuccugagcuccggcuucagccuggaggacccgcagacgcacgccaaccgcaucuaccggaugaucaagcucgggcugggcaucgacgaggacgaccccaccgcggacgacaccuccgccgccgucaccgaggagaugccgccccuggagggggacgacgacaccagccgcauggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2755 - RNA, 721 nt, Artificial Sequence
  mRNA product Design2 comprising derived and/or modified sequence from Homo sapiens__NG_005218__HsHSP90AA3P (opt1)
ggggcgcugccuacggagguggcagccaucuccuucucggcaucaagcuuaccauggacagcuccaagcuggacagcggcaaggggcuccacaucaaccuggugcccaacaagcagaaccagacccugaccaucgucgacacgcgcaucggcaugaccaagaccgaccucaucaacaaccuggggaccgugacgaaguccggcaccaaggccuucauggaggcccugcaggcggacgccgacaucagcaugaucgggcacuucggcgugggcuucuacuccgccuaccucgucgccaagaaggugaccgugaucagcaagcacaacaacgacgagcaguacaccugggaguccagcgccgggggcuccuucacgguccggaccgacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2756 - RNA, 2557 nt, Artificial Sequence
  mRNA product Design2 comprising derived and/or modified sequence from Homo sapiens__NP_031381.2__HsHSP90AB1 (opt1)
ggggcgcugccuacggagguggcagccaucuccuucucggcaucaagcuuaccaugcccgaggaggugcaccacggcgaggaggaggucgagaccuucgccuuccaggccgagaucgcgcagcugaugagccucaucaucaacaccuucuacuccaacaaggagaucuuccugcgcgagcugaucagcaacgccuccgacgcccucgacaagauccgguacgagagccugacggacccguccaagcuggacagcgggaaggagcucaagaucgacaucauccccaacccccaggagcgcacccugacccugguggacaccggcaucgggaugacgaaggccgaccucaucaacaaccugggcaccaucgccaaguccgggaccaaggcguucauggaggcccugcaggccggcgccgacaucagcaugaucggccaguucggggugggcuucuacuccgcguaccucgucgccgagaaggugguggucaucaccaagcacaacgacgacgagcaguacgccugggagagcuccgccgggggcagcuucacggugcgggccgaccacggggagcccaucggccgcggcaccaaggugauccugcaccugaaggaggaccagaccgaguaccucgaggagcggcgcgucaaggagguggugaagaagcacucccaguucaucggguacccgaucacccuguaccuggagaaggagcgggagaaggagaucagcgacgacgaggcggaggaggagaagggcgagaaggaggaggaggacaaggacgacgaggagaagcccaagaucgaggacgucggguccgacgaggaggacgacagcggcaaggacaagaagaagaagacgaagaagaucaaggagaaguacaucgaccaggaggagcucaacaagaccaagcccaucuggacccgcaaccccgacgacaucacccaggaggaguacggcgaguucuacaagucccugacgaacgacugggaggaccaccuggccgugaagcacuucagcguggaggggcagcucgaguuccgggcccugcuguucaucccgcgccgggcccccuucgaccucuucgagaacaagaagaagaagaacaacaucaagcuguacguccgccggguguucaucauggacuccugcgacgagcugauccccgaguaccucaacuucauccgcggcguggucgacagcgaggaccugccccugaacaucagccgggagaugcuccagcaguccaagauccugaaggugauccgcaagaacaucgugaagaagugccuggagcuguucagcgagcucgccgaggacaaggagaacuacaagaaguucuacgaggcguucuccaagaaccugaagcucgggauccacgaggacagcaccaaccggcgccggcuguccgagcugcuccgcuaccacaccagccaguccggcgacgagaugaccagccuguccgaguacgucagccggaugaaggagacgcagaaguccaucuacuacaucaccggggagagcaaggagcaggucgccaacuccgccuucguggagcgcgugcgcaagcggggcuucgagguggucuacaugaccgagccgaucgacgaguacugcgugcagcagcugaaggaguucgacggcaagagccucguguccgucaccaaggaggggcuggagcugcccgaggacgaggaggagaagaagaagauggaggagagcaaggccaaguucgagaaccucugcaagcugaugaaggagauccuggacaagaagguggagaaggugacgaucuccaaccgccucgucagcucccccugcugcaucgugaccagcaccuacggcuggaccgccaacauggagcggaucaugaaggcgcaggcccugcgcgacaacagcacgaugggguacaugauggccaagaagcaccuggagaucaaccccgaccacccgaucguggagacccugcggcagaaggccgaggccgacaagaacgacaaggcggucaaggaccucguggugcugcuguucgagaccgcccuccuguccagcggcuucucccuggaggacccccagacccacagcaaccgcaucuaccggaugaucaagcucgggcugggcaucgacgaggacgaggucgccgccgaggagcccaacgcggccgugcccgacgagaucccgccccuggagggcgacgaggacgccucccgcauggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2757 - RNA, 2794 nt, Artificial Sequence
  mRNA product Design2 comprising derived and/or modified sequence from Homo sapiens__NP_003290.1__HsHSP90B1 (opt1)
ggggcgcugccuacggagguggcagccaucuccuucucggcaucaagcuuaccaugcgcgcccugugggugcucggccugugcugcguccugcucaccuucgggagcgugcgggccgacgacgagguggacgucgacggcaccguggaggaggaccuggggaagucccgcgagggcagccggacggacgacgaggugguccagcgcgaggaggaggcgauccagcuggacgggcucaacgccucccagauccgggagcugcgcgagaaguccgagaaguucgccuuccaggccgaggugaaccggaugaugaagcugaucaucaacagccucuacaagaacaaggagaucuuccugcgcgagcugaucagcaacgccuccgacgcgcucgacaagauccggcugaucagccugaccgacgagaacgcccucuccggcaacgaggagcugaccgugaagaucaagugcgacaaggagaagaaccugcuccacgucaccgacacgggcguggggaugacccgcgaggagcuggugaagaaccugggcaccaucgccaagagcgggaccuccgaguuccucaacaagaugacggaggcccaggaggacggccagagcaccuccgagcugaucgggcaguucggcgucggcuucuacagcgcguuccugguggccgacaaggugaucgucaccuccaagcacaacaacgacacccagcacaucugggagagcgacuccaacgaguucagcgugaucgccgacccccgggggaacacgcucggccgcgggaccaccaucacccuggugcugaaggaggaggccuccgacuaccucgagcuggacacgaucaagaaccuggucaagaaguacagccaguucaucaacuucccgaucuacguguggagcuccaagaccgagaccguggaggagcccauggaggaggaggaggccgcgaaggaggagaaggaggagagcgacgacgaggccgccgucgaggaggaggaggaggagaagaagcccaagaccaagaagguggagaagacggugugggacugggagcucaugaacgacaucaagcccaucuggcagcggccguccaaggaggucgaggaggacgaguacaaggccuucuacaagagcuucuccaaggagagcgacgaccccauggccuacauccacuucaccgcggagggcgaggugaccuucaaguccauccuguucguccccaccagcgcgccccgcggccuguucgacgaguacggguccaagaaguccgacuacaucaagcucuacgugcggcgcguguucaucacggacgacuuccacgacaugaugccgaaguaccugaacuucgucaagggcgugguggacagcgacgaccugccccucaacgucagccgggagacccugcagcagcacaagcugcucaaggugauccgcaagaagcuggugcggaagacccuggacaugaucaagaagaucgccgacgacaaguacaacgacaccuucuggaaggaguucgggacgaacaucaagcucggcgucaucgaggaccacuccaaccgcacccggcuggccaagcugcuccgcuuccagagcucccaccaccccaccgacaucaccagccuggaccaguacguggagcgcaugaaggagaagcaggacaagaucuacuucauggccggguccagccggaaggaggccgaguccagccccuucguggagcgccugcucaagaagggcuacgaggucaucuaccugacggagccgguggacgaguacugcauccaggcccugcccgaguucgacggcaagcgguuccagaacguggccaaggagggggucaaguucgacgagagcgagaagaccaaggagucccgcgaggccguggagaaggaguucgagccccugcucaacuggaugaaggacaaggcccugaaggacaagaucgagaaggcgguggucagccagcggcugaccgagucccccugcgcccucguggccagccaguacggcugguccgggaacauggagcgcaucaugaaggcccaggcguaccagaccggcaaggacaucagcacgaacuacuacgccucccagaagaagaccuucgagaucaacccgcggcacccccugauccgcgacaugcugcggcgcaucaaggaggacgaggacgacaagaccgugcucgaccuggccgucgugcuguucgagaccgccacccuccggagcggguaccugcugcccgacacgaaggccuacggcgaccgcaucgagcggaugcuccgccugucccugaacaucgaccccgacgcgaagguggaggaggagccggaggaggagcccgaggagaccgccgaggacaccaccgaggacacggagcaggacgaggacgaggagauggacgucggcaccgacgaggaggaggagaccgccaaggagagcaccgccgagaaggacgagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2758 - RNA, 2497 nt, Artificial Sequence
  mRNA product Design2 comprising derived and/or modified sequence from Homo sapiens__NP_057376.2__HsTRAP1 (opt1)
ggggcgcugccuacggagguggcagccaucuccuucucggcaucaagcuuaccauggcccgcgagcugcgggcccuccugcuguggggccgccggcuccgcccccugcugcgggcgccggcccucgccgccgugcccgggggcaagcccauccugugcccccgccggaccaccgcccagcuggggccgcgccggaaccccgcguggagccuccaggccggccgccuguucuccacgcagaccgccgaggacaaggaggagccccugcacagcaucaucuccagcaccgaguccguccaggggagcaccuccaagcacgaguuccaggccgagacgaagaagcuccuggacaucguggcgcggagccuguacuccgagaaggagguguucauccgcgagcucaucagcaacgccuccgacgcccuggagaagcugcggcacaagcucgucagcgacggccaggcccugcccgagauggagauccaccuccagaccaacgccgagaagggcaccaucaccauccaggacacggggaucggcaugacccaggaggagcugguguccaaccuggggaccaucgcgcgcagcggcuccaaggccuuccuggacgcccuccagaaccaggccgaggccagcuccaagaucaucgggcaguucggcgugggcuucuacagcgcguucauggucgccgaccggguggagguguacucccgcagcgccgccccggggagccugggcuaccaguggcuguccgacgggagcggcgucuucgagaucgccgaggcguccggcgugcggaccgggacgaagaucaucauccaccucaagagcgacugcaaggaguucuccagcgaggcccgcgugcgggacgucgugaccaaguacuccaacuucgugagcuucccccuguaccugaacggccgccggaugaacacccuccaggccaucuggaugauggaccccaaggacguccgcgaguggcagcacgaggaguucuaccgcuacguggcccaggcccacgacaagccccgguacacccugcacuacaagacggacgcgccgcugaacauccgcuccaucuucuacgugcccgacaugaagcccagcauguucgacgucucccgggagcucgggagcuccguggcccuguacagccgcaaggugcugauccagaccaaggccaccgacauccuccccaaguggcugcgguucauccgcggcgucguggacuccgaggacaucccgcugaaccucagccgggagcugcugcaggaguccgcccucauccgcaagcugcgggacgugcugcagcagcgccucaucaaguucuucaucgaccagagcaagaaggacgcggagaaguacgccaaguucuucgaggacuacgggcuguucaugcgggagggcaucgucaccgccacggagcaggaggugaaggaggacaucgccaagcugcuccgcuacgaguccagcgcccugcccagcggccagcugaccucccugagcgaguacgcgucccggaugcgcgccgggacccggaacaucuacuaccucugcgcccccaaccgccaccuggccgagcacagccccuacuacgaggccaugaagaagaaggacaccgagguccuguucugcuucgagcaguucgacgagcucacgcugcugcaccuccgggaguucgacaagaagaagcugaucuccguggagaccgacaucguggucgaccacuacaaggaggagaaguucgaggaccgcagcccggcggccgagugccuguccgagaaggagaccgaggagcucauggccuggaugcggaacgugcugggcagccgcgugaccaacgucaaggugacgcugcgccucgacacccaccccgccauggugaccguccuggagaugggggccgcgcggcacuuccugcgcaugcagcagcucgccaagacccaggaggagcgggcccagcugcugcagcccacgcucgagaucaacccccgccacgcccugaucaagaagcugaaccagcuccgggcguccgagccgggccuggcccagcugcucguggaccagaucuacgagaacgccaugaucgccgccgggcugguggacgacccccgcgcgauggucggccggcugaacgagcuccuggugaaggcccuggagcgccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2759 - RNA, 844 nt, Artificial Sequence
  mRNA product Design2 comprising derived and/or modified sequence from Homo sapiens__NP_000609.1__HsIGF1 (opt1)
ggggcgcugccuacggagguggcagccaucuccuucucggcaucaagcuuaccaugggcaagaucagcucccugcccacccagcuguucaagugcugcuucugcgacuuccucaaggugaagaugcacaccaugagcuccagccaccuguucuaccucgcccugugccugcucacguucaccuccagcgccaccgcggggccggagacccugugcggcgccgagcuggucgacgcccuccaguucgugugcggggaccgcggcuucuacuucaacaagcccacgggguacggcuccagcucccggcgcgcgccccagaccggcaucguggacgagugcugcuuccggagcugcgaccugcgccggcuggagauguacugcgcgccccucaagccggccaaguccgcccgcagcguccgggcccagcgccacaccgacaugcccaagacccagaaggaggugcaccugaagaacgccucccgggggagcgccggcaacaagaacuaccgcaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2760 - RNA, 925 nt, Artificial Sequence
  mRNA product Design2 comprising derived and/or modified sequence from Homo sapiens__NP_000603.1__HsIGF2 (opt1)
ggggcgcugccuacggagguggcagccaucuccuucucggcaucaagcuuaccaugggcauccccauggggaaguccaugcuggugcuccugaccuuccuggccuucgccagcugcugcaucgcggccuaccgcccgagcgagacccucugcggcggggagcuggucgacacgcugcaguucgugugcggcgaccggggguucuacuucucccgccccgccagccgggugucccgccggagccgcggcaucgucgaggagugcugcuuccgguccugcgaccucgcccugcuggagaccuacugcgccacccccgccaagagcgagcgcgacguguccacgcccccgaccgugcuccccgacaacuucccccgguaccccgucggcaaguucuuccaguacgacaccuggaagcagagcacccagcgccugcggcgcgggcugccggcgcuccugcgggcccgccggggccacgugcuggccaaggagcucgaggcguuccgcgaggccaagcggcaccgcccccugaucgcccugcccacccaggaccccgcccacgggggcgccccgcccgagauggcguccaaccggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2761 - RNA, 1021 nt, Artificial Sequence
  mRNA product Design2 comprising derived and/or modified sequence from Homo sapiens__NP_000591.1__HsIL6 (opt1)
ggggcgcugccuacggagguggcagccaucuccuucucggcaucaagcuuaccaugaacagcuucuccaccagcgccuucggccccguggccuucucccuggggcuccugcugguccucccggcggccuuccccgcccccgugcccccgggcgaggacagcaaggacguggccgcgccccaccgccagccccugaccuccagcgagcggaucgacaagcagauccgcuacauccuggacgggaucuccgcccuccggaaggagacgugcaacaagagcaacaugugcgaguccagcaaggaggcccuggccgagaacaaccugaaccuccccaagauggccgagaaggacggcugcuuccaguccggguucaacgaggagaccugccuggucaagaucaucaccggccugcucgaguucgagguguaccuggaguaccugcagaaccgcuucgagagcuccgaggagcaggcgcgggccgugcagaugagcaccaagguccucauccaguuccugcagaagaaggccaagaaccuggacgccaucacgaccccggaccccaccaccaacgccucccuccugacgaagcugcaggcgcagaaccaguggcuccaggacaugaccacccaccugauccugcgcagcuucaaggaguuccuccaguccagccugcgggcccugcgccagaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2762 - RNA, 1663 nt, Artificial Sequence
  mRNA product Design2 comprising derived and/or modified sequence from Homo sapiens__NP_002183.1__HsINHBA (opt1)
ggggcgcugccuacggagguggcagccaucuccuucucggcaucaagcuuaccaugccccugcucuggcugcgcggcuuccugcucgccagcugcuggaucaucgugcgguccagcccgacccccggguccgagggccacagcgccgcgcccgacugccccuccugcgcccuggccgcccugccgaaggacguccccaacagccagcccgagaugguggaggccgugaagaagcacauccucaacaugcugcaccugaagaagcgccccgacgucacccagccggugcccaaggcggcccuccugaacgccauccggaagcugcacguggggaaggucggcgagaacggguacguggagaucgaggacgacaucggccgccgggccgagaugaacgagcucauggagcagacguccgagaucaucaccuucgcggagagcggcaccgcccgcaagacccugcacuucgagaucuccaaggaggggagcgaccuguccguggucgagcgggccgagguguggcuguuccucaaggugcccaaggccaaccgcacgcggaccaaggucaccauccgccuguuccagcagcagaagcacccccagggcagccucgacaccggggaggaggccgaggaggugggccugaagggggagcgguccgagcugcuccugagcgagaagguggucgacgcgcgcaaguccacguggcacguguucccggugagcuccagcauccagcggcugcucgaccagggcaaguccagccuggacguccgcaucgccugcgagcagugccaggagagcggcgccucccuggugcuccuggggaagaagaagaagaaggaggaggagggcgaggggaagaagaagggcggcggggagggcggggccggcgccgacgaggagaaggagcagagccaccggcccuuccugaugcuccaggcgcgccaguccgaggaccacccccaccggcgccggcgccgggggcuggagugcgacggcaaggugaacaucugcugcaagaagcaguucuucgucagcuucaaggacaucggcuggaacgacuggaucaucgcccccuccggguaccacgccaacuacugcgagggcgagugcccgagccacaucgccgggaccuccggcagcucccugagcuuccacuccaccgugaucaaccacuaccgcaugcgcgggcacagccccuucgccaaccucaaguccugcugcgugcccaccaagcugcggcccaugagcaugcuguacuacgacgacggccagaacaucaucaagaaggacauccagaacaugaucgucgaggagugcggcugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2763 - RNA, 1606 nt, Artificial Sequence
  mRNA product Design2 comprising derived and/or modified sequence from Homo sapiens__NP_002184.2__HsINHBB (opt1)
ggggcgcugccuacggagguggcagccaucuccuucucggcaucaagcuuaccauggacggccugcccgggcgcgcccucggcgccgcgugccugcugcuccuggccgccggguggcugggcccggaggccugggggagccccaccccgcccccgacccccgccgcgcccccgcccccgcccccgcccggcucccccggcgggagccaggacacgugcaccuccugcggcggguuccggcgccccgaggagcucggccggguggacggggacuuccuggaggccgucaagcgccacauccugagccggcuccagaugcgcggccggcccaacaucacccacgccgugcccaaggccgcgauggugaccgcccugcgcaagcugcacgccggcaagguccgggaggacgggcgcguggagaucccccaccucgacggccacgccucccccggggccgacggccaggagcgggugagcgagaucaucuccuucgcggagacggacggccuggccagcucccgcguccggcuguacuucuucaucagcaacgaggggaaccagaaccucuucguggugcaggccucccuguggcuguaccucaagcugcugcccuacguccucgagaagggcagccgccggaaggugcgcgugaaggucuacuuccaggagcaggggcacggcgaccgguggaacaugguggagaagcgcguggaccugaagcgguccggguggcacaccuucccccugaccgaggccauccaggcccucuucgagcgcggcgagcggcgccugaaccuggacguccagugcgacagcugccaggagcucgcgguggugcccgucuucguggaccccggcgaggagucccaccgccccuucguggucgugcaggcccggcugggggacagccgccaccggauccgcaagcggggccuggagugcgacgggcgcaccaaccucugcugccggcagcaguucuucaucgacuuccgccugaucggcuggaacgacuggaucaucgccccgacgggguacuacggcaacuacugcgagggcuccugccccgccuaccuggccggggugcccggcagcgcguccagcuuccacaccgccgucgugaaccaguaccggaugcgcgggcucaaccccggcaccgucaacagcugcugcaucccgaccaagcuguccacgaugagcaugcuguacuucgacgacgaguacaacaucgugaagcgggacgugcccaacaugaucgucgaggagugcgggugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2764 - RNA, 3841 nt, Artificial Sequence
  mRNA product Design2 comprising derived and/or modified sequence from Homo sapiens__NP_000623.2__HsITGAM (opt1)
ggggcgcugccuacggagguggcagccaucuccuucucggcaucaagcuuaccauggcccugcgcgugcuccugcugaccgcccucacccugugccacggcuucaaccuggacacggagaacgcgaugaccuuccaggagaacgcccggggguucggccagagcgucgugcagcuccaggggucccgcguggucgugggcgccccccaggagaucguggccgccaaccagcgggggagccuguaccagugcgacuacuccaccggcagcugcgagccgauccgccugcagguccccguggaggcggugaacaugucccucggccugagccuggccgccaccacgucccccccccagcuccuggccugcgggccgaccguccaccagaccugcagcgagaacaccuacgugaagggccugugcuuccucuucggguccaaccugcggcagcagccccagaaguuccccgaggcgcugcgcggcugcccccaggaggacagcgacaucgccuuccucaucgacggguccggcagcaucaucccgcacgacuuccggcgcaugaaggaguucguguccacggucauggagcagcugaagaaguccaagacccuguucucccucaugcaguacagcgaggaguuccggauccacuucaccuucaaggaguuccagaacaaccccaacccccgcucccuggugaagcccaucacccagcugcucggccggacgcacaccgccaccgggauccgcaaggugguccgggagcuguucaacaucaccaacggcgcccgcaagaacgccuucaagauccugguggugaucacggacggggagaaguucggcgacccgcucggcuacgaggacgucauccccgaggcggaccgggagggggugauccgcuacgugaucggcgucggggacgccuuccggagcgagaagucccgccaggagcugaacaccaucgccagcaagcccccccgggaccacguguuccaggugaacaacuucgaggcccugaagaccauccagaaccagcuccgcgagaagaucuucgccaucgagggcacccagacggggagcuccagcuccuucgagcacgagaugagccaggagggcuucuccgcggccaucaccagcaacggcccgcugcuguccaccgucgggagcuacgacugggccggcgggguguuccucuacaccuccaaggagaaguccacguucaucaacaugacccgggucgacuccgacaugaacgacgccuaccugggcuacgccgcggccaucauccugcgcaaccgcgugcagagccucgugcugggggccccccgguaccagcacaucggccuggucgccauguuccgccagaacaccggcaugugggaguccaacgccaacgugaaggggacccagaucggcgcguacuucggggccagccucugcuccguggacgucgacagcaacggcuccacggaccuggugcugaucggggccccccacuacuacgagcagacccggggcggccaggugagcgucugcccccucccgcgcgggcgggcccgcuggcagugcgacgcggugcuguacggcgagcaggggcagcccuggggccgguucggcgccgcccugaccgugcucggggacgucaacggcgacaagcugaccgacguggccaucggggcccccggcgaggaggacaaccgcggggcgguguaccuguuccacggcacguccggcagcgggaucagccccucccacagccagcggaucgccggcuccaagcucagcccgcgccugcaguacuucgggcagucccugagcggcgggcaggaccugaccauggacggccucgucgaccugaccgugggcgcccaggggcacgugcugcuccugcggucccagcccguccugcgcgugaaggccaucauggaguucaacccccgggagguggcccgcaacgucuucgagugcaacgaccagguggugaagggcaaggaggcgggggagguccgggugugccuccacgugcagaaguccacccgcgaccggcugcgcgagggccagauccaguccgucgugacguacgaccuggcccucgacagcgggcggccccacucccgcgccguguucaacgagaccaagaacagcacccgccggcagacccagguccugggccugacccagacgugcgagacccucaagcugcagcugccgaacugcaucgaggaccccgugucccccaucgugcuccgccugaacuucagccuggucggcaccccgcucuccgccuucgggaaccugcggcccgugcuggccgaggacgcgcagcgccucuucaccgcccuguuccccuucgagaagaacugcggcaacgacaacaucugccaggacgaccugagcaucacguucuccuucaugagccucgacugccugguggucgggggcccccgggaguucaacgugaccgugaccguccgcaacgacggggaggacagcuaccggacccaggugacguucuucuucccgcuggaccucuccuaccgcaaggugagcacccugcagaaccagcggucccagcgcagcuggcggcuggccugcgaguccgccagcuccaccgaggucagcggcgcgcucaaguccaccagcugcuccaucaaccaccccaucuuccccgagaacagcgaggugacguucaacaucaccuucgacguggacuccaaggccagccugggcaacaagcugcuccugaaggccaacgucaccuccgagaacaacaugccccgcaccaacaagacggaguuccagcuggagcucccggugaaguacgccguguacauggucgugaccagccacgggguguccaccaaguaccugaacuucaccgccagcgagaacacgucccgggucaugcagcaccaguaccaggugagcaaccugggccagcgcagccuccccaucucccuggucuuccuggugcccgugcggcucaaccagaccgucaucugggaccgcccccaggugaccuucagcgagaaccuguccagcacaugccacacgaaggagcggcugccgucccacagcgacuuccucgcggagcugcgcaaggcccccguggucaacugcuccaucgccgugugccagcggauccagugcgacauccccuucuucgggauccaggaggaguucaacgccacccugaagggcaaccucagcuucgacugguacaucaagaccucccacaaccaccuccugaucgugagcaccgccgagauccucuucaacgacuccgucuucacgcugcugcccggccagggggcguucgugcgcagccagaccgagaccaagguggagccguucgagguccccaacccccucccccugaucgugggcuccagcguggggggccugcuccugcuggcccucaucaccgccgcccuguacaagcugggguucuucaagcggcaguacaaggacaugauguccgagggcggcccgcccggggccgagccccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2765 - RNA, 1786 nt, Artificial Sequence
  mRNA product Design2 comprising derived and/or modified sequence from Homo sapiens__NP_002415.1__HsMMP8 (opt1)
ggggcgcugccuacggagguggcagccaucuccuucucggcaucaagcuuaccauguucagccugaagacccuccccuuccugcugcuccugcacgugcagaucuccaaggccuucccggucagcuccaaggagaagaacaccaagacggugcaggacuaccuggagaaguucuaccagcuccccagcaaccaguaccaguccacccgcaagaacggcaccaacgugaucgucgagaagcugaaggagaugcagcgguucuucgggcugaacgugaccggcaagcccaacgaggagacgcucgacaugaugaagaagccccgcugcggggugccggacagcggcggguucaugcugacccccggcaaccccaagugggagcggaccaaccugaccuaccgcauccggaacuacacgccccagcucuccgaggccgaggucgagcgcgcgaucaaggacgccuucgagcuguggagcguggccuccccgcugaucuucacccggaucagccagggcgaggccgacaucaacaucgccuucuaccagcgcgaccacggggacaacucccccuucgacggccccaacgggauccucgcgcacgccuuccagcccggccaggggaucggcggcgacgcccacuucgacgccgaggagaccuggaccaacacgagcgcgaacuacaaccuguuccugguggccgcccacgaguucgggcacucccucggccuggcccacagcuccgacccgggggcccugauguaccccaacuacgcguuccgggagaccagcaacuacucccucccccaggacgacaucgacggcauccaggccaucuacggccugagcuccaaccccauccagccgaccgggcccagcacccccaagcccugcgacccgagccugacguucgacgccaucaccacccuccgcggcgagauccuguucuucaaggaccgguacuucuggcgccggcacccccagcugcagcgcgucgagaugaacuucaucucccucuucuggcccagccugcccaccgggauccaggccgccuacgaggacuucgaccgggaccugaucuuccucuucaagggcaaccaguacugggcgcuguccggguacgacauccugcagggcuacccgaaggacaucagcaacuacggcuuccccuccagcgugcaggccaucgacgccgccguguucuaccgcuccaagacguacuucuucgucaacgaccaguucuggcgguacgacaaccagcgccaguucauggagcccggguaccccaagagcaucuccggcgccuucccggggaucgagagcaagguggacgcgguguuccagcaggagcacuucuuccacgucuucuccggcccccgguacuacgccuucgaccucaucgcccagcgcgugacccggguggcccgcgggaacaaguggcugaacugccgcuacggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2766 - RNA, 2506 nt, Artificial Sequence
  mRNA product Design2 comprising derived and/or modified sequence from Homo sapiens__NP_004985.2__HsMMP9 (opt1)
ggggcgcugccuacggagguggcagccaucuccuucucggcaucaagcuuaccaugagccuguggcagccccucgugcugguccugcucgugcugggcugcugcuucgccgccccgcgccagcggcaguccacccugguccucuuccccggggaccugcgcaccaaccugacggaccggcagcucgcggaggaguaccuguaccgcuacggcuacacccggguggccgagaugcgcggggagagcaagucccugggccccgcccuccugcugcuccagaagcagcugagccugcccgagaccggggagcucgacuccgccacccugaaggccaugcggacgccgcgcugcggcgugcccgaccugggccgguuccagaccuucgagggggaccucaaguggcaccaccacaacaucaccuacuggauccagaacuacagcgaggaccugccccgcgcggugaucgacgacgccuucgcccgggccuucgcgcugugguccgccgucacgccccucaccuucacccgcguguacagccgggacgccgacaucgugauccaguucggcgucgccgagcacggggacggcuacccguucgacgggaaggacggccugcuggcccacgcguucccgcccggccccgggauccagggcgacgcccacuucgacgacgacgagcucuggucccuggggaagggcguggugguccccacccgcuucggcaacgccgacggggccgccugccacuuccccuucaucuucgagggccggagcuacuccgcgugcaccacggacgggcgcagcgacggccugcccuggugcuccaccaccgccaacuacgacaccgacgaccgguucggguucugccccagcgagcgccucuacacgcaggacggcaacgccgacggcaagccgugccaguuccccuucaucuuccaggggcaguccuacagcgccugcaccaccgacggccgguccgacggguaccgcuggugcgccaccacggcgaacuacgaccgggacaagcuguucggcuucugccccacccgcgccgacagcaccgugaugggcggcaacuccgccggcgagcugugcguguuccccuucaccuuccucgggaaggaguacagcacgugcaccagcgagggccgcggggacggccggcuguggugcgccaccaccuccaacuucgacagcgacaagaaguggggguucugcccggaccagggcuacucccuguuccucgucgccgcgcacgaguucggccacgcccuggggcuggaccacagcuccgugcccgaggcccucauguaccccauguaccgcuucacggaggggcccccgcugcacaaggacgacgugaacgggauccggcaccuguacggcccccgccccgagcccgagccgcggccgcccaccaccaccacgccccagcccaccgccccgcccaccgucugccccaccggcccgcccacggugcaccccagcgagcgccccaccgcggggcccaccggcccgcccuccgccgggcccaccggcccgcccaccgccgggcccagcacggccaccaccgugccccucucccccgucgacgacgccugcaacgugaacaucuucgacgcgaucgccgagaucggcaaccagcuguaccuguucaaggacggcaaguacuggcgguucagcgaggggcgcggcucccggccccaggggcccuuccucaucgccgacaaguggccggcccugccccgcaagcuggacagcguguucgaggagcggcucuccaagaagcuguucuucuucagcggccgccaggucuggguguacaccggggccuccguccugggcccccggcgccuggacaagcucggccugggggcggacguggcccaggugacgggcgcccugcggagcgggcgcggcaagaugcuccuguucuccgggcggcgccuguggcgguucgacgucaaggcccagaugguggacccccgcagcgccuccgagguggaccgcauguucccgggcgucccccucgacacccacgacguguuccaguaccgggagaaggcguacuucugccaggaccgcuucuacuggcgggugagcagccgcuccgagcugaaccaggucgaccaggugggcuacgugaccuacgacauccugcagugccccgaggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2767 - RNA, 1798 nt, Artificial Sequence
  mRNA product Design2 comprising derived and/or modified sequence from Homo sapiens__NP_002418.1__HsMMP13 (opt1)
ggggcgcugccuacggagguggcagccaucuccuucucggcaucaagcuuaccaugcaccccggcgugcuggccgccuuccucuuccugagcuggacccacugccgcgcgcugccgcuccccuccgggggcgacgaggacgaccugagcgaggaggaccugcaguucgccgagcgguaccuccgcuccuacuaccaccccaccaaccuggccgggauccugaaggagaacgccgccagcuccaugacggagcggcuccgcgagaugcagagcuucuucggccuggaggucaccgggaagcuggacgacaacacccucgacgugaugaagaagccccggugcggcgugccggacgucggcgaguacaacguguucccccgcacccugaagugguccaagaugaaccugacguaccggaucgugaacuacacccccgacaugacccacagcgaggucgagaaggcguucaagaaggccuucaaggugugguccgacgugacgccccucaacuucacccgccugcacgacgggaucgccgacaucaugaucagcuucggcaucaaggagcacggggacuucuacccguucgacggccccuccgggcugcucgcccacgcguucccgcccggccccaacuacggcggggacgcccacuucgacgacgacgagaccuggaccagcuccagcaagggcuacaaccuguuccuggucgccgcccacgaguucgggcacucccucggccuggaccacagcaaggaccccggcgcccugauguuccccaucuacaccuacacggggaagucccacuucaugcuccccgacgacgacgugcagggcauccagagccuguacgggccgggcgacgaggaccccaaccccaagcaccccaagaccccggacaagugcgaccccucccugagccucgacgcgaucaccagccugcgcggggagaccaugaucuucaaggaccgguucuucuggcggcugcacccccagcaggucgacgccgagcuguuccugacgaaguccuucuggcccgagcugccgaaccgcaucgacgccgccuacgagcaccccagccacgaccucaucuucaucuuccggggccgcaaguucugggcccugaacggcuacgacauccuggagggguaccccaagaagaucuccgagcucggccugcccaaggaggugaagaagaucagcgcggccgugcacuucgaggacaccgggaagacccuccucuucuccggcaaccagguguggcgguacgacgacaccaaccacaucauggacaaggacuacccgcgccugaucgaggaggacuuccccgggaucggcgacaaggucgacgccguguacgagaagaacggcuacaucuacuucuucaacgggcccauccaguucgaguacagcaucugguccaaccggaucgugcgcgucaugccggccaacagcauccuguggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2768 - RNA, 1450 nt, Artificial Sequence
  mRNA product Design2 comprising derived and/or modified sequence from Homo sapiens__NP_001286.1__HsCCR1 (opt1)
ggggcgcugccuacggagguggcagccaucuccuucucggcaucaagcuuaccauggagacccccaacaccacggaggacuacgacaccaccaccgaguucgacuacggcgacgccacgccgugccagaaggugaacgagcgcgccuucggggcgcagcugcucccgccccuguacagccuggucuucgugaucggccucguggggaacauccuggucgugcuggugcucguccaguacaagcggcugaagaacaugaccuccaucuaccugcucaaccuggccaucagcgaccuccucuuccuguucacccugcccuucuggaucgacuacaagcucaaggacgacuggguguucggcgacgccaugugcaagauccuguccggguucuacuacaccggccuguacagcgagaucuucuucaucauccuccugacgaucgaccgcuaccuggccaucgugcacgccgucuucgcgcuccgggcccgcaccgugaccuucggcgugaucaccuccaucaucaucugggcccuggccauccuggcgagcaugcccgggcucuacuucuccaagacgcagugggaguucacccaccacacgugcagccugcacuucccccacgagucccugcgggaguggaagcuguuccaggcccugaagcugaaccucuucggccugguccugccccuccuggugaugaucaucugcuacaccgggaucaucaagauccugcuccgccggcccaacgagaagaaguccaaggccgugcgccugaucuucgucaucaugaucaucuucuuccuguucuggaccccguacaaccucaccauccugaucagcguguuccaggacuuccuguucacccacgagugcgagcagagccggcaccucgaccuggccgugcaggucaccgaggugaucgccuacacgcacugcugcgugaaccccgucaucuacgcguucgugggcgagcgcuuccggaaguaccugcgccagcuguuccaccggcgcguggccguccaccucgugaaguggcugcccuuccucuccgucgaccggcuggagcgcgugagcuccaccagccccuccaccggggagcacgagcugagcgccggcuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2769 - RNA, 1018 nt, Artificial Sequence
  mRNA product Design2 comprising derived and/or modified sequence from Homo sapiens__NP_002598.4__HsPDGFA (opt1)
ggggcgcugccuacggagguggcagccaucuccuucucggcaucaagcuuaccaugcgcacccuggccugccuccugcugcucggcugcggguaccuggcccacgugcuggcggaggaggccgagaucccccgggaggugaucgagcgccucgcccggagccagauccacuccauccgcgaccugcagcggcugcucgagaucgacagcgugggcuccgaggacagccuggacaccucccugcgcgcccacggggugcacgccacgaagcacgucccggagaagcggccccuccccauccgccggaagcgcagcaucgaggaggcggugcccgccgugugcaagacccggaccgucaucuacgagaucccgcgcucccagguggaccccaccagcgccaacuuccugaucuggccgcccugcguggaggucaagcggugcacgggcugcugcaacaccuccagcgugaagugccagcccucccgcgugcaccaccggagcgucaagguggccaagguggaguacguccgcaagaagcccaagcugaaggagguccaggugcggcucgaggagcaccuggagugcgcgugcgccaccaccucccugaaccccgacuaccgcgaggaggacacggggcggccccgcgagagcggcaagaagcggaagcgcaagcgccucaagccgaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2770 - RNA, 1108 nt, Artificial Sequence
  mRNA product Design2 comprising derived and/or modified sequence from Homo sapiens__NP_002599.1__HsPDGFB (opt1)
ggggcgcugccuacggagguggcagccaucuccuucucggcaucaagcuuaccaugaaccgcugcugggcccuguuccucagccugugcugcuaccugcggcucguguccgccgagggcgaccccaucccggaggagcuguacgagaugcugagcgaccacuccauccgcagcuucgacgaccuccagcggcugcugcacggggaccccggcgaggaggacggggcggagcucgaccugaacaugacccgcucccacagcggcggggagcuggagucccucgcccggggccgccggagccugggcucccugaccaucgccgagcccgccaugaucgccgagugcaagacgcgcaccgaggucuucgagaucagccggcgccucaucgaccggaccaacgcgaacuuccugguguggcccccgugcguggagguccagcgcugcuccgggugcugcaacaaccggaacgugcagugccgccccacccaggugcagcugcggcccguccaggugcgcaagaucgagaucgugcggaagaagcccaucuucaagaaggccacggucacccucgaggaccaccuggccugcaagugcgagaccguggccgcggcccgcccggugacccggagccccggcgggucccaggagcagcgcgccaagacgccccagacccgggucaccauccgcaccgugcgcgugcggcggcccccgaagggcaagcaccgcaaguucaagcacacgcacgacaagaccgcccugaaggagacccucggggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2771 - RNA, 1420 nt, Artificial Sequence
  mRNA product Design2 comprising derived and/or modified sequence from Homo sapiens__NP_057289.1__HsPDGFC (opt1)
ggggcgcugccuacggagguggcagccaucuccuucucggcaucaagcuuaccaugagccuguucggccuccugcugcucaccuccgcccuggccgggcagcgccagggcacccaggcggagagcaaccuguccagcaaguuccaguucuccagcaacaaggagcagaacggggugcaggacccccagcacgagcggaucaucacggucuccaccaacggcagcauccacuccccgcgcuucccccacaccuacccccggaacaccgugcucguguggcgccuggucgccguggaggagaacguguggauccagcugacguucgacgagcgguucgggcucgaggaccccgaggacgacaucugcaaguacgacuucgucgagguggaggagccgagcgacggcaccauccugggccgcuggugcggguccggcaccgugcccgggaagcagaucagcaagggcaaccagauccggauccgcuucgucuccgacgaguacuuccccagcgagcccggguucugcauccacuacaacaucgugaugccgcaguucaccgaggccgugucccccagcguccugccgcccuccgcccucccccuggaccugcucaacaacgccaucacggcguucagcacccuggaggaccugauccgguaccucgagcccgagcgcuggcagcuggaccuggaggaccucuaccggcccaccuggcagcugcugggcaaggccuucguguucggccgcaagucccggguggucgaccucaaccugcugaccgaggaggugcgccucuacagcugcacgccccggaacuucagcguguccauccgcgaggagcugaagcggaccgacaccaucuucuggccggggugccugcucgucaagcgcugcggcgggaacugcgccugcugccugcacaacugcaacgagugccagugcgugcccagcaaggugaccaagaaguaccacgagguccugcagcuccggcccaagacgggcgugcgcggccugcacaagucccugaccgacguggcccucgagcaccacgaggagugcgacugcgucugccgggggagcaccggcgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2772 - RNA, 1477 nt, Artificial Sequence
  mRNA product Design2 comprising derived and/or modified sequence from Homo sapiens__NP_149126.1__HsPDGFD (opt1)
ggggcgcugccuacggagguggcagccaucuccuucucggcaucaagcuuaccaugcaccgccugaucuucguguacacccucaucugcgccaacuucugcagcugccgggacaccuccgccacgccccagagcgcguccaucaaggcccugcgcaacgccaaccugcggcgcgacgaccucuaccggcgcgacgagaccauccaggucaagggcaacggguacgugcagagcccccgguuccccaacuccuacccccgcaaccugcugcucaccuggcggcugcacagccaggagaacacccgcauccagcugguguucgacaaccaguucggccucgaggaggccgagaacgacaucugccgguacgacuucgucgagguggaggacaucuccgagaccagcaccaucauccgcgggcgguggugcggccacaaggaggugcccccgcgcaucaagucccggaccaaccagaucaagaucaccuucaagagcgacgacuacuucgucgccaagcccggguucaagaucuacuacucccugcuggaggacuuccagcccgcggccgccagcgagacgaacugggaguccgugaccagcuccaucagcggcguguccuacaacagccccuccgucaccgacccgacccucaucgccgacgcgcuggacaagaagaucgccgaguucgacacgguggaggaccugcucaaguacuucaaccccgagagcuggcaggaggaccuggagaacauguaccuggacaccccgcgcuaccggggccgcagcuaccacgaccggaaguccaagguggaccucgaccgccugaacgacgacgccaagcgguacagcugcacgccccgcaacuacuccgucaacauccgcgaggagcugaagcucgccaacgugguguucuucccccggugccugcugguccagcgcugcgggggcaacugcgggugcggcaccgugaacuggcggagcugcacgugcaacuccgggaagaccgugaagaaguaccacgagguccuccaguucgagcccggccacaucaagcgccggggccgcgccaagaccauggcgcugguggacauccagcuggaccaccacgagcggugcgacugcaucugcagcucccgcccgccccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2773 - RNA, 1060 nt, Artificial Sequence
  mRNA product Design2 comprising derived and/or modified sequence from Homo sapiens__NP_003946.3__HsSOCS3 (opt1)
ggggcgcugccuacggagguggcagccaucuccuucucggcaucaagcuuaccauggugacccacagcaaguuccccgccgccggcaugucccgcccgcuggacaccagccuccggcugaagacguucuccagcaaguccgaguaccagcuggucgugaacgcggugcgcaagcuccaggagagcggguucuacugguccgccgucaccggcggggaggccaaccugcugcucagcgccgagcccgccggcaccuuccugauccgggacuccagcgaccagcgccacuucuucacccuguccgugaagacgcagagcgggaccaagaaccuccggauccagugcgagggcggcuccuucagccugcaguccgacccccgcagcacccagcccgugccgcgguucgacugcguccugaagcucgugcaccacuacaugcccccgcccggggcgcccuccuuccccagcccgcccaccgagcccuccagcgaggugcccgagcagcccagcgcccagccccugccgggcuccccgccccgccgggccuacuacaucuacagcgggggcgagaagaucccccugguccucucccgcccccugagcuccaacguggccacgcugcagcaccucugccggaagaccgugaacgggcaccuggacagcuacgagaaggucacccagcugcccggccccauccgcgaguuccucgaccaguacgacgcgccccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2774 - RNA, 865 nt, Artificial Sequence
  mRNA product Design2 comprising derived and/or modified sequence from Homo sapiens__NP_003227.1__HsTGFA (opt1)
ggggcgcugccuacggagguggcagccaucuccuucucggcaucaagcuuaccauggugcccagcgccggccagcuggcccucuucgcgcuggggaucguccuggccgccugccaggcccucgagaacuccaccagcccgcuguccgccgacccgcccguggcggccgccguggucagccacuucaacgacugccccgacucccacacccaguucugcuuccacggcacgugccgcuuccuggugcaggaggacaagcccgccugcgugugccacagcggguacgucggcgcgcggugcgagcacgccgaccuccuggccgugguggccgccucccagaagaagcaggcgaucaccgcccuggucguggugagcaucgucgcccucgccgugcugaucaucacgugcgugcugauccacugcugccagguccgcaagcacugcgaguggugccgggcccucaucugccgccacgagaagcccuccgcgcugcugaaggggcggaccgccugcugccacagcgagaccguggugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2775 - RNA, 1555 nt, Artificial Sequence
  mRNA product Design2 comprising derived and/or modified sequence from Homo sapiens__NP_000651.3__HsTGFB1 (opt1)
ggggcgcugccuacggagguggcagccaucuccuucucggcaucaagcuuaccaugcccccgagcggccugcgccuccugccccugcuccugccccugcucuggcugcuggugcucacccccgggcggccggccgccggccuguccacgugcaagaccaucgacauggagcuggucaagcgcaagcggaucgaggcgauccgcgggcagauccucagcaagcugcggcuggccuccccgcccagccagggcgaggugccgcccgggccccuccccgaggccgugcuggcccuguacaacuccacccgcgaccgggucgccggcgagagcgcggagcccgagcccgagcccgaggccgacuacuacgccaaggaggugacccgcgugcucauggucgagacccacaacgagaucuacgacaaguucaagcaguccacgcacagcaucuacauguucuucaacaccuccgagcugcgggaggccgugcccgagcccgugcugcucagccgcgcggagcugcggcugcuccgccugaagcugaaggucgagcagcacguggagcucuaccagaaguacuccaacaacagcuggcgguaccuguccaaccgccugcucgccccgagcgacucccccgaguggcugagcuucgacgugaccggcgucgugcggcaguggcugucccgcgggggcgagaucgagggguuccggcucagcgcccacugcuccugcgacagccgcgacaacacccuccagguggacaucaacggcuucacgaccgggcggcgcggcgaccuggccaccauccacggcaugaaccggcccuuccugcugcugauggccacgccccucgagcgcgcgcagcaccuccagagcucccgccaccggcgcgcccuggacaccaacuacugcuucagcuccaccgagaagaacugcugcguccggcagcuguacaucgacuuccgcaaggaccugggguggaaguggauccacgagccgaagggcuaccacgccaacuucugccuggggcccugccccuacaucuggagccucgacacccaguacuccaaggugcuggcccuguacaaccagcacaaccccggcgccagcgcggccccgugcugcgugccccaggcccucgagccccugcccaucgucuacuacgugggccggaagccgaagguggagcagcuguccaacaugaucguccgcagcugcaagugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2776 - RNA, 1627 nt, Artificial Sequence
  mRNA product Design2 comprising derived and/or modified sequence from Homo sapiens__NP_003229.1__HsTGFB2 (opt1)
ggggcgcugccuacggagguggcagccaucuccuucucggcaucaagcuuaccaugcacuacugcgugcugagcgccuuccucauccugcaccuggucaccguggcccucucccugagcacgugcuccacccuggacauggaccaguucaugcgcaagcggaucgaggcgauccgcggccagauccucagcaagcugaagcugaccagcccgcccgaggacuaccccgagcccgaggaggugcccccggaggucaucuccaucuacaacuccacccgggaccuccugcaggagaaggccagccgccgggccgccgccugcgagcgcgagcgguccgacgaggaguacuacgcgaaggagguguacaagaucgacaugccgcccuucuuccccagcgagaacgccaucccgcccaccuucuaccgccccuacuuccggaucgugcgcuucgacgucuccgccauggagaagaacgccagcaaccuggugaaggcggaguuccggguguuccgccuccagaaccccaaggcccggguccccgagcagcgcaucgagcuguaccagauccugaaguccaaggaccucacgagccccacccagcgguacaucgacuccaagguggugaagacccgcgccgagggggaguggcugagcuucgacgucaccgacgccgugcacgaguggcugcaccacaaggaccggaaccucggcuucaagaucucccugcacugccccugcugcacguucgugcccagcaacaacuacaucaucccgaacaaguccgaggagcuggaggcccgcuucgcggggaucgacggcaccagcaccuacaccagcggggaccagaagacgaucaaguccacccggaagaagaacagcggcaagacgccccaccuccugcugaugcuccugcccuccuaccgccuggagagccagcagaccaaccggcgcaagaagcgcgcccucgacgccgccuacugcuuccggaacguccaggacaacugcugccugcgcccccuguacaucgacuucaagcgggaccucggcuggaaguggauccacgagccgaagggguacaacgccaacuucugcgcgggcgccugccccuaccugugguccagcgacacccagcacucccgcgugcugagccucuacaacaccaucaaccccgaggccuccgccagccccugcugcgugucccaggaccuggagccgcugaccauccucuacuacaucgggaagacccccaagaucgagcagcugagcaacaugaucgucaaguccugcaagugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2777 - RNA, 1621 nt, Artificial Sequence
  mRNA product Design2 comprising derived and/or modified sequence from Homo sapiens__NP_003230.1__HsTGFB3 (opt1)
ggggcgcugccuacggagguggcagccaucuccuucucggcaucaagcuuaccaugaagaugcaccuccagcgcgcccucguggugcuggcccugcucaacuucgcgaccgugagccugucccugagcacgugcaccacccucgacuucggccacaucaagaagaagcggguggaggccauccgcgggcagauccuguccaagcugcggcucaccagcccgcccgagcccaccgucaugacgcacgugcccuaccaggugcuggcccuguacaacuccacccgcgagcuccuggaggagaugcacggcgagcgggaggaggggugcacccaggagaacaccgagagcgaguacuacgccaaggagauccacaaguucgacaugauccagggccuggccgagcacaacgagcucgcggucugccccaaggggaucacguccaagguguuccgcuucaacgugagcuccgucgagaagaaccggaccaaccuguuccgcgccgaguuccgggugcugcgcgugccgaaccccagcuccaagcggaacgagcagcgcaucgagcuguuccagauccugcggcccgacgagcacaucgccaagcagcgcuacaucggcggcaagaaccugcccacccgggggaccgccgaguggcucagcuucgacgucacggacaccgugcgcgaguggcugcugcggcgcgaguccaaccucggccuggagaucagcauccacugcccgugccacaccuuccagcccaacggggacauccuggagaacauccacgaggugauggagaucaaguucaagggcgucgacaacgaggacgaccacgggcggggcgaccucggccgccugaagaagcagaaggaccaccacaacccccaccugauccucaugaugaucccgccccaccggcuggacaaccccgggcagggcgggcagcgcaagaagcgcgcgcuggacaccaacuacugcuuccggaaccucgaggagaacugcugcgugcgcccccuguacaucgacuuccggcaggaccugggcuggaagugggugcacgagcccaagggcuacuacgccaacuucugcuccgggccgugccccuaccuccgcagcgccgacacgacccacuccaccguccugggccuguacaacacccucaaccccgaggccagcgccucccccugcugcgugccgcaggaccuggagccccugacgauccucuacuacguggggcggacccccaaggucgagcagcugagcaacaugguggucaagagcugcaagugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2778 - RNA, 1768 nt, Artificial Sequence
  mRNA product Design2 comprising derived and/or modified sequence from Homo sapiens__NP_001057.1__HsTNFRSF1B (opt1)
ggggcgcugccuacggagguggcagccaucuccuucucggcaucaagcuuaccauggcccccguggccgucugggcggcccuggccgugggccucgagcugugggccgccgcgcacgcccugccggcccagguggccuucacccccuacgcgcccgagcccgggagcacgugccgccuccgggaguacuacgaccagaccgcccagaugugcugcuccaagugcagcccgggccagcacgccaaggucuucugcaccaagaccuccgacaccgugugcgacagcugcgaggacuccacguacacccagcuguggaacugggugcccgagugccugagcugcgggucccgcugcagcuccgaccaggucgagacccaggccugcacccgggagcagaaccgcaucugcacgugccggcccggcugguacugcgcccucagcaagcaggaggggugccgccugugcgcgccccugcggaagugccgcccgggcuucggcguggcccggcccgggaccgagaccuccgacguggucugcaagcccugcgcccccggcaccuucagcaacacgaccuccagcaccgacaucugccgcccgcaccagaucugcaacgugguggccauccccgggaacgccuccauggacgcggucugcaccagcacgucccccacccggagcauggcccccggcgccgugcaccucccgcagcccguguccacccgcagccagcacacccagcccacgcccgagccgagcaccgcccccuccaccagcuuccugcugcccauggggcccuccccgcccgccgagggcagcaccggcgacuucgcgcuccccgucgggcugaucgugggcgugacggcccuggggcuccugaucaucggcgucgugaacugcgugaucaugacccaggucaagaagaagccccugugccuccagcgggaggccaaggugccgcaccuccccgccgacaaggcccgcggcacccaggggcccgagcagcagcaccuccugaucaccgcgccguccagcuccagcuccagccuggaguccagcgccuccgcccuggaccggcgcgcccccacgcggaaccagccccaggcgcccggcguggaggccagcggggccggcgaggcccgcgccuccaccgggagcuccgacagcuccccgggcggccacgggacccaggucaacgugaccugcaucgucaacgugugcagcagcuccgaccacagcucccagugcagcucccaggcgagcuccacgaugggcgacaccgacagcucccccagcgagucccccaaggacgagcagguccccuucagcaaggaggagugcgccuuccggucccagcuggagaccccggagacccugcuggggagcacggaggagaagccccucccccugggcgugcccgacgccgggaugaagccguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2779 - RNA, 895 nt, Artificial Sequence
  mRNA product Design2 comprising derived and/or modified sequence from Homo sapiens__NP_002623.2__HsPGF (opt1)
ggggcgcugccuacggagguggcagccaucuccuucucggcaucaagcuuaccaugcccgugaugcgccuguucccgugcuuccuccagcugcuggccggccucgcccugcccgcggucccgccccagcagugggcccugagcgccgggaacggcuccagcgagguggaggugguccccuuccaggaggugugggggcgguccuacugccgcgcccucgagcggcugguggacgucgugagcgaguaccccuccgagguggagcacauguucagccccuccugcgucagccugcuccgcugcaccggcugcugcggggacgagaaccugcacugcgugcccguggagaccgccaacgucacgaugcagcugcucaagauccgguccggcgaccgcccgagcuacguggagcugaccuucucccagcacgugcggugcgagugccgcccccugcgggagaagaugaagcccgagcgccggcgccccaagggccgggggaagcgccggcgcgagaagcagcggccgaccgacugccaccucugcggcgacgcggucccccgccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2780 - RNA, 1621 nt, Artificial Sequence
  mRNA product Design2 comprising derived and/or modified sequence from Homo sapiens__NP_001020537.2__HsVEGFA (opt1)
ggggcgcugccuacggagguggcagccaucuccuucucggcaucaagcuuaccaugaccgaccgccagaccgacacggcccccagcccguccuaccaccuccugcccggccggcgccggaccguggacgccgcggccagccgcgggcagggccccgagcccgcccccgggggcggggucgagggcgugggcgcccgcgggguggcccugaagcuguucguccagcuccugggcugcucccgguucgggggcgcgguggugcgggccggggaggccgagcccagcggcgccgcgcgcuccgccagcuccggccgggaggagccccagcccgaggagggggaggaggaggaggagaaggaggaggagcgcggcccgcaguggcggcugggggcccgcaagcccggcagcuggaccggcgaggccgccgucugcgcggacuccgcccccgccgcccgggccccgcaggcgcucgcccgcgccagcgggcggggcgggcgcguggcccggcgcggcgccgaggaguccgggccgccccacagccccucccggcgcggcagcgcgucccgggccggccccgggcgcgccagcgagaccaugaacuuccugcuguccugggugcacuggagccucgcccugcugcucuaccugcaccacgccaaguggucccaggcggccccgauggccgagggcgggggccagaaccaccacgaggucgugaaguucauggacguguaccagcgcagcuacugccaccccaucgagacgcuggucgacaucuuccaggaguaccccgacgagaucgaguacaucuucaagcccagcugcgugccgcucaugcggugcgggggcugcugcaacgacgagggccuggagugcgugcccaccgaggaguccaacaucaccaugcagaucaugcgcaucaagccccaccaggggcagcacaucggcgagaugagcuuccugcagcacaacaagugcgagugccggcccaagaaggaccgcgcccggcaggagaagaaguccguccgcgggaagggcaaggggcagaagcggaagcgcaagaagucccgguacaagagcuggagcguguacgugggcgcgcgcugcugccucaugccguggucccugcccggcccccaccccugcgggccgugcagcgagcggcgcaagcaccuguucguccaggacccccagaccugcaagugcuccugcaagaacacggacagccggugcaaggcccgccagcucgagcugaacgagcggaccugccgcugcgacaagccccggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2781 - RNA, 1081 nt, Artificial Sequence
  mRNA product Design2 comprising derived and/or modified sequence from Homo sapiens__NP_001165094.1__HsVEGFA (opt1)
ggggcgcugccuacggagguggcagccaucuccuucucggcaucaagcuuaccaugaacuuccugcucagcugggugcacuggucccuggcccugcuccuguaccugcaccacgccaaguggagccaggcggcccccauggccgagggcgggggccagaaccaccacgaggucgugaaguucauggacguguaccagcgcuccuacugccacccgaucgagacccucgucgacaucuuccaggaguaccccgacgagaucgaguacaucuucaagcccagcugcgugccccugaugcggugcgggggcugcugcaacgacgaggggcuggagugcgugccgaccgaggaguccaacaucacgaugcagaucaugcgcaucaagccccaccagggccagcacaucggcgagaugagcuuccuccagcacaacaagugcgagugccggcccaagaaggaccgcgcccggcaggagaagaaguccguccgcgggaagggcaaggggcagaagcggaagcgcaagaagucccgguacaagagcuggagcguguacgugggcgcccgcugcugccugaugcccuggucccugccggggccccaccccugcggccccugcagcgagcggcgcaagcaccucuucguccaggacccgcagaccugcaagugcuccugcaagaacaccgacagccggugcaaggcgcgccagcuggagcugaacgagcggaccugccgcugcgacaagccccggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2782 - RNA, 1006 nt, Artificial Sequence
  mRNA product Design2 comprising derived and/or modified sequence from Homo sapiens__NP_003368.1__HsVEGFB (opt1)
ggggcgcugccuacggagguggcagccaucuccuucucggcaucaagcuuaccaugagcccccugcuccgccggcugcugcucgccgcccugcugcagcucgcgccggcccaggcccccgugucccagcccgacgcccccggccaccagcgcaaggucgugagcuggaucgacguguacacccgggcgaccugccagccgcgcgaggucguggugccccugacggucgagcugauggggaccguggccaagcagcucgugcccuccugcgucaccgugcagcggugcggcgggugcugccccgacgacggccuggagugcgugccgaccgggcagcaccagguccgcaugcagauccugaugauccgguaccccagcucccagcucggcgagaugagccuggaggagcacucccagugcgagugccgccccaagaagaaggacagcgccgugaagcccgaccgggccgccacgccgcaccaccgcccccagccccgguccgugcccggcugggacagcgcgccgggggcccccucccccgccgacaucacccaccccaccccggcccccggccccagcgcccacgcggcccccuccaccacgagcgcccugaccccggggcccgccgccgcggccgccgacgccgccgcguccagcgucgccaagggcggggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2783 - RNA, 1642 nt, Artificial Sequence
  mRNA product Design2 comprising derived and/or modified sequence from Homo sapiens__NP_005420.1__HsVEGFC (opt1)
ggggcgcugccuacggagguggcagccaucuccuucucggcaucaagcuuaccaugcaccuccugggcuucuucagcguggccugcucccugcuggccgcggcccuccugcccgggccgcgcgaggcccccgccgccgcggccgccuucgagagcggccuggaccucuccgacgccgagcccgacgcgggggaggccaccgccuacgccagcaaggaccuggaggagcagcugcgguccgucagcuccguggacgagcucaugaccgugcuguaccccgaguacuggaagauguacaagugccagcugcgcaagggcggguggcagcacaaccgggagcaggccaaccucaacagccgcacggaggagaccaucaaguucgcggccgcccacuacaacaccgagauccugaaguccaucgacaacgaguggcggaagacccagugcaugccgcgcgaggucugcaucgacgugggcaaggaguucggcguggccacgaacaccuucuucaagccgcccugcgucagcguguaccggugcgggggcugcugcaacuccgaggggcugcagugcaugaacaccagcaccuccuaccucagcaagacgcuguucgagaucaccgugccccugucccagggccccaagcccgucaccaucagcuucgccaaccacaccuccugccgcugcaugagcaagcucgacguguaccgccaggugcacuccaucauccggcggagccugcccgcgacgcugccccagugccaggccgccaacaagaccugcccgaccaacuacauguggaacaaccacaucugccgcugccucgcccaggaggacuucauguucagcuccgacgccggggacgacagcaccgacggcuuccacgacaucugcggccccaacaaggagcuggacgaggagacgugccagugcgucugccgggcggggcugcgccccgccuccugcggcccccacaaggagcucgaccggaacagcugccagugcgugugcaagaacaagcuguucccgucccagugcggggccaaccgcgaguucgacgagaacacgugccagugcgugugcaagcggaccugcccccgcaaccagccccugaaccccggcaagugcgccugcgagugcaccgagagcccgcagaagugccuccugaagggcaagaaguuccaccaccagaccugcuccugcuaccggcgccccugcaccaaccggcagaaggccugcgagcccggguucagcuacuccgaggaggucugccgcugcgugcccagcuacuggaagcgcccgcagauguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2784 - RNA, 1447 nt, Artificial Sequence
  mRNA product Design2 comprising derived and/or modified sequence from Homo sapiens__NP_004460.1__HsVEGFD (opt1)
ggggcgcugccuacggagguggcagccaucuccuucucggcaucaagcuuaccauguaccgcgaguggguggucgugaacguguucaugaugcuguacguccagcucgugcagggcagcuccaacgagcacgggcccgugaagcggagcucccagagcacccuggagcgcuccgagcagcagauccgggccgccagcucccuggaggagcuccugcgcaucacccacagcgaggacuggaagcuguggcggugccgccuccggcugaaguccuucacgagcauggacucccgcagcgcgucccaccggagcacccgcuucgccgccaccuucuacgacaucgagacccugaaggucaucgacgaggaguggcagcggacgcagugcuccccgcgcgagaccugcguggagguggccagcgagcucggcaaguccaccaacaccuucuucaagccgcccugcgucaacguguuccggugcgggggcugcugcaacgaggagagccugaucugcaugaacacguccaccagcuacaucagcaagcagcuguucgagaucuccgugccccucaccagcguccccgagcuggugcccgugaaggucgccaaccacaccgggugcaagugccugcccacggcgccccgccacccguacuccaucauccggcgcagcauccagauccccgaggaggaccggugcucccacagcaagaagcucugccccaucgacaugcugugggacuccaacaagugcaagugcgugcugcaggaggagaacccccucgccggcaccgaggaccacagccaccuccaggagccggcccugugcggcccccacaugauguucgacgaggaccgcugcgagugcgugugcaagacccccugccccaaggaccugauccagcacccgaagaacugcuccugcuucgagugcaaggagagccuggagaccugcugccagaagcacaagcuguuccaccccgacacgugcuccugcgaggaccggugccccuuccacacccgccccugcgccagcgggaagaccgcgugcgccaagcacugccgguucccgaaggagaagcgcgccgcccagggcccccacucccgcaagaaccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2785 - RNA, 1012 nt, Artificial Sequence
  mRNA product Design2 comprising derived and/or modified sequence from Homo sapiens__NP_061986.1__HsFGF21 (opt2)
ggggcgcugccuacggagguggcagccaucuccuucucggcaucaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcuccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggccccucccagggccgcucccccuccuacgccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2786 - RNA, 1792 nt, Artificial Sequence
  mRNA product Design2 comprising derived and/or modified sequence from Homo sapiens__NP_002412.1__HsMMP1 (opt2)
ggggcgcugccuacggagguggcagccaucuccuucucggcaucaagcuuaccaugcacuccuuccccccccuccuccuccuccucuucuggggcgucgucucccacuccuuccccgccacccucgagacccaggagcaggacgucgaccucguccagaaguaccucgagaaguacuacaaccucaagaacgacggccgccaggucgagaagcgccgcaacuccggccccgucgucgagaagcucaagcagaugcaggaguucuucggccucaaggucaccggcaagcccgacgccgagacccucaaggucaugaagcagccccgcugcggcguccccgacgucgcccaguucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2787 - RNA, 1552 nt, Artificial Sequence
  mRNA product Design2 comprising derived and/or modified sequence from Homo sapiens__NP_002412.1__HsMMP1(1-19,100-469) (opt2)
ggggcgcugccuacggagguggcagccaucuccuucucggcaucaagcuuaccaugcacuccuuccccccccuccuccuccuccucuucuggggcgucgucucccacuccuucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2788 - RNA, 3739 nt, Artificial Sequence
  mRNA product Design2 comprising derived and/or modified sequence from Clostridium histolyticum__BAA77453.1__ColG (opt2)
ggggcgcugccuacggagguggcagccaucuccuucucggcaucaagcuuaccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2789 - RNA, 3463 nt, Artificial Sequence
  mRNA product Design2 comprising derived and/or modified sequence from Clostridium histolyticum__BAA77453.1__HsALB(1-18)_ColG(111-1118) (opt2)
ggggcgcugccuacggagguggcagccaucuccuucucggcaucaagcuuaccaugaagugggucaccuucaucucccuccucuuccucuucuccuccgccuacuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2790 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt2)
ggggcgcugccuacggagguggcagccaucuccuucucggcaucaagcuuaccaugaagugggucaccuucaucucccuccucuuccucuucuccuccgccuacuccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccucccgccgccgccgcaagcgcaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2791 - RNA, 3487 nt, Artificial Sequence
  mRNA product Design2 comprising derived and/or modified sequence from Clostridium histolyticum__BAA34542.1__ColH (opt2)
ggggcgcugccuacggagguggcagccaucuccuucucggcaucaagcuuaccaugaacuuccucaagaucauccucaaccgcggcaagaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2792 - RNA, 3448 nt, Artificial Sequence
  mRNA product Design2 comprising derived and/or modified sequence from Clostridium histolyticum__BAA34542.1__ColH (opt2)
ggggcgcugccuacggagguggcagccaucuccuucucggcaucaagcuuaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2793 - RNA, 3382 nt, Artificial Sequence
  mRNA product Design2 comprising derived and/or modified sequence from Clostridium histolyticum__BAA34542.1__HsALB(1-18)_ColH(41-1021) (opt2)
ggggcgcugccuacggagguggcagccaucuccuucucggcaucaagcuuaccaugaagugggucaccuucaucucccuccucuuccucuucuccuccgccuacuccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2794 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt2)
ggggcgcugccuacggagguggcagccaucuccuucucggcaucaagcuuaccaugaagugggucaccuucaucucccuccucuuccucuucuccuccgccuacuccaugaagcgcaagugccucuccaagcgccucaugcucgccaucaccauggccaccaucuucaccgucaacuccacccuccccaucuacgccgccgucgacaagaacaacgccaccgccgcccgccgccgccgcaagcgcguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2795 - RNA, 958 nt, Artificial Sequence
  mRNA product Design2 comprising derived and/or modified sequence from Homo sapiens__NP_001133.1__HsAMELX (opt2)
ggggcgcugccuacggagguggcagccaucuccuucucggcaucaagcuuaccaugggcaccuggauccucuucgccugccuccucggcgccgccuucgccaugccccuccccccccaccccggccaccccggcuacaucaacuucuccuacgagguccucaccccccucaagugguaccaguccauccgcccccccuaccccuccuacggcuacgagcccaugggcggcuggcuccaccaccagaucauccccguccucucccagcagcacccccccacccacacccuccagccccaccaccacauccccgucguccccgcccagcagcccgucaucccccagcagcccaugaugcccguccccggccagcacuccaugacccccauccagcaccaccagcccaaccuccccccccccgcccagcagcccuaccagccccagcccguccagccccagccccaccagcccaugcagccccagccccccguccaccccaugcagccccuccccccccagcccccccucccccccauguuccccaugcagccccucccccccaugcuccccgaccucacccucgaggccuggcccuccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2796 - RNA, 517 nt, Artificial Sequence
  mRNA product Design2 comprising derived and/or modified sequence from Homo sapiens__NP_001133.1__HsAMELX-TRAP (opt2)
ggggcgcugccuacggagguggcagccaucuccuucucggcaucaagcuuaccaugccccuccccccccaccccggccaccccggcuacaucaacuucuccuacgagguccucaccccccucaagugguaccaguccauccgcccccccuaccccuccuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2797 - RNA, 550 nt, Artificial Sequence
  mRNA product Design2 comprising derived and/or modified sequence from Homo sapiens__NP_001133.1__HsAMELX-LRAP (opt2)
ggggcgcugccuacggagguggcagccaucuccuucucggcaucaagcuuaccaugccccuccccccccaccccggccaccccggcuacaucaacuucuccuacgagguccucaccccccucaagugguaccaguccauccgccccccccccaugcuccccgaccucacccucgaggccuggcccuccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2798 - RNA, 589 nt, Artificial Sequence
  mRNA product Design2 comprising derived and/or modified sequence from Homo sapiens__NP_001133.1__HLA-A2-SP_HsAMELX(17-60) (opt2)
ggggcgcugccuacggagguggcagccaucuccuucucggcaucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccauccgcccccccuaccccuccuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2799 - RNA, 622 nt, Artificial Sequence
  mRNA product Design2 comprising derived and/or modified sequence from Homo sapiens__NP_001133.1__HLA-A2-SP_HsAMELX(17-47,168-191) (opt2)
ggggcgcugccuacggagguggcagccaucuccuucucggcaucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccauccgccccccccccaugcuccccgaccucacccucgaggccuggcccuccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2800 - RNA, 961 nt, Artificial Sequence
  mRNA product Design2 comprising derived and/or modified sequence from Homo sapiens__NP_001134.1__HsAMELY (opt2)
ggggcgcugccuacggagguggcagccaucuccuucucggcaucaagcuuaccaugggcaccuggauccucuucgccugccucgucggcgccgccuucgccaugccccuccccccccaccccggccaccccggcuacaucaacuucuccuacgagguccucaccccccucaagugguaccaguccaugauccgcccccccuacuccuccuacggcuacgagcccaugggcggcuggcuccaccaccagaucauccccgucgucucccagcagcacccccucacccacacccuccagucccaccaccacauccccgucguccccgcccagcagccccgcguccgccagcaggcccucaugcccguccccggccagcaguccaugacccccacccagcaccaccagcccaaccucccccuccccgcccagcagcccuuccagccccagcccguccagccccagccccaccagcccaugcagccccagccccccguccagcccaugcagccccuccucccccagcccccccucccccccauguucccccuccgcccccucccccccauccuccccgaccuccaccucgaggccuggcccgccaccgacaagaccaagcaggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2801 - RNA, 520 nt, Artificial Sequence
  mRNA product Design2 comprising derived and/or modified sequence from Homo sapiens__NP_001134.1__HsAMELY-TRAP (opt2)
ggggcgcugccuacggagguggcagccaucuccuucucggcaucaagcuuaccaugccccuccccccccaccccggccaccccggcuacaucaacuucuccuacgagguccucaccccccucaagugguaccaguccaugauccgcccccccuacuccuccuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2802 - RNA, 553 nt, Artificial Sequence
  mRNA product Design2 comprising derived and/or modified sequence from Homo sapiens__NP_001134.1__HsAMELY-LRAP (opt2)
ggggcgcugccuacggagguggcagccaucuccuucucggcaucaagcuuaccaugccccuccccccccaccccggccaccccggcuacaucaacuucuccuacgagguccucaccccccucaagugguaccaguccaugauccgccccccccccauccuccccgaccuccaccucgaggccuggcccgccaccgacaagaccaagcaggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2803 - RNA, 592 nt, Artificial Sequence
  mRNA product Design2 comprising derived and/or modified sequence from Homo sapiens__NP_001134.1__HLA-A2-SP_HsAMELY(17-61) (opt2)
ggggcgcugccuacggagguggcagccaucuccuucucggcaucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccaugauccgcccccccuacuccuccuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2804 - RNA, 625 nt, Artificial Sequence
  mRNA product Design2 comprising derived and/or modified sequence from Homo sapiens__NP_001134.1__HLA-A2-SP_HsAMELY(17-48,169-192) (opt2)
ggggcgcugccuacggagguggcagccaucuccuucucggcaucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccaugauccgccccccccccauccuccccgaccuccaccucgaggccuggcccgccaccgacaagaccaagcaggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2805 - RNA, 952 nt, Artificial Sequence
  mRNA product Design2 comprising derived and/or modified sequence from Sus scrofa__NP_999071.1__SsAMELX-001-1 (opt2)
ggggcgcugccuacggagguggcagccaucuccuucucggcaucaagcuuaccaugggcaccuggauccucuucgccugccuccucggcgccgccuucuccaugccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2806 - RNA, 520 nt, Artificial Sequence
  mRNA product Design2 comprising derived and/or modified sequence from Sus scrofa__NP_999071.1__SsAMELX-TRAP (opt2)
ggggcgcugccuacggagguggcagccaucuccuucucggcaucaagcuuaccaugccccuccccccccaccccggccaccccggcuacaucaacuucuccuacgagguccucaccccccucaagugguaccagaacaugauccgccaccccuacaccuccuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2807 - RNA, 553 nt, Artificial Sequence
  mRNA product Design2 comprising derived and/or modified sequence from Sus scrofa__NP_999071.1__SsAMELX-LRAP (opt2)
ggggcgcugccuacggagguggcagccaucuccuucucggcaucaagcuuaccaugccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2808 - RNA, 592 nt, Artificial Sequence
  mRNA product Design2 comprising derived and/or modified sequence from Sus scrofa__NP_999071.1__HLA-A2-SP_SsAMEL(17-61) (opt2)
ggggcgcugccuacggagguggcagccaucuccuucucggcaucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccagaacaugauccgccaccccuacaccuccuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2809 - RNA, 625 nt, Artificial Sequence
  mRNA product Design2 comprising derived and/or modified sequence from Sus scrofa__NP_999071.1__HLA-A2-SP_SsAMEL(17-49,167-189) (opt2)
ggggcgcugccuacggagguggcagccaucuccuucucggcaucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2810 - RNA, 916 nt, Artificial Sequence
  mRNA product Design2 comprising derived and/or modified sequence from Sus scrofa__P45561-2__SsAMELX-001-2 (opt2)
ggggcgcugccuacggagguggcagccaucuccuucucggcaucaagcuuaccaugggcaccuggauccucuucgccugccuccucggcgccgccuucuccaugccccuccccccccaccccggccaccccggcuacaucaacuucuccuacauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2811 - RNA, 952 nt, Artificial Sequence
  mRNA product Design2 comprising derived and/or modified sequence from Sus scrofa__NP_998965.1__SsAMELX-001-3 (opt2)
ggggcgcugccuacggagguggcagccaucuccuucucggcaucaagcuuaccaugggcaccuggaucuucuucgccugccuccucggcgccucccucgccaugccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2812 - RNA, 601 nt, Artificial Sequence
  mRNA product Design2 comprising derived and/or modified sequence from Sus scrofa__K7GPB2__SsAMELX-002 (opt2)
ggggcgcugccuacggagguggcagccaucuccuucucggcaucaagcuuaccaugggcaccuggauccucuucgccugccuccucggcgccgccuucuccaugccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2813 - RNA, 994 nt, Artificial Sequence
  mRNA product Design2 comprising derived and/or modified sequence from Sus scrofa__K7GLD0__SsAMELX-003 (opt2)
ggggcgcugccuacggagguggcagccaucuccuucucggcaucaagcuuaccaugggcaccuggauccucuucgccugccuccucggcgccgccuucuccaugccccuccccccccaccccggccaccccggcuacaucaacuucuccuacgaggaccucuaccucgaggccauccgcaucgaccgcaccgccuucguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2814 - RNA, 880 nt, Artificial Sequence
  mRNA product Design2 comprising derived and/or modified sequence from Sus scrofa__K7GPE9__SsAMELX-004 (opt2)
ggggcgcugccuacggagguggcagccaucuccuucucggcaucaagcuuaccaugggcaccuggauccucuucgccugccuccucggcgccgccuucuccaugccccuccccccccaccccggccaccccggcuacaucaacuucuccuacgagguccucaccccccucaagugguaccagaacaugauccgccaccccaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2815 - RNA, 904 nt, Artificial Sequence
  mRNA product Design2 comprising derived and/or modified sequence from Sus scrofa__J9JIM4__SsAMELX-201 (opt2)
ggggcgcugccuacggagguggcagccaucuccuucucggcaucaagcuuaccaugccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2816 - RNA, 3343 nt, Artificial Sequence
  mRNA product Design2 comprising derived and/or modified sequence from Homo sapiens__NP_006120.1__HsBMP1 (opt2)
ggggcgcugccuacggagguggcagccaucuccuucucggcaucaagcuuaccaugcccggcgucgcccgccucccccuccuccucggccuccuccuccucccccgccccggccgcccccucgaccucgccgacuacaccuacgaccucgccgaggaggacgacuccgagccccucaacuacaaggaccccugcaaggccgccgccuuccucggcgacaucgcccucgacgaggaggaccuccgcgccuuccagguccagcaggccgucgaccuccgccgccacaccgcccgcaaguccuccaucaaggccgccguccccggcaacaccuccacccccuccugccaguccaccaacggccagccccagcgcggcgccugcggccgcuggcgcggccgcucccgcucccgccgcgccgccaccucccgccccgagcgcgucuggcccgacggcgucauccccuucgucaucggcggcaacuucaccggcucccagcgcgccgucuuccgccaggccaugcgccacugggagaagcacaccugcgucaccuuccucgagcgcaccgacgaggacuccuacaucgucuucaccuaccgccccugcggcugcugcuccuacgucggccgccgcggcggcggcccccaggccaucuccaucggcaagaacugcgacaaguucggcaucgucguccacgagcucggccacgucgucggcuucuggcacgagcacacccgccccgaccgcgaccgccacgucuccaucguccgcgagaacauccagcccggccaggaguacaacuuccucaagauggagccccaggaggucgagucccucggcgagaccuacgacuucgacuccaucaugcacuacgcccgcaacaccuucucccgcggcaucuuccucgacaccaucguccccaaguacgaggucaacggcgucaagccccccaucggccagcgcacccgccucuccaagggcgacaucgcccaggcccgcaagcucuacaagugccccgccugcggcgagacccuccaggacuccaccggcaacuucuccucccccgaguaccccaacggcuacuccgcccacaugcacugcgucuggcgcaucuccgucacccccggcgagaagaucauccucaacuucaccucccucgaccucuaccgcucccgccucugcugguacgacuacgucgagguccgcgacggcuucuggcgcaaggccccccuccgcggccgcuucugcggcuccaagcuccccgagcccaucgucuccaccgacucccgccucugggucgaguuccgcuccuccuccaacugggucggcaagggcuucuucgccgucuacgaggccaucugcggcggcgacgucaagaaggacuacggccacauccagucccccaacuaccccgacgacuaccgccccuccaaggucugcaucuggcgcauccaggucuccgagggcuuccacgucggccucaccuuccaguccuucgagaucgagcgccacgacuccugcgccuacgacuaccucgagguccgcgacggccacuccgaguccuccacccucaucggccgcuacugcggcuacgagaagcccgacgacaucaaguccaccuccucccgccucuggcucaaguucgucuccgacggcuccaucaacaaggccggcuucgccgucaacuucuucaaggaggucgacgagugcucccgccccaaccgcggcggcugcgagcagcgcugccucaacacccucggcuccuacaagugcuccugcgaccccggcuacgagcucgcccccgacaagcgccgcugcgaggccgccugcggcggcuuccucaccaagcucaacggcuccaucaccucccccggcuggcccaaggaguacccccccaacaagaacugcaucuggcagcucgucgcccccacccaguaccgcaucucccuccaguucgacuucuucgagaccgagggcaacgacgucugcaaguacgacuucgucgagguccgcuccggccucaccgccgacuccaagcuccacggcaaguucugcggcuccgagaagcccgaggucaucaccucccaguacaacaacaugcgcgucgaguucaaguccgacaacaccgucuccaagaagggcuucaaggcccacuucuucuccgacaaggacgagugcuccaaggacaacggcggcugccagcaggacugcgucaacaccuucggcuccuacgagugccagugccgcuccggcuucguccuccacgacaacaagcacgacugcaaggaggccggcugcgaccacaaggucaccuccaccuccggcaccaucaccucccccaacuggcccgacaaguaccccuccaagaaggagugcaccugggccaucuccuccacccccggccaccgcgucaagcucaccuucauggagauggacaucgagucccagcccgagugcgccuacgaccaccucgaggucuucgacggccgcgacgccaaggcccccguccucggccgcuucugcggcuccaagaagcccgagcccguccucgccaccggcucccgcauguuccuccgcuucuacuccgacaacuccguccagcgcaagggcuuccaggccucccacgccaccgagugcggcggccagguccgcgccgacgucaagaccaaggaccucuacucccacgcccaguucggcgacaacaacuaccccggcggcgucgacugcgagugggucaucgucgccgaggagggcuacggcgucgagcucgucuuccagaccuucgaggucgaggaggagaccgacugcggcuacgacuacauggagcucuucgacggcuacgacuccaccgccccccgccucggccgcuacugcggcuccggcccccccgaggaggucuacuccgccggcgacuccguccucgucaaguuccacuccgacgacaccaucaccaagaagggcuuccaccuccgcuacaccuccaccaaguuccaggacacccuccacucccgcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2817 - RNA, 1573 nt, Artificial Sequence
  mRNA product Design2 comprising derived and/or modified sequence from Homo sapiens__NP_001191.1__HsBMP2 (opt2)
ggggcgcugccuacggagguggcagccaucuccuucucggcaucaagcuuaccauggucgccggcacccgcugccuccucgcccuccuccucccccagguccuccucggcggcgccgccggccucguccccgagcucggccgccgcaaguucgccgccgccuccuccggccgccccuccucccagcccuccgacgagguccucuccgaguucgagcuccgccuccucuccauguucggccucaagcagcgccccacccccucccgcgacgccgucgucccccccuacaugcucgaccucuaccgccgccacuccggccagcccggcucccccgcccccgaccaccgccucgagcgcgccgccucccgcgccaacaccguccgcuccuuccaccacgaggagucccucgaggagcuccccgagaccuccggcaagaccacccgccgcuucuucuucaaccucuccuccauccccaccgaggaguucaucaccuccgccgagcuccaggucuuccgcgagcagaugcaggacgcccucggcaacaacuccuccuuccaccaccgcaucaacaucuacgagaucaucaagcccgccaccgccaacuccaaguuccccgucacccgccuccucgacacccgccucgucaaccagaacgccucccgcugggaguccuucgacgucacccccgccgucaugcgcuggaccgcccagggccacgccaaccacggcuucgucgucgaggucgcccaccucgaggagaagcagggcgucuccaagcgccacguccgcaucucccgcucccuccaccaggacgagcacuccuggucccagauccgcccccuccucgucaccuucggccacgacggcaagggccacccccuccacaagcgcgagaagcgccaggccaagcacaagcagcgcaagcgccucaaguccuccugcaagcgccacccccucuacgucgacuucuccgacgucggcuggaacgacuggaucgucgccccccccggcuaccacgccuucuacugccacggcgagugccccuucccccucgccgaccaccucaacuccaccaaccacgccaucguccagacccucgucaacuccgucaacuccaagauccccaaggccugcugcguccccaccgagcucuccgccaucuccaugcucuaccucgacgagaacgagaaggucguccucaagaacuaccaggacauggucgucgagggcugcggcugccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2818 - RNA, 1609 nt, Artificial Sequence
  mRNA product Design2 comprising derived and/or modified sequence from Homo sapiens__NP_001193.2__HsBMP4 (opt2)
ggggcgcugccuacggagguggcagccaucuccuucucggcaucaagcuuaccaugauccccggcaaccgcaugcucauggucguccuccucugccagguccuccucggcggcgccucccacgccucccucauccccgagaccggcaagaagaaggucgccgagauccagggccacgccggcggccgccgcuccggccagucccacgagcuccuccgcgacuucgaggccacccuccuccagauguucggccuccgccgccgcccccagcccuccaaguccgccgucauccccgacuacaugcgcgaccucuaccgccuccaguccggcgaggaggaggaggagcagauccacuccaccggccucgaguaccccgagcgccccgccucccgcgccaacaccguccgcuccuuccaccacgaggagcaccucgagaacauccccggcaccuccgagaacuccgccuuccgcuuccucuucaaccucuccuccauccccgagaacgaggucaucuccuccgccgagcuccgccucuuccgcgagcaggucgaccagggccccgacugggagcgcggcuuccaccgcaucaacaucuacgaggucaugaagccccccgccgaggucguccccggccaccucaucacccgccuccucgacacccgccucguccaccacaacgucacccgcugggagaccuucgacgucucccccgccguccuccgcuggacccgcgagaagcagcccaacuacggccucgccaucgaggucacccaccuccaccagacccgcacccaccagggccagcacguccgcaucucccgcucccucccccagggcuccggcaacugggcccagcuccgcccccuccucgucaccuucggccacgacggccgcggccacgcccucacccgccgccgccgcgccaagcgcucccccaagcaccacucccagcgcgcccgcaagaagaacaagaacugccgccgccacucccucuacgucgacuucuccgacgucggcuggaacgacuggaucgucgccccccccggcuaccaggccuucuacugccacggcgacugccccuucccccucgccgaccaccucaacuccaccaaccacgccaucguccagacccucgucaacuccgucaacuccuccauccccaaggccugcugcguccccaccgagcucuccgccaucuccaugcucuaccucgacgaguacgacaaggucguccucaagaacuaccaggagauggucgucgagggcugcggcugccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2819 - RNA, 1924 nt, Artificial Sequence
  mRNA product Design2 comprising derived and/or modified sequence from Homo sapiens__NP_001709.1__HsBMP6 (opt2)
ggggcgcugccuacggagguggcagccaucuccuucucggcaucaagcuuaccaugcccggccucggccgccgcgcccaguggcucugcuggugguggggccuccucugcuccugcugcggcccccccccccuccgccccccccuccccgccgccgccgccgccgccgccggcggccagcuccucggcgacggcggcucccccggccgcaccgagcagcccccccccuccccccaguccuccuccggcuuccucuaccgccgccucaagacccaggagaagcgcgagaugcagaaggagauccucuccguccucggccucccccaccgcccccgcccccuccacggccuccagcagccccagccccccgcccuccgccagcaggaggagcagcagcagcagcagcagcucccccgcggcgagcccccccccggccgccucaaguccgccccccucuucaugcucgaccucuacaacgcccucuccgccgacaacgacgaggacggcgccuccgagggcgagcgccagcaguccuggccccacgaggccgccuccuccucccagcgccgccagcccccccccggcgccgcccacccccucaaccgcaagucccuccucgcccccggcuccggcuccggcggcgccuccccccucaccuccgcccaggacuccgccuuccucaacgacgccgacauggucauguccuucgucaaccucgucgaguacgacaaggaguucuccccccgccagcgccaccacaaggaguucaaguucaaccucucccagauccccgagggcgaggucgucaccgccgccgaguuccgcaucuacaaggacugcgucaugggcuccuucaagaaccagaccuuccucaucuccaucuaccagguccuccaggagcaccagcaccgcgacuccgaccucuuccuccucgacacccgcgucgucugggccuccgaggagggcuggcucgaguucgacaucaccgccaccuccaaccucugggucgucaccccccagcacaacaugggccuccagcucuccgucgucacccgcgacggcguccacguccacccccgcgccgccggccucgucggccgcgacggccccuacgacaagcagcccuucauggucgccuucuucaaggucuccgagguccacguccgcaccacccgcuccgccuccucccgccgccgccagcagucccgcaaccgcuccacccagucccaggacgucgcccgcgucuccuccgccuccgacuacaacuccuccgagcucaagaccgccugccgcaagcacgagcucuacgucuccuuccaggaccucggcuggcaggacuggaucaucgcccccaagggcuacgccgccaacuacugcgacggcgagugcuccuucccccucaacgcccacaugaacgccaccaaccacgccaucguccagacccucguccaccucaugaaccccgaguacguccccaagcccugcugcgcccccaccaagcucaacgccaucuccguccucuacuucgacgacaacuccaacgucauccucaagaaguaccgcaacauggucguccgcgccugcggcugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2820 - RNA, 1678 nt, Artificial Sequence
  mRNA product Design2 comprising derived and/or modified sequence from Homo sapiens__NP_001710.1__HsBMP7 (opt2)
ggggcgcugccuacggagguggcagccaucuccuucucggcaucaagcuuaccaugcacguccgcucccuccgcgccgccgccccccacuccuucgucgcccucugggccccccucuuccuccuccgcuccgcccucgccgacuucucccucgacaacgagguccacuccuccuucauccaccgccgccuccgcucccaggagcgccgcgagaugcagcgcgagauccucuccauccucggccucccccaccgcccccgcccccaccuccagggcaagcacaacuccgcccccauguucaugcucgaccucuacaacgccauggccgucgaggagggcggcggccccggcggccagggcuucuccuaccccuacaaggccgucuucuccacccagggccccccccucgccucccuccaggacucccacuuccucaccgacgccgacauggucauguccuucgucaaccucgucgagcacgacaaggaguucuuccacccccgcuaccaccaccgcgaguuccgcuucgaccucuccaagauccccgagggcgaggccgucaccgccgccgaguuccgcaucuacaaggacuacauccgcgagcgcuucgacaacgagaccuuccgcaucuccgucuaccagguccuccaggagcaccucggccgcgaguccgaccucuuccuccucgacucccgcacccucugggccuccgaggagggcuggcucgucuucgacaucaccgccaccuccaaccacugggucgucaacccccgccacaaccucggccuccagcucuccgucgagacccucgacggccaguccaucaaccccaagcucgccggccucaucggccgccacggcccccagaacaagcagcccuucauggucgccuucuucaaggccaccgagguccacuuccgcuccauccgcuccaccggcuccaagcagcgcucccagaaccgcuccaagacccccaagaaccaggaggcccuccgcauggccaacgucgccgagaacuccuccuccgaccagcgccaggccugcaagaagcacgagcucuacgucuccuuccgcgaccucggcuggcaggacuggaucaucgcccccgagggcuacgccgccuacuacugcgagggcgagugcgccuucccccucaacuccuacaugaacgccaccaaccacgccaucguccagacccucguccacuucaucaaccccgagaccguccccaagcccugcugcgcccccacccagcucaacgccaucuccguccucuacuucgacgacuccuccaacgucauccucaagaaguaccgcaacauggucguccgcgccugcggcugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2821 - RNA, 682 nt, Artificial Sequence
  mRNA product Design2 comprising derived and/or modified sequence from Homo sapiens__NP_006264.2__HsCCL7 (opt2)
ggggcgcugccuacggagguggcagccaucuccuucucggcaucaagcuuaccaugaaggccuccgccgcccuccucugccuccuccucaccgccgccgccuucuccccccagggccucgcccagcccgucggcaucaacaccuccaccaccugcugcuaccgcuucaucaacaagaagauccccaagcagcgccucgaguccuaccgccgcaccaccuccucccacugcccccgcgaggccgucaucuucaagaccaagcucgacaaggagaucugcgccgaccccacccagaaguggguccaggacuucaugaagcaccucgacaagaagacccagacccccaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2822 - RNA, 4006 nt, Artificial Sequence
  mRNA product Design2 comprising derived and/or modified sequence from Homo sapiens__NP_001954.2__HsEGF (opt2)
ggggcgcugccuacggagguggcagccaucuccuucucggcaucaagcuuaccaugcuccucacccucaucauccuccuccccgucgucuccaaguucuccuucgucucccucuccgccccccagcacugguccugccccgagggcacccucgccggcaacggcaacuccaccugcgucggccccgcccccuuccucaucuucucccacggcaacuccaucuuccgcaucgacaccgagggcaccaacuacgagcagcucgucgucgacgccggcgucuccgucaucauggacuuccacuacaacgagaagcgcaucuacugggucgaccucgagcgccagcuccuccagcgcgucuuccucaacggcucccgccaggagcgcgucugcaacaucgagaagaacgucuccggcauggccaucaacuggaucaacgaggaggucaucugguccaaccagcaggagggcaucaucaccgucaccgacaugaagggcaacaacucccacauccuccucuccgcccucaaguaccccgccaacgucgccgucgaccccgucgagcgcuucaucuucugguccuccgaggucgccggcucccucuaccgcgccgaccucgacggcgucggcgucaaggcccuccucgagaccuccgagaagaucaccgccgucucccucgacguccucgacaagcgccucuucuggauccaguacaaccgcgagggcuccaacucccucaucugcuccugcgacuacgacggcggcuccguccacaucuccaagcaccccacccagcacaaccucuucgccaugucccucuucggcgaccgcaucuucuacuccaccuggaagaugaagaccaucuggaucgccaacaagcacaccggcaaggacaugguccgcaucaaccuccacuccuccuucgucccccucggcgagcucaaggucguccacccccucgcccagcccaaggccgaggacgacaccugggagcccgagcagaagcucugcaagcuccgcaagggcaacugcuccuccaccgucugcggccaggaccuccagucccaccucugcaugugcgccgagggcuacgcccucucccgcgaccgcaaguacugcgaggacgucaacgagugcgccuucuggaaccacggcugcacccucggcugcaagaacacccccggcuccuacuacugcaccugccccgucggcuucguccuccuccccgacggcaagcgcugccaccagcucgucuccugcccccgcaacgucuccgagugcucccacgacugcguccucaccuccgagggcccccucugcuucugccccgagggcuccguccucgagcgcgacggcaagaccugcuccggcugcuccucccccgacaacggcggcugcucccagcucugcgucccccucucccccgucuccugggagugcgacugcuuccccggcuacgaccuccagcucgacgagaaguccugcgccgccuccggcccccagcccuuccuccucuucgccaacucccaggacauccgccacaugcacuucgacggcaccgacuacggcacccuccucucccagcagaugggcauggucuacgcccucgaccacgaccccgucgagaacaagaucuacuucgcccacaccgcccucaaguggaucgagcgcgccaacauggacggcucccagcgcgagcgccucaucgaggagggcgucgacguccccgagggccucgccgucgacuggaucggccgccgcuucuacuggaccgaccgcggcaagucccucaucggccgcuccgaccucaacggcaagcgcuccaagaucaucaccaaggagaacaucucccagccccgcggcaucgccguccaccccauggccaagcgccucuucuggaccgacaccggcaucaacccccgcaucgaguccuccucccuccagggccucggccgccucgucaucgccuccuccgaccucaucuggcccuccggcaucaccaucgacuuccucaccgacaagcucuacuggugcgacgccaagcaguccgucaucgagauggccaaccucgacggcuccaagcgccgccgccucacccagaacgacgucggccaccccuucgccgucgccgucuucgaggacuacgucugguucuccgacugggccaugcccuccgucaugcgcgucaacaagcgcaccggcaaggaccgcguccgccuccagggcuccaugcucaagcccuccucccucgucgucguccacccccucgccaagcccggcgccgaccccugccucuaccagaacggcggcugcgagcacaucugcaagaagcgccucggcaccgccuggugcuccugccgcgagggcuucaugaaggccuccgacggcaagaccugccucgcccucgacggccaccagcuccucgccggcggcgaggucgaccucaagaaccaggucaccccccucgacauccucuccaagacccgcgucuccgaggacaacaucaccgagucccagcacaugcucgucgccgagaucauggucuccgaccaggacgacugcgcccccgucggcugcuccauguacgcccgcugcaucuccgagggcgaggacgccaccugccagugccucaagggcuucgccggcgacggcaagcucugcuccgacaucgacgagugcgagaugggcguccccgucugcccccccgccuccuccaagugcaucaacaccgagggcggcuacgucugccgcugcuccgagggcuaccagggcgacggcauccacugccucgacaucgacgagugccagcucggcgagcacuccugcggcgagaacgccuccugcaccaacaccgagggcggcuacaccugcaugugcgccggccgccucuccgagcccggccucaucugccccgacuccaccccccccccccaccuccgcgaggacgaccaccacuacuccguccgcaacuccgacuccgagugcccccucucccacgacggcuacugccuccacgacggcgucugcauguacaucgaggcccucgacaaguacgccugcaacugcgucgucggcuacaucggcgagcgcugccaguaccgcgaccucaaguggugggagcuccgccacgccggccacggccagcagcagaaggucaucgucgucgccgucugcgucgucguccucgucaugcuccuccuccucucccucuggggcgcccacuacuaccgcacccagaagcuccucuccaagaaccccaagaaccccuacgaggaguccucccgcgacguccgcucccgccgccccgccgacaccgaggacggcauguccuccugcccccagcccugguucgucgucaucaaggagcaccaggaccucaagaacggcggccagcccgucgccggcgaggacggccaggccgccgacggcuccaugcagcccaccuccuggcgccaggagccccagcucugcggcaugggcaccgagcagggcugcuggauccccgucuccuccgacaagggcuccugcccccaggucauggagcgcuccuuccacaugcccuccuacggcacccagacccucgagggcggcgucgagaagccccacucccuccucuccgccaacccccucuggcagcagcgcgcccucgaccccccccaccagauggagcucacccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2823 - RNA, 892 nt, Artificial Sequence
  mRNA product Design2 comprising derived and/or modified sequence from Homo sapiens__NP_001423.1__HsEREG (opt2)
ggggcgcugccuacggagguggcagccaucuccuucucggcaucaagcuuaccaugaccgccggccgccgcauggagaugcucugcgccggccgcguccccgcccuccuccucugccucggcuuccaccuccuccaggccguccucuccaccaccgucauccccuccugcauccccggcgaguccuccgacaacugcaccgcccucguccagaccgaggacaacccccgcgucgcccaggucuccaucaccaagugcuccuccgacaugaacggcuacugccuccacggccagugcaucuaccucgucgacaugucccagaacuacugccgcugcgaggucggcuacaccggcguccgcugcgagcacuucuuccucaccguccaccagccccucuccaaggaguacgucgcccucaccgucauccucaucauccucuuccucaucaccgucgucggcuccaccuacuacuucugccgcugguaccgcaaccgcaaguccaaggagcccaagaaggaguacgagcgcgucaccuccggcgaccccgagcucccccaggucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2824 - RNA, 850 nt, Artificial Sequence
  mRNA product Design2 comprising derived and/or modified sequence from Homo sapiens__NP_000791.1__HsFGF1 (opt2)
ggggcgcugccuacggagguggcagccaucuccuucucggcaucaagcuuaccauggccgagggcgagaucaccaccuucaccgcccucaccgagaaguucaaccucccccccggcaacuacaagaagcccaagcuccucuacugcuccaacggcggccacuuccuccgcauccuccccgacggcaccgucgacggcacccgcgaccgcuccgaccagcacauccagcuccagcucuccgccgaguccgucggcgaggucuacaucaaguccaccgagaccggccaguaccucgccauggacaccgacggccuccucuacggcucccagacccccaacgaggagugccucuuccucgagcgccucgaggagaaccacuacaacaccuacaucuccaagaagcacgccgagaagaacugguucgucggccucaagaagaacggcuccugcaagcgcggcccccgcacccacuacggccagaaggccauccucuuccucccccuccccgucuccuccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2825 - RNA, 1249 nt, Artificial Sequence
  mRNA product Design2 comprising derived and/or modified sequence from Homo sapiens__NP_001997.5__HsFGF2 (opt2)
ggggcgcugccuacggagguggcagccaucuccuucucggcaucaagcuuaccauggucggcgucggcggcggcgacgucgaggacgucaccccccgccccggcggcugccagaucuccggccgcggcgcccgcggcugcaacggcauccccggcgccgccgccugggaggccgcccucccccgccgccgcccccgccgccaccccuccgucaacccccgcucccgcgccgccggcuccccccgcacccgcggccgccgcaccgaggagcgccccuccggcucccgccucggcgaccgcggccgcggccgcgcccuccccggcggccgccucggcggccgcggccgcggccgcgcccccgagcgcgucggcggccgcggccgcggccgcggcaccgccgccccccgcgccgcccccgccgcccgcggcucccgccccggccccgccggcaccauggccgccggcuccaucaccacccuccccgcccuccccgaggacggcggcuccggcgccuucccccccggccacuucaaggaccccaagcgccucuacugcaagaacggcggcuucuuccuccgcauccaccccgacggccgcgucgacggcguccgcgagaaguccgacccccacaucaagcuccagcuccaggccgaggagcgcggcgucgucuccaucaagggcgucugcgccaaccgcuaccucgccaugaaggaggacggccgccuccucgccuccaagugcgucaccgacgagugcuucuucuucgagcgccucgaguccaacaacuacaacaccuaccgcucccgcaaguacaccuccugguacgucgcccucaagcgcaccggccaguacaagcucggcuccaagaccggccccggccagaaggccauccucuuccuccccauguccgccaaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2826 - RNA, 967 nt, Artificial Sequence
  mRNA product Design2 comprising derived and/or modified sequence from Homo sapiens__NP_002000.1__HsFGF7 (opt2)
ggggcgcugccuacggagguggcagccaucuccuucucggcaucaagcuuaccaugcacaaguggauccucaccuggauccuccccacccuccucuaccgcuccugcuuccacaucaucugccucgucggcaccaucucccucgccugcaacgacaugacccccgagcagauggccaccaacgucaacugcuccucccccgagcgccacacccgcuccuacgacuacauggagggcggcgacauccgcguccgccgccucuucugccgcacccagugguaccuccgcaucgacaagcgcggcaaggucaagggcacccaggagaugaagaacaacuacaacaucauggagauccgcaccgucgccgucggcaucgucgccaucaagggcgucgaguccgaguucuaccucgccaugaacaaggagggcaagcucuacgccaagaaggagugcaacgaggacugcaacuucaaggagcucauccucgagaaccacuacaacaccuacgccuccgccaaguggacccacaacggcggcgagauguucgucgcccucaaccagaagggcauccccguccgcggcaagaagaccaagaaggagcagaagaccgcccacuuccuccccauggccaucaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2827 - RNA, 1009 nt, Artificial Sequence
  mRNA product Design2 comprising derived and/or modified sequence from Homo sapiens__NP_001936.1__HsHBEGF (opt2)
ggggcgcugccuacggagguggcagccaucuccuucucggcaucaagcuuaccaugaagcuccuccccuccgucguccucaagcucuuccucgccgccguccucuccgcccucgucaccggcgagucccucgagcgccuccgccgcggccucgccgccggcaccuccaaccccgacccccccaccgucuccaccgaccagcuccucccccucggcggcggccgcgaccgcaagguccgcgaccuccaggaggccgaccucgaccuccuccgcgucacccucuccuccaagccccaggcccucgccacccccaacaaggaggagcacggcaagcgcaagaagaagggcaagggccucggcaagaagcgcgaccccugccuccgcaaguacaaggacuucugcauccacggcgagugcaaguacgucaaggagcuccgcgcccccuccugcaucugccaccccggcuaccacggcgagcgcugccacggccucucccuccccgucgagaaccgccucuacaccuacgaccacaccaccauccucgccgucgucgccgucguccucuccuccgucugccuccucgucaucgucggccuccucauguuccgcuaccaccgccgcggcggcuacgacgucgagaacgaggagaaggucaagcucggcaugaccaacucccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2828 - RNA, 2569 nt, Artificial Sequence
  mRNA product Design2 comprising derived and/or modified sequence from Homo sapiens__NP_000592.3__HsHGF (opt2)
ggggcgcugccuacggagguggcagccaucuccuucucggcaucaagcuuaccaugugggucaccaagcuccuccccgcccuccuccuccagcacguccuccuccaccuccuccuccuccccaucgccauccccuacgccgagggccagcgcaagcgccgcaacaccauccacgaguucaagaaguccgccaagaccacccucaucaagaucgaccccgcccucaagaucaagaccaagaaggucaacaccgccgaccagugcgccaaccgcugcacccgcaacaagggccuccccuucaccugcaaggccuucgucuucgacaaggcccgcaagcagugccucugguuccccuucaacuccauguccuccggcgucaagaaggaguucggccacgaguucgaccucuacgagaacaaggacuacauccgcaacugcaucaucggcaagggccgcuccuacaagggcaccgucuccaucaccaaguccggcaucaagugccagcccugguccuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccucauggaccacaccgaguccggcaagaucugccagcgcugggaccaccagaccccccaccgccacaaguuccuccccgagcgcuaccccgacaagggcuucgacgacaacuacugccgcaaccccgacggccagccccgccccuggugcuacacccucgacccccacacccgcugggaguacugcgccaucaagaccugcgccgacaacaccaugaacgacaccgacgucccccucgagaccaccgagugcauccagggccagggcgagggcuaccgcggcaccgucaacaccaucuggaacggcauccccugccagcgcugggacucccaguacccccacgagcacgacaugacccccgagaacuucaagugcaaggaccuccgcgagaacuacugccgcaaccccgacggcuccgagucccccuggugcuucaccaccgaccccaacauccgcgucggcuacugcucccagauccccaacugcgacaugucccacggccaggacugcuaccgcggcaacggcaagaacuacaugggcaaccucucccagacccgcuccggccucaccugcuccaugugggacaagaacauggaggaccuccaccgccacaucuucugggagcccgacgccuccaagcucaacgagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccgcaccaacaucggcuggauggucucccuccgcuaccgcaacaagcacaucugcggcggcucccucaucaaggaguccuggguccucaccgcccgccagugcuuccccucccgcgaccucaaggacuacgaggccuggcucggcauccacgacguccacggccgcggcgacgagaagugcaagcagguccucaacgucucccagcucgucuacggccccgagggcuccgaccucguccucaugaagcucgcccgccccgccguccucgacgacuucgucuccaccaucgaccuccccaacuacggcugcaccauccccgagaagaccuccugcuccgucuacggcuggggcuacaccggccucaucaacuacgacggccuccuccgcgucgcccaccucuacaucaugggcaacgagaagugcucccagcaccaccgcggcaaggucacccucaacgaguccgagaucugcgccggcgccgagaagaucggcuccggccccugcgagggcgacuacggcggcccccucgucugcgagcagcacaagaugcgcaugguccucggcgucaucguccccggccgcggcugcgccauccccaaccgccccggcaucuucguccgcgucgccuacuacgccaaguggauccacaagaucauccucaccuacaaggucccccaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2829 - RNA, 2308 nt, Artificial Sequence
  mRNA product Design2 comprising derived and/or modified sequence from Homo sapiens__NP_005336.3 __HsHSPA1A (opt2)
ggggcgcugccuacggagguggcagccaucuccuucucggcaucaagcuuaccauggccaaggccgccgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgcccucaacccccagaacaccgucuucgacgccaagcgccucaucggccgcaaguucggcgaccccgucguccaguccgacaugaagcacuggcccuuccaggucaucaacgacggcgacaagcccaagguccaggucuccuacaagggcgagaccaaggccuucuaccccgaggagaucuccuccaugguccucaccaagaugaaggagaucgccgaggccuaccucggcuaccccgucaccaacgccgucaucaccguccccgccuacuucaacgacucccagcgccaggccaccaaggacgccggcgucaucgccggccucaacguccuccgcaucaucaacgagcccaccgccgccgccaucgccuacggccucgaccgcaccggcaagggcgagcgcaacguccucaucuucgaccucggcggcggcaccuucgacgucuccauccucaccaucgacgacggcaucuucgaggucaaggccaccgccggcgacacccaccucggcggcgaggacuucgacaaccgccucgucaaccacuucgucgaggaguucaagcgcaagcacaagaaggacaucucccagaacaagcgcgccguccgccgccuccgcaccgccugcgagcgcgccaagcgcacccucuccuccuccacccaggccucccucgagaucgacucccucuucgagggcaucgacuucuacaccuccaucacccgcgcccgcuucgaggagcucugcuccgaccucuuccgcuccacccucgagcccgucgagaaggcccuccgcgacgccaagcucgacaaggcccagauccacgaccucguccucgucggcggcuccacccgcauccccaagguccagaagcuccuccaggacuucuucaacggccgcgaccucaacaaguccaucaaccccgacgaggccgucgccuacggcgccgccguccaggccgccauccucaugggcgacaaguccgagaacguccaggaccuccuccuccucgacgucgccccccucucccucggccucgagaccgccggcggcgucaugaccgcccucaucaagcgcaacuccaccauccccaccaagcagacccagaucuucaccaccuacuccgacaaccagcccggcguccucauccaggucuacgagggcgagcgcgccaugaccaaggacaacaaccuccucggccgcuucgagcucuccggcaucccccccgccccccgcggcgucccccagaucgaggucaccuucgacaucgacgccaacggcauccucaacgucaccgccaccgacaaguccaccggcaaggccaacaagaucaccaucaccaacgacaagggccgccucuccaaggaggagaucgagcgcaugguccaggaggccgagaaguacaaggccgaggacgagguccagcgcgagcgcgucuccgccaagaacgcccucgaguccuacgccuucaacaugaaguccgccgucgaggacgagggccucaagggcaagaucuccgaggccgacaagaagaagguccucgacaagugccaggaggucaucuccuggcucgacgccaacacccucgccgagaaggacgaguucgagcacaagcgcaaggagcucgagcaggucugcaaccccaucaucuccggccucuaccagggcgccggcggccccggccccggcggcuucggcgcccagggccccaagggcggcuccggcuccggccccaccaucgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2830 - RNA, 2308 nt, Artificial Sequence; identical to SEQ ID NO: 2829
  mRNA product Design2 comprising derived and/or modified sequence from Homo sapiens__NP_005337.2 __HsHSPA1B (opt2)

SEQ ID NO: 2831 - RNA, 2308 nt, Artificial Sequence
  mRNA product Design2 comprising derived and/or modified sequence from Homo sapiens__NP_005518.3 __HsHSPA1L (opt2)
ggggcgcugccuacggagguggcagccaucuccuucucggcaucaagcuuaccauggccaccgccaagggcaucgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaacccccagaacaccgucuucgacgccaagcgccucaucggccgcaaguucaacgaccccgucguccaggccgacaugaagcucuggcccuuccaggucaucaacgagggcggcaagcccaagguccucgucuccuacaagggcgagaacaaggccuucuaccccgaggagaucuccuccaugguccucaccaagcucaaggagaccgccgaggccuuccucggccaccccgucaccaacgccgucaucaccguccccgccuacuucaacgacucccagcgccaggccaccaaggacgccggcgucaucgccggccucaacguccuccgcaucaucaacgagcccaccgccgccgccaucgccuacggccucgacaagggcggccagggcgagcgccacguccucaucuucgaccucggcggcggcaccuucgacgucuccauccucaccaucgacgacggcaucuucgaggucaaggccaccgccggcgacacccaccucggcggcgaggacuucgacaaccgccucgucucccacuucgucgaggaguucaagcgcaagcacaagaaggacaucucccagaacaagcgcgccguccgccgccuccgcaccgccugcgagcgcgccaagcgcacccucuccuccuccacccaggccaaccucgagaucgacucccucuacgagggcaucgacuucuacaccuccaucacccgcgcccgcuucgaggagcucugcgccgaccucuuccgcggcacccucgagcccgucgagaaggcccuccgcgacgccaagauggacaaggccaagauccacgacaucguccucgucggcggcuccacccgcauccccaagguccagcgccuccuccaggacuacuucaacggccgcgaccucaacaaguccaucaaccccgacgaggccgucgccuacggcgccgccguccaggccgccauccucaugggcgacaaguccgagaagguccaggaccuccuccuccucgacgucgccccccucucccucggccucgagaccgccggcggcgucaugaccgcccucaucaagcgcaacuccaccauccccaccaagcagacccagaucuucaccaccuacuccgacaaccagcccggcguccucauccaggucuacgagggcgagcgcgccaugaccaaggacaacaaccuccucggccgcuucgaccucaccggcaucccccccgccccccgcggcgucccccagaucgaggucaccuucgacaucgacgccaacggcauccucaacgucaccgccaccgacaaguccaccggcaaggucaacaagaucaccaucaccaacgacaagggccgccucuccaaggaggagaucgagcgcaugguccucgacgccgagaaguacaaggccgaggacgagguccagcgcgagaagaucgccgccaagaacgcccucgaguccuacgccuucaacaugaaguccgucgucuccgacgagggccucaagggcaagaucuccgaguccgacaagaacaagauccucgacaagugcaacgagcuccucuccuggcucgaggucaaccagcucgccgagaaggacgaguucgaccacaagcgcaaggagcucgagcagaugugcaaccccaucaucaccaagcucuaccagggcggcugcaccggccccgccugcggcaccggcuacguccccggccgccccgccaccggccccaccaucgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2832 - RNA, 2302 nt, Artificial Sequence
  mRNA product Design2 comprising derived and/or modified sequence from Homo sapiens__NP_068814.2 __HsHSPA2 (opt2)
ggggcgcugccuacggagguggcagccaucuccuucucggcaucaagcuuaccauguccgcccgcggccccgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaaccccaccaacaccaucuucgacgccaagcgccucaucggccgcaaguucgaggacgccaccguccaguccgacaugaagcacuggcccuuccgcgucgucuccgagggcggcaagcccaagguccaggucgaguacaagggcgagaccaagaccuucuuccccgaggagaucuccuccaugguccucaccaagaugaaggagaucgccgaggccuaccucggcggcaagguccacuccgccgucaucaccguccccgccuacuucaacgacucccagcgccaggccaccaaggacgccggcaccaucaccggccucaacguccuccgcaucaucaacgagcccaccgccgccgccaucgccuacggccucgacaagaagggcugcgccggcggcgagaagaacguccucaucuucgaccucggcggcggcaccuucgacgucuccauccucaccaucgaggacggcaucuucgaggucaaguccaccgccggcgacacccaccucggcggcgaggacuucgacaaccgcauggucucccaccucgccgaggaguucaagcgcaagcacaagaaggacaucggccccaacaagcgcgccguccgccgccuccgcaccgccugcgagcgcgccaagcgcacccucuccuccuccacccaggccuccaucgagaucgacucccucuacgagggcgucgacuucuacaccuccaucacccgcgcccgcuucgaggagcucaacgccgaccucuuccgcggcacccucgagcccgucgagaaggcccuccgcgacgccaagcucgacaagggccagauccaggagaucguccucgucggcggcuccacccgcauccccaagauccagaagcuccuccaggacuucuucaacggcaaggagcucaacaaguccaucaaccccgacgaggccgucgccuacggcgccgccguccaggccgccauccucaucggcgacaaguccgagaacguccaggaccuccuccuccucgacgucaccccccucucccucggcaucgagaccgccggcggcgucaugaccccccucaucaagcgcaacaccaccauccccaccaagcagacccagaccuucaccaccuacuccgacaaccaguccuccguccucguccaggucuacgagggcgagcgcgccaugaccaaggacaacaaccuccucggcaaguucgaccucaccggcaucccccccgccccccgcggcgucccccagaucgaggucaccuucgacaucgacgccaacggcauccucaacgucaccgccgccgacaaguccaccggcaaggagaacaagaucaccaucaccaacgacaagggccgccucuccaaggacgacaucgaccgcaugguccaggaggccgagcgcuacaaguccgaggacgaggccaaccgcgaccgcgucgccgccaagaacgcccucgaguccuacaccuacaacaucaagcagaccgucgaggacgagaagcuccgcggcaagaucuccgagcaggacaagaacaagauccucgacaagugccaggaggucaucaacuggcucgaccgcaaccagauggccgagaaggacgaguacgagcacaagcagaaggagcucgagcgcgucugcaaccccaucaucuccaagcucuaccagggcggccccggcggcggcuccggcggcggcggcuccggcgccuccggcggccccaccaucgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2833 - RNA, 2905 nt, Artificial Sequence
  mRNA product Design2 comprising derived and/or modified sequence from Homo sapiens__NP_002145.3 __HsHSPA4 (opt2)
ggggcgcugccuacggagguggcagccaucuccuucucggcaucaagcuuaccauguccgucgucggcaucgaccucggcuuccaguccugcuacgucgccgucgcccgcgccggcggcaucgagaccaucgccaacgaguacuccgaccgcugcacccccgccugcaucuccuucggccccaagaaccgcuccaucggcgccgccgccaagucccaggucaucuccaacgccaagaacaccguccagggcuucaagcgcuuccacggccgcgccuucuccgaccccuucgucgaggccgagaaguccaaccucgccuacgacaucguccagcuccccaccggccucaccggcaucaaggucaccuacauggaggaggagcgcaacuucaccaccgagcaggucaccgccaugcuccucuccaagcucaaggagaccgccgaguccguccucaagaagcccgucgucgacugcgucgucuccguccccugcuucuacaccgacgccgagcgccgcuccgucauggacgccacccagaucgccggccucaacugccuccgccucaugaacgagaccaccgccgucgcccucgccuacggcaucuacaagcaggaccuccccgcccucgaggagaagccccgcaacgucgucuucgucgacaugggccacuccgccuaccaggucuccgucugcgccuucaaccgcggcaagcucaagguccucgccaccgccuucgacaccacccucggcggccgcaaguucgacgagguccucgucaaccacuucugcgaggaguucggcaagaaguacaagcucgacaucaaguccaagauccgcgcccuccuccgccucucccaggagugcgagaagcucaagaagcucauguccgccaacgccuccgaccucccccucuccaucgagugcuucaugaacgacgucgacgucuccggcaccaugaaccgcggcaaguuccucgagaugugcaacgaccuccucgcccgcgucgagcccccccuccgcuccguccucgagcagaccaagcucaagaaggaggacaucuacgccgucgagaucgucggcggcgccacccgcauccccgccgucaaggagaagaucuccaaguucuucggcaaggagcucuccaccacccucaacgccgacgaggccgucacccgcggcugcgcccuccagugcgccauccucucccccgccuucaagguccgcgaguucuccaucaccgacgucguccccuaccccaucucccuccgcuggaacucccccgccgaggagggcuccuccgacugcgaggucuucuccaagaaccacgccgcccccuucuccaagguccucaccuucuaccgcaaggagcccuucacccucgaggccuacuacuccuccccccaggaccuccccuaccccgaccccgccaucgcccaguucuccguccagaaggucaccccccaguccgacggcuccuccuccaaggucaaggucaagguccgcgucaacguccacggcaucuucuccgucuccuccgccucccucgucgagguccacaaguccgaggagaacgaggagcccauggagaccgaccagaacgccaaggaggaggagaagaugcaggucgaccaggaggagccccacgucgaggagcagcagcagcagacccccgccgagaacaaggccgaguccgaggagauggagaccucccaggccggcuccaaggacaagaagauggaccagcccccccaggccaagaaggccaaggucaagaccuccaccgucgaccuccccaucgagaaccagcuccucuggcagaucgaccgcgagaugcucaaccucuacaucgagaacgagggcaagaugaucaugcaggacaagcucgagaaggagcgcaacgacgccaagaacgccgucgaggaguacgucuacgagaugcgcgacaagcucuccggcgaguacgagaaguucgucuccgaggacgaccgcaacuccuucacccucaagcucgaggacaccgagaacuggcucuacgaggacggcgaggaccagcccaagcaggucuacgucgacaagcucgccgagcucaagaaccucggccagcccaucaagauccgcuuccaggaguccgaggagcgccccaagcucuucgaggagcucggcaagcagauccagcaguacaugaagaucaucuccuccuucaagaacaaggaggaccaguacgaccaccucgacgccgccgacaugaccaaggucgagaaguccaccaacgaggccauggaguggaugaacaacaagcucaaccuccagaacaagcagucccucaccauggaccccgucgucaaguccaaggagaucgaggccaagaucaaggagcucaccuccaccugcucccccaucaucuccaagcccaagcccaaggucgagccccccaaggaggagcagaagaacgccgagcagaacggccccgucgacggccagggcgacaaccccggcccccaggccgccgagcagggcaccgacaccgccguccccuccgacuccgacaagaagcuccccgagauggacaucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2834 - RNA, 2902 nt, Artificial Sequence
  mRNA product Design2 comprising derived and/or modified sequence from Homo sapiens__NP_055093.2 __HsHSPA4L (opt2)
ggggcgcugccuacggagguggcagccaucuccuucucggcaucaagcuuaccauguccgucgucggcaucgaccucggcuuccucaacugcuacaucgccgucgcccgcuccggcggcaucgagaccaucgccaacgaguacuccgaccgcugcacccccgccugcaucucccucggcucccgcacccgcgccaucggcaacgccgccaagucccagaucgucaccaacguccgcaacaccauccacggcuucaagaagcuccacggccgcuccuucgacgaccccaucguccagaccgagcgcauccgccuccccuacgagcuccagaagaugcccaacggcuccgccggcgucaagguccgcuaccucgaggaggagcgccccuucgccaucgagcaggucaccggcaugcuccucgccaagcucaaggagaccuccgagaacgcccucaagaagcccgucgccgacugcgucaucuccauccccuccuucuucaccgacgccgagcgccgcuccgucauggccgccgcccaggucgccggccucaacugccuccgccucaugaacgagaccaccgccgucgcccucgccuacggcaucuacaagcaggaccuccccccccucgacgagaagccccgcaacgucgucuucaucgacaugggccacuccgccuaccagguccucgucugcgccuucaacaagggcaagcucaagguccucgccaccaccuucgaccccuaccucggcggccgcaacuucgacgaggcccucgucgacuacuucugcgacgaguucaagaccaaguacaagaucaacgucaaggagaacucccgcgcccuccuccgccucuaccaggagugcgagaagcucaagaagcucauguccgccaacgccuccgaccucccccucaacaucgagugcuucaugaacgaccucgacgucuccuccaagaugaaccgcgcccaguucgagcagcucugcgccucccuccucgcccgcgucgagcccccccucaaggccgucauggagcaggccaaccuccagcgcgaggacaucuccuccaucgagaucgucggcggcgccacccgcauccccgccgucaaggagcagaucaccaaguucuuccucaaggacaucuccaccacccucaacgccgacgaggccgucgcccgcggcugcgcccuccagugcgccauccucucccccgccuucaagguccgcgaguucuccaucaccgaccucguccccuacuccaucacccuccgcuggaagaccuccuucgaggacggcuccggcgagugcgaggucuucugcaagaaccaccccgcccccuucuccaaggucaucaccuuccacaagaaggagcccuucgagcucgaggccuucuacaccaaccuccacgagguccccuaccccgacgcccgcaucggcuccuucaccauccagaacgucuucccccaguccgacggcgacuccuccaaggucaaggucaagguccgcgucaacauccacggcaucuucuccgucgccuccgccuccgucaucgagaagcagaaccucgagggcgaccacuccgacgcccccauggagaccgagaccuccuucaagaacgagaacaaggacaacauggacaagaugcaggucgaccaggaggagggccaccagaagugccacgccgagcacacccccgaggaggagaucgaccacaccggcgccaagaccaaguccgccgucuccgacaagcaggaccgccucaaccagacccucaagaagggcaaggucaaguccaucgaccuccccauccaguccucccucugccgccagcucggccaggaccuccucaacuccuacaucgagaacgagggcaagaugaucaugcaggacaagcucgagaaggagcgcaacgacgccaagaacgccgucgaggaguacgucuacgacuuccgcgaccgccucggcaccgucuacgagaaguucaucacccccgaggaccucuccaagcucuccgccguccucgaggacaccgagaacuggcucuacgaggacggcgaggaccagcccaagcaggucuacgucgacaagcuccaggagcucaagaaguacggccagcccauccagaugaaguacauggagcacgaggagcgccccaaggcccucaacgaccucggcaagaagauccagcucgucaugaaggucaucgaggccuaccgcaacaaggacgagcgcuacgaccaccucgaccccaccgagauggagaaggucgagaagugcaucuccgacgccauguccuggcucaacuccaagaugaacgcccagaacaagcucucccucacccaggaccccgucgucaaggucuccgagaucgucgccaaguccaaggagcucgacaacuucugcaaccccaucaucuacaagcccaagcccaaggccgagguccccgaggacaagcccaaggccaacuccgagcacaacggccccauggacggccaguccggcaccgagaccaaguccgacuccaccaaggacuccucccagcacaccaaguccuccggcgagauggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2835 - RNA, 2347 nt, Artificial Sequence
  mRNA product Design2 comprising derived and/or modified sequence from Homo sapiens__NP_005338.1__HsHSPA5 (opt2)
ggggcgcugccuacggagguggcagccaucuccuucucggcaucaagcuuaccaugaagcucucccucgucgccgccaugcuccuccuccucuccgccgcccgcgccgaggaggaggacaagaaggaggacgucggcaccgucgucggcaucgaccucggcaccaccuacuccugcgucggcgucuucaagaacggccgcgucgagaucaucgccaacgaccagggcaaccgcaucacccccuccuacgucgccuucacccccgagggcgagcgccucaucggcgacgccgccaagaaccagcucaccuccaaccccgagaacaccgucuucgacgccaagcgccucaucggccgcaccuggaacgaccccuccguccagcaggacaucaaguuccuccccuucaaggucgucgagaagaagaccaagcccuacauccaggucgacaucggcggcggccagaccaagaccuucgcccccgaggagaucuccgccaugguccucaccaagaugaaggagaccgccgaggccuaccucggcaagaaggucacccacgccgucgucaccguccccgccuacuucaacgacgcccagcgccaggccaccaaggacgccggcaccaucgccggccucaacgucaugcgcaucaucaacgagcccaccgccgccgccaucgccuacggccucgacaagcgcgagggcgagaagaacauccucgucuucgaccucggcggcggcaccuucgacgucucccuccucaccaucgacaacggcgucuucgaggucgucgccaccaacggcgacacccaccucggcggcgaggacuucgaccagcgcgucauggagcacuucaucaagcucuacaagaagaagaccggcaaggacguccgcaaggacaaccgcgccguccagaagcuccgccgcgaggucgagaaggccaagcgcgcccucuccucccagcaccaggcccgcaucgagaucgaguccuucuacgagggcgaggacuucuccgagacccucacccgcgccaaguucgaggagcucaacauggaccucuuccgcuccaccaugaagcccguccagaagguccucgaggacuccgaccucaagaaguccgacaucgacgagaucguccucgucggcggcuccacccgcauccccaagauccagcagcucgucaaggaguucuucaacggcaaggagcccucccgcggcaucaaccccgacgaggccgucgccuacggcgccgccguccaggccggcguccucuccggcgaccaggacaccggcgaccucguccuccucgacgucugcccccucacccucggcaucgagaccgucggcggcgucaugaccaagcucaucccccgcaacaccgucguccccaccaagaagucccagaucuucuccaccgccuccgacaaccagcccaccgucaccaucaaggucuacgagggcgagcgcccccucaccaaggacaaccaccuccucggcaccuucgaccucaccggcaucccccccgccccccgcggcgucccccagaucgaggucaccuucgagaucgacgucaacggcauccuccgcgucaccgccgaggacaagggcaccggcaacaagaacaagaucaccaucaccaacgaccagaaccgccucacccccgaggagaucgagcgcauggucaacgacgccgagaaguucgccgaggaggacaagaagcucaaggagcgcaucgacacccgcaacgagcucgaguccuacgccuacucccucaagaaccagaucggcgacaaggagaagcucggcggcaagcucuccuccgaggacaaggagaccauggagaaggccgucgaggagaagaucgaguggcucgagucccaccaggacgccgacaucgaggacuucaaggccaagaagaaggagcucgaggagaucguccagcccaucaucuccaagcucuacggcuccgccggccccccccccaccggcgaggaggacaccgccgagaaggacgagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2836 - RNA, 2314 nt, Artificial Sequence
  mRNA product Design2 comprising derived and/or modified sequence from Homo sapiens__NP_002146.2__HsHSPA6 (opt2)
ggggcgcugccuacggagguggcagccaucuccuucucggcaucaagcuuaccaugcaggccccccgcgagcucgccgucggcaucgaccucggcaccaccuacuccugcgucggcgucuuccagcagggccgcgucgagauccucgccaacgaccagggcaaccgcaccacccccuccuacgucgccuucaccgacaccgagcgccucgucggcgacgccgccaagucccaggccgcccucaacccccacaacaccgucuucgacgccaagcgccucaucggccgcaaguucgccgacaccaccguccaguccgacaugaagcacuggcccuuccgcgucgucuccgagggcggcaagcccaagguccgcgucugcuaccgcggcgaggacaagaccuucuaccccgaggagaucuccuccaugguccucuccaagaugaaggagaccgccgaggccuaccucggccagcccgucaagcacgccgucaucaccguccccgccuacuucaacgacucccagcgccaggccaccaaggacgccggcgccaucgccggccucaacguccuccgcaucaucaacgagcccaccgccgccgccaucgccuacggccucgaccgccgcggcgccggcgagcgcaacguccucaucuucgaccucggcggcggcaccuucgacgucuccguccucuccaucgacgccggcgucuucgaggucaaggccaccgccggcgacacccaccucggcggcgaggacuucgacaaccgccucgucaaccacuucauggaggaguuccgccgcaagcacggcaaggaccucuccggcaacaagcgcgcccuccgccgccuccgcaccgccugcgagcgcgccaagcgcacccucuccuccuccacccaggccacccucgagaucgacucccucuucgagggcgucgacuucuacaccuccaucacccgcgcccgcuucgaggagcucugcuccgaccucuuccgcuccacccucgagcccgucgagaaggcccuccgcgacgccaagcucgacaaggcccagauccacgacgucguccucgucggcggcuccacccgcauccccaagguccagaagcuccuccaggacuucuucaacggcaaggagcucaacaaguccaucaaccccgacgaggccgucgccuacggcgccgccguccaggccgccguccucaugggcgacaagugcgagaagguccaggaccuccuccuccucgacgucgccccccucucccucggccucgagaccgccggcggcgucaugaccacccucauccagcgcaacgccaccauccccaccaagcagacccagaccuucaccaccuacuccgacaaccagcccggcgucuucauccaggucuacgagggcgagcgcgccaugaccaaggacaacaaccuccucggccgcuucgagcucuccggcaucccccccgccccccgcggcgucccccagaucgaggucaccuucgacaucgacgccaacggcauccucuccgucaccgccaccgaccgcuccaccggcaaggccaacaagaucaccaucaccaacgacaagggccgccucuccaaggaggaggucgagcgcaugguccacgaggccgagcaguacaaggccgaggacgaggcccagcgcgaccgcgucgccgccaagaacucccucgaggcccacgucuuccacgucaagggcucccuccaggaggagucccuccgcgacaagauccccgaggaggaccgccgcaagaugcaggacaagugccgcgagguccucgccuggcucgagcacaaccagcucgccgagaaggaggaguacgagcaccagaagcgcgagcucgagcagaucugccgccccaucuucucccgccucuacggcggccccggcguccccggcggcuccuccugcggcacccaggcccgccagggcgaccccuccaccggccccaucaucgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2837 - RNA, 1486 nt, Artificial Sequence
  mRNA product Design2 comprising derived and/or modified sequence from Homo sapiens__P48741__HsHSPA7 (opt2)
ggggcgcugccuacggagguggcagccaucuccuucucggcaucaagcuuaccaugcaggccccccgcgagcucgccgucggcaucgaccucggcaccaccuacuccugcgucggcgucuuccagcagggccgcgucgagauccucgccaacgaccagggcaaccgcaccacccccuccuacgucgccuucaccgacaccgagcgccucgucggcgacgccgccaagucccaggccgcccucaacccccacaacaccgucuucgacgccaagcgccucaucggccgcaaguucgccgacaccaccguccaguccgacaugaagcacuggcccuuccaggucgucuccgagggcggcaagcccaagguccgcgucugcuaccgcggcgaggacaagaccuucuaccccgaggagaucuccuccaugguccucuccaagaugaaggagaccgccgaggccuaccucggccagcccgucaagcacgccgucaucaccguccccaccuacuucuccaacucccagcgccaggccaccaaggacgccggcgccaucgccggccucaagguccuccccaucaucaacgaggccaccgccgccgccaucgccuacggccucgaccgccgcggcgccggcaagcgcaacguccucaucuucgaccucggcggcggcaccuucgacgucuccguccucuccaucgacgccggcgucuucgaggucaaggccaccgccggcgacacccaccucggcggcgaggacuucgacaaccgccucgucaaccacuucauggaggaguuccgccgcaagcacggcaaggaccucuccggcaacaagcgcgcccuccgccgccuccgcaccgccugcgagcgcgccaagcgcacccccuccuccuccacccaggccacccucgagaucgacucccucuucgagggcgucgacuucuacaaguccaucacccgcgcccgcuucgaggagcucugcuccgaccucuuccgcuccacccucgagcccgucgagaaggcccuccgcgacgccaagcucgacaaggcccagauccacgacuucguccucggcggcggccuccacucccacccccagggcgccgaggucgccgccggccuccuccagcgccagggcgccgagcaggagcaccagcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2838 - RNA, 2323 nt, Artificial Sequence
  mRNA product Design2 comprising derived and/or modified sequence from Homo sapiens__NP_006588.1 __HsHSPA8 (opt2)
ggggcgcugccuacggagguggcagccaucuccuucucggcaucaagcuuaccauguccaagggccccgccgucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaaccccaccaacaccgucuucgacgccaagcgccucaucggccgccgcuucgacgacgccgucguccaguccgacaugaagcacuggcccuucauggucgucaacgacgccggccgccccaagguccaggucgaguacaagggcgagaccaaguccuucuaccccgaggaggucuccuccaugguccucaccaagaugaaggagaucgccgaggccuaccucggcaagaccgucaccaacgccgucgucaccguccccgccuacuucaacgacucccagcgccaggccaccaaggacgccggcaccaucgccggccucaacguccuccgcaucaucaacgagcccaccgccgccgccaucgccuacggccucgacaagaaggucggcgccgagcgcaacguccucaucuucgaccucggcggcggcaccuucgacgucuccauccucaccaucgaggacggcaucuucgaggucaaguccaccgccggcgacacccaccucggcggcgaggacuucgacaaccgcauggucaaccacuucaucgccgaguucaagcgcaagcacaagaaggacaucuccgagaacaagcgcgccguccgccgccuccgcaccgccugcgagcgcgccaagcgcacccucuccuccuccacccaggccuccaucgagaucgacucccucuacgagggcaucgacuucuacaccuccaucacccgcgcccgcuucgaggagcucaacgccgaccucuuccgcggcacccucgaccccgucgagaaggcccuccgcgacgccaagcucgacaagucccagauccacgacaucguccucgucggcggcuccacccgcauccccaagauccagaagcuccuccaggacuucuucaacggcaaggagcucaacaaguccaucaaccccgacgaggccgucgccuacggcgccgccguccaggccgccauccucuccggcgacaaguccgagaacguccaggaccuccuccuccucgacgucaccccccucucccucggcaucgagaccgccggcggcgucaugaccguccucaucaagcgcaacaccaccauccccaccaagcagacccagaccuucaccaccuacuccgacaaccagcccggcguccucauccaggucuacgagggcgagcgcgccaugaccaaggacaacaaccuccucggcaaguucgagcucaccggcaucccccccgccccccgcggcgucccccagaucgaggucaccuucgacaucgacgccaacggcauccucaacgucuccgccgucgacaaguccaccggcaaggagaacaagaucaccaucaccaacgacaagggccgccucuccaaggaggacaucgagcgcaugguccaggaggccgagaaguacaaggccgaggacgagaagcagcgcgacaaggucuccuccaagaacucccucgaguccuacgccuucaacaugaaggccaccgucgaggacgagaagcuccagggcaagaucaacgacgaggacaagcagaagauccucgacaagugcaacgagaucaucaacuggcucgacaagaaccagaccgccgagaaggaggaguucgagcaccagcagaaggagcucgagaaggucugcaaccccaucaucaccaagcucuaccaguccgccggcggcaugcccggcggcaugcccggcggcuuccccggcggcggcgccccccccuccggcggcgccuccuccggccccaccaucgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2839 - RNA, 2422 nt, Artificial Sequence
  mRNA product Design2 comprising derived and/or modified sequence from Homo sapiens__NP_004125.3 __HsHSPA9 (opt2)
ggggcgcugccuacggagguggcagccaucuccuucucggcaucaagcuuaccaugaucuccgccucccgcgccgccgccgcccgccucgucggcgccgccgccucccgcggccccaccgccgcccgccaccaggacuccuggaacggccucucccacgaggccuuccgccucgucucccgccgcgacuacgccuccgaggccaucaagggcgccgucgucggcaucgaccucggcaccaccaacuccugcgucgccgucauggagggcaagcaggccaagguccucgagaacgccgagggcgcccgcaccacccccuccgucgucgccuucaccgccgacggcgagcgccucgucggcaugcccgccaagcgccaggccgucaccaaccccaacaacaccuucuacgccaccaagcgccucaucggccgccgcuacgacgaccccgagguccagaaggacaucaagaacguccccuucaagaucguccgcgccuccaacggcgacgccugggucgaggcccacggcaagcucuacucccccucccagaucggcgccuucguccucaugaagaugaaggagaccgccgagaacuaccucggccacaccgccaagaacgccgucaucaccguccccgccuacuucaacgacucccagcgccaggccaccaaggacgccggccagaucuccggccucaacguccuccgcgucaucaacgagcccaccgccgccgcccucgccuacggccucgacaaguccgaggacaaggucaucgccgucuacgaccucggcggcggcaccuucgacaucuccauccucgagauccagaagggcgucuucgaggucaaguccaccaacggcgacaccuuccucggcggcgaggacuucgaccaggcccuccuccgccacaucgucaaggaguucaagcgcgagaccggcgucgaccucaccaaggacaacauggcccuccagcgcguccgcgaggccgccgagaaggccaagugcgagcucuccuccuccguccagaccgacaucaaccuccccuaccucaccauggacuccuccggccccaagcaccucaacaugaagcucacccgcgcccaguucgagggcaucgucaccgaccucauccgccgcaccaucgcccccugccagaaggccaugcaggacgccgaggucuccaaguccgacaucggcgaggucauccucgucggcggcaugacccgcaugcccaagguccagcagaccguccaggaccucuucggccgcgcccccuccaaggccgucaaccccgacgaggccgucgccaucggcgccgccauccagggcggcguccucgccggcgacgucaccgacguccuccuccucgacgucaccccccucucccucggcaucgagacccucggcggcgucuucaccaagcucaucaaccgcaacaccaccauccccaccaagaagucccaggucuucuccaccgccgccgacggccagacccaggucgagaucaaggucugccagggcgagcgcgagauggccggcgacaacaagcuccucggccaguucacccucaucggcaucccccccgccccccgcggcgucccccagaucgaggucaccuucgacaucgacgccaacggcaucguccacgucuccgccaaggacaagggcaccggccgcgagcagcagaucgucauccaguccuccggcggccucuccaaggacgacaucgagaacauggucaagaacgccgagaaguacgccgaggaggaccgccgcaagaaggagcgcgucgaggccgucaacauggccgagggcaucauccacgacaccgagaccaagauggaggaguucaaggaccagcuccccgccgacgagugcaacaagcucaaggaggagaucuccaagaugcgcgagcuccucgcccgcaaggacuccgagaccggcgagaacauccgccaggccgccuccucccuccagcaggccucccucaagcucuucgagauggccuacaagaagauggccuccgagcgcgagggcuccggcuccuccggcaccggcgagcagaaggaggaccagaaggaggagaagcagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2840 - RNA, 2410 nt, Artificial Sequence
  mRNA product Design2 comprising derived and/or modified sequence from Homo sapiens__NP_079291.2__HsHSPA12A (opt2)
ggggcgcugccuacggagguggcagccaucuccuucucggcaucaagcuuaccauggccgacaaggaggccggcggcuccgacggcccccgcgagaccgcccccaccuccgccuacuccucccccgcccgcucccucggcgacaccggcaucaccccccucucccccucccacaucgucaacgacaccgacuccaacgucuccgagcagcaguccuuccucgucgucgucgccgucgacuucggcaccaccuccuccggcuacgccuacuccuucaccaaggagcccgagugcauccacgucaugcgccgcugggagggcggcgaccccggcgucuccaaccagaagacccccaccaccauccuccucacccccgagcgcaaguuccacuccuucggcuacgccgcccgcgacuucuaccacgaccucgaccccaacgaggccaagcaguggcucuaccucgagaaguucaagaugaagcuccacaccaccggcgaccucaccauggacaccgaccucaccgccgccaacggcaagaaggucaaggcccucgagaucuucgccuacgcccuccaguacuucaaggagcaggcccucaaggagcucuccgaccaggccggcuccgaguucgagaacuccgacguccgcugggucaucaccguccccgccaucuggaagcagcccgccaagcaguucaugcgccaggccgccuaccaggccggccucgccucccccgagaacuccgagcagcucaucaucgcccucgagcccgaggccgccuccaucuacugccgcaagcuccgccuccaccagaugaucgagcucuccuccaaggccgccgucaacggcuacuccggcuccgacaccgucggcgccggcuucacccaggccaaggagcacauccgccgcaaccgccagucccgcaccuuccucgucgagaacgucaucggcgagaucugguccgagcucgaggagggcgacaaguacgucgucgucgacuccggcggcggcaccgucgaccucaccguccaccagauccgccuccccgagggccaccucaaggagcucuacaaggccaccggcggccccuacggcucccucggcgucgacuacgaguucgagaagcuccucuacaagaucuucggcgaggacuucaucgagcaguucaagaucaagcgccccgccgccugggucgaccucaugaucgccuucgagucccgcaagcgcgccgccgcccccgaccgcaccaacccccucaacaucacccuccccuucuccuucaucgacuacuacaagaaguuccgcggccacuccgucgagcacgcccuccgcaaguccaacgucgacuucgucaagugguccucccagggcaugcuccgcaugucccccgacgccaugaacgcccucuucaagcccaccaucgacuccaucaucgagcaccuccgcgaccucuuccagaagcccgaggucuccaccgucaaguuccucuuccucgucggcggcuucgccgaggccccccuccuccagcaggccguccaggccgccuucggcgaccagugccgcaucaucaucccccaggacgucggccucaccauccucaagggcgccguccucuucggccucgaccccgccgucaucaagguccgccgcuccccccucaccuacggcgucggcguccucaaccgcuacgucgagggcaagcacccccccgagaagcuccucgucaaggacggcacccgcuggugcaccgacgucuucgacaaguucaucuccgccgaccaguccgucgcccucggcgagcucgucaagcgcuccuacacccccgccaagcccucccagcucgucaucgucaucaacaucuacuccuccgagcacgacaacgucuccuucaucaccgaccccggcgucaagaagugcggcacccuccgccucgaccucaccggcaccuccggcaccgccguccccgcccgccgcgagauccagacccucaugcaguucggcgacaccgagaucaaggccaccgccaucgacaucgccaccuccaaguccgucaaggucggcaucgacuuccucaacuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2841 - RNA, 2443 nt, Artificial Sequence
  mRNA product Design2 comprising derived and/or modified sequence from Homo sapiens__NP_443202.3 __HsHSPA12B (opt2)
ggggcgcugccuacggagguggcagccaucuccuucucggcaucaagcuuaccaugcucgccguccccgagaugggccuccagggccucuacaucggcuccucccccgagcgcucccccguccccuccccccccggcuccccccgcacccaggaguccugcggcaucgccccccucacccccucccagucccccaagcccgagguccgcgccccccagcaggccuccuucuccgucgucgucgccaucgacuucggcaccaccuccuccggcuacgccuucuccuucgccuccgaccccgaggccauccacaugaugcgcaagugggagggcggcgaccccggcgucgcccaccagaagacccccaccugccuccuccucacccccgagggcgccuuccacuccuucggcuacaccgcccgcgacuacuaccacgaccucgaccccgaggaggcccgcgacuggcucuacuucgagaaguucaagaugaagauccacuccgccaccgaccucacccucaagacccagcucgaggccgucaacggcaagaccaugcccgcccucgaggucuucgcccacgcccuccgcuucuuccgcgagcacgcccuccaggagcuccgcgagcagucccccucccuccccgagaaggacaccguccgcuggguccucaccguccccgccaucuggaagcagcccgccaagcaguucaugcgcgaggccgccuaccucgccggccucgucucccgcgagaacgccgagcagcuccucaucgcccucgagcccgaggccgccuccgucuacugccgcaagcuccgccuccaccagcuccucgaccucuccggccgcgcccccggcggcggccgccucggcgagcgccgcuccaucgacuccuccuuccgccaggcccgcgagcagcuccgccgcucccgccacucccgcaccuuccucgucgaguccggcgucggcgagcucugggccgagaugcaggccggcgaccgcuacgucgucgccgacugcggcggcggcaccgucgaccucaccguccaccagcucgagcagccccacggcacccucaaggagcucuacaaggccuccggcggccccuacggcgccgucggcgucgaccucgccuucgagcagcuccucugccgcaucuucggcgaggacuucaucgccaccuucaagcgccagcgccccgccgccugggucgaccucaccaucgccuucgaggcccgcaagcgcaccgccggcccccaccgcgccggcgcccucaacaucucccuccccuucuccuucaucgacuucuaccgcaagcagcgcggccacaacgucgagaccgcccuccgccgcuccuccgucaacuucgucaagugguccucccagggcaugcuccgcauguccugcgaggccaugaacgagcucuuccagcccaccgucuccggcaucauccagcacaucgaggcccuccucgcccgccccgagguccagggcgucaagcuccucuuccucgucggcggcuucgccgaguccgccguccuccagcacgccguccaggccgcccucggcgcccgcggccuccgcgucgucgucccccacgacgucggccucaccauccucaagggcgccguccucuucggccaggcccccggcgucguccgcguccgccgcuccccccucaccuacggcgucggcguccucaaccgcuucguccccggccgccacccccccgagaagcuccucguccgcgacggccgccgcuggugcaccgacgucuucgagcgcuucgucgccgccgagcaguccgucgcccucggcgaggagguccgccgcuccuacugccccgcccgccccggccagcgccgcguccucaucaaccucuacugcugcgccgccgaggacgcccgcuucaucaccgaccccggcguccgcaagugcggcgcccucucccucgagcucgagcccgccgacugcggccaggacaccgccggcgccccccccggccgccgcgagauccgcgccgccaugcaguucggcgacaccgagaucaaggucaccgccgucgacgucuccaccaaccgcuccguccgcgccuccaucgacuuccucuccaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2842 - RNA, 1798 nt, Artificial Sequence
  mRNA product Design2 comprising derived and/or modified sequence from Homo sapiens__NP_008879.3__HsHSPA13 (opt2)
ggggcgcugccuacggagguggcagccaucuccuucucggcaucaagcuuaccauggcccgcgagaugaccauccucggcuccgccguccucacccuccuccucgccggcuaccucgcccagcaguaccucccccuccccacccccaaggucaucggcaucgaccucggcaccaccuacugcuccgucggcgucuucuuccccggcaccggcaaggucaaggucauccccgacgagaacggccacaucuccauccccuccauggucuccuucaccgacaacgacgucuacgucggcuacgaguccgucgagcucgccgacuccaacccccagaacaccaucuacgacgccaagcgcuucaucggcaagaucuucaccgccgaggagcucgaggccgagaucggccgcuaccccuucaagguccucaacaagaacggcauggucgaguucuccgucaccuccaacgagaccaucaccgucucccccgaguacgucggcucccgccuccuccucaagcucaaggagauggccgaggccuaccucggcaugcccgucgccaacgccgucaucuccguccccgccgaguucgaccucaagcagcgcaacuccaccaucgaggccgccaaccucgccggccucaagauccuccgcgucaucaacgagcccaccgccgccgccauggccuacggccuccacaaggccgacgucuuccacguccucgucaucgaccucggcggcggcacccucgacgucucccuccucaacaagcagggcggcauguuccucacccgcgccauguccggcaacaacaagcucggcggccaggacuucaaccagcgccuccuccaguaccucuacaagcagaucuaccagaccuacggcuucguccccucccgcaaggaggagauccaccgccuccgccaggccgucgagauggucaagcucaaccucacccuccaccaguccgcccagcucuccguccuccucaccgucgaggagcaggaccgcaaggagccccacuccuccgacaccgagcuccccaaggacaagcucuccuccgccgacgaccaccgcgucaacuccggcuucggccgcggccucuccgacaagaaguccggcgagucccagguccucuucgagaccgagaucucccgcaagcucuucgacacccucaacgaggaccucuuccagaagauccucguccccauccagcagguccucaaggagggccaccucgagaagaccgagaucgacgaggucguccucgucggcggcuccacccgcaucccccgcauccgccaggucauccaggaguucuucggcaaggaccccaacaccuccgucgaccccgaccucgccgucgucaccggcgucgccauccaggccggcaucgacggcggcuccuggccccuccaggucuccgcccucgagauccccaacaagcaccuccagaagaccaacuucaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2843 - RNA, 1912 nt, Artificial Sequence
  mRNA product Design2 comprising derived and/or modified sequence from Homo sapiens__NP_057383.2__HsHSPA14 (opt2)
ggggcgcugccuacggagguggcagccaucuccuucucggcaucaagcuuaccauggccgccaucggcguccaccucggcugcaccuccgccugcgucgccgucuacaaggacggccgcgccggcgucgucgccaacgacgccggcgaccgcgucacccccgccgucgucgccuacuccgagaacgaggagaucgucggccucgccgccaagcagucccgcauccgcaacaucuccaacaccgucaugaaggucaagcagauccucggccgcuccuccuccgacccccaggcccagaaguacaucgccgaguccaagugccucgucaucgagaagaacggcaagcuccgcuacgagaucgacaccggcgaggagaccaaguucgucaaccccgaggacgucgcccgccucaucuucuccaagaugaaggagaccgcccacuccguccucggcuccgacgccaacgacgucgucaucaccguccccuucgacuucggcgagaagcagaagaacgcccucggcgaggccgcccgcgccgccggcuucaacguccuccgccucauccacgagcccuccgccgcccuccucgccuacggcaucggccaggacucccccaccggcaaguccaacauccucgucuucaagcucggcggcaccucccucucccucuccgucauggaggucaacuccggcaucuaccgcguccucuccaccaacaccgacgacaacaucggcggcgcccacuucaccgagacccucgcccaguaccucgccuccgaguuccagcgcuccuucaagcacgacguccgcggcaacgcccgcgccaugaugaagcucaccaacuccgccgaggucgccaagcacucccucuccacccucggcuccgccaacugcuuccucgacucccucuacgagggccaggacuucgacugcaacgucucccgcgcccgcuucgagcuccucugcuccccccucuucaacaagugcaucgaggccauccgcggccuccucgaccagaacggcuucaccgccgacgacaucaacaaggucguccucugcggcggcuccucccgcauccccaagcuccagcagcucaucaaggaccucuuccccgccgucgagcuccucaacuccaucccccccgacgaggucauccccaucggcgccgccaucgaggccggcauccucaucggcaaggagaaccuccucgucgaggacucccucaugaucgagugcuccgcccgcgacauccucgucaagggcgucgacgaguccggcgccucccgcuucaccguccucuuccccuccggcaccccccuccccgcccgccgccagcacacccuccaggcccccggcuccaucuccuccgucugccucgagcucuacgaguccgacggcaagaacuccgccaaggaggagaccaaguucgcccaggucguccuccaggaccucgacaagaaggagaacggccuccgcgacauccucgccguccucaccaugaagcgcgacggcucccuccacgucaccugcaccgaccaggagaccggcaagugcgaggccaucuccaucgagaucgccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2844 - RNA, 2959 nt, Artificial Sequence
  mRNA product Design2 comprising derived and/or modified sequence from Homo sapiens__NP_006635.2 __HsHSPH1 (opt2)
ggggcgcugccuacggagguggcagccaucuccuucucggcaucaagcuuaccauguccgucgucggccucgacgucggcucccaguccugcuacaucgccgucgcccgcgccggcggcaucgagaccaucgccaacgaguucuccgaccgcugcacccccuccgucaucuccuucggcuccaagaaccgcaccaucggcgucgccgccaagaaccagcagaucacccacgccaacaacaccgucuccaacuucaagcgcuuccacggccgcgccuucaacgaccccuucauccagaaggagaaggagaaccucuccuacgaccucgucccccucaagaacggcggcgucggcaucaaggucauguacaugggcgaggagcaccucuucuccgucgagcagaucaccgccaugcuccucaccaagcucaaggagaccgccgagaacucccucaagaagcccgucaccgacugcgucaucuccguccccuccuucuucaccgacgccgagcgccgcuccguccucgacgccgcccagaucgucggccucaacugccuccgccucaugaacgacaugaccgccgucgcccucaacuacggcaucuacaagcaggaccuccccucccucgacgagaagccccgcaucgucgucuucgucgacaugggccacuccgccuuccaggucuccgccugcgccuucaacaagggcaagcucaagguccucggcaccgccuucgaccccuuccucggcggcaagaacuucgacgagaagcucgucgagcacuucugcgccgaguucaagaccaaguacaagcucgacgccaaguccaagauccgcgcccuccuccgccucuaccaggagugcgagaagcucaagaagcucauguccuccaacuccaccgaccucccccucaacaucgagugcuucaugaacgacaaggacgucuccggcaagaugaaccgcucccaguucgaggagcucugcgccgagcuccuccagaagaucgaggucccccucuacucccuccucgagcagacccaccucaaggucgaggacgucuccgccgucgagaucgucggcggcgccacccgcauccccgccgucaaggagcgcaucgccaaguucuucggcaaggacaucuccaccacccucaacgccgacgaggccgucgcccgcggcugcgcccuccagugcgccauccucucccccgccuucaagguccgcgaguucuccgucaccgacgccguccccuuccccaucucccucaucuggaaccacgacuccgaggacaccgagggcguccacgaggucuucucccgcaaccacgccgcccccuucuccaagguccucaccuuccuccgccgcggccccuucgagcucgaggccuucuacuccgacccccagggcguccccuaccccgaggccaagaucggccgcuucgucguccagaacgucuccgcccagaaggacggcgagaagucccgcgucaaggucaagguccgcgucaacacccacggcaucuucaccaucuccaccgccuccauggucgagaagguccccaccgaggagaacgagauguccuccgaggccgacauggagugccucaaccagcgcccccccgagaaccccgacaccgacaagaacguccagcaggacaacuccgaggccggcacccagccccagguccagaccgacgcccagcagaccucccaguccccccccucccccgagcucaccuccgaggagaacaagauccccgacgccgacaaggccaacgagaagaaggucgaccagccccccgaggccaagaagcccaagaucaaggucgucaacgucgagcuccccaucgaggccaaccucgucuggcagcucggcaaggaccuccucaacauguacaucgagaccgagggcaagaugaucaugcaggacaagcucgagaaggagcgcaacgacgccaagaacgccgucgaggaguacgucuacgaguuccgcgacaagcucugcggccccuacgagaaguucaucugcgagcaggaccaccagaacuuccuccgccuccucaccgagaccgaggacuggcucuacgaggagggcgaggaccaggccaagcaggccuacgucgacaagcucgaggagcucaugaagaucggcacccccgucaagguccgcuuccaggaggccgaggagcgccccaagauguucgaggagcucggccagcgccuccagcacuacgccaagaucgccgccgacuuccgcaacaaggacgagaaguacaaccacaucgacgaguccgagaugaagaaggucgagaaguccgucaacgaggucauggaguggaugaacaacgucaugaacgcccaggccaagaagucccucgaccaggaccccgucguccgcgcccaggagaucaagaccaagaucaaggagcucaacaacaccugcgagcccgucgucacccagcccaagcccaagaucgagucccccaagcucgagcgcacccccaacggccccaacaucgacaagaaggaggaggaccucgaggacaagaacaacuucggcgccgagcccccccaccagaacggcgagugcuaccccaacgagaagaacuccgucaacauggaccucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2845 - RNA, 3382 nt, Artificial Sequence
  mRNA product Design2 comprising derived and/or modified sequence from Homo sapiens__NP_006380.1 __HsHYOU1 (opt2)
ggggcgcugccuacggagguggcagccaucuccuucucggcaucaagcuuaccauggccgacaagguccgccgccagcgcccccgccgccgcgucugcugggcccucgucgccguccuccucgccgaccuccucgcccucuccgacacccucgccgucauguccgucgaccucggcuccgaguccaugaaggucgccaucgucaagcccggcguccccauggagaucguccucaacaaggagucccgccgcaagacccccgucaucgucacccucaaggagaacgagcgcuucuucggcgacuccgccgccuccauggccaucaagaaccccaaggccacccuccgcuacuuccagcaccuccucggcaagcaggccgacaacccccacgucgcccucuaccaggcccgcuuccccgagcacgagcucaccuucgacccccagcgccagaccguccacuuccagaucuccucccagcuccaguucucccccgaggagguccucggcaugguccucaacuacucccgcucccucgccgaggacuucgccgagcagcccaucaaggacgccgucaucaccguccccgucuucuucaaccaggccgagcgccgcgccguccuccaggccgcccgcauggccggccucaagguccuccagcucaucaacgacaacaccgccaccgcccucuccuacggcgucuuccgccgcaaggacaucaacaccaccgcccagaacaucauguucuacgacaugggcuccggcuccaccgucugcaccaucgucaccuaccagauggucaagaccaaggaggccggcaugcagccccagcuccagauccgcggcgucggcuucgaccgcacccucggcggccucgagauggagcuccgccuccgcgagcgccucgccggccucuucaacgagcagcgcaagggccagcgcgccaaggacguccgcgagaacccccgcgccauggccaagcuccuccgcgaggccaaccgccucaagaccguccucuccgccaacgccgaccacauggcccagaucgagggccucauggacgacgucgacuucaaggccaaggucacccgcgucgaguucgaggagcucugcgccgaccucuucgagcgcguccccggccccguccagcaggcccuccaguccgccgagaugucccucgacgagaucgagcaggucauccucgucggcggcgccacccgcgucccccgcguccaggagguccuccucaaggccgucggcaaggaggagcucggcaagaacaucaacgccgacgaggccgccgccaugggcgccgucuaccaggccgccgcccucuccaaggccuucaaggucaagcccuucgucguccgcgacgccgucgucuaccccauccucgucgaguucacccgcgaggucgaggaggagcccggcauccacucccucaagcacaacaagcgcguccucuucucccgcaugggccccuacccccagcgcaaggucaucaccuucaaccgcuacucccacgacuucaacuuccacaucaacuacggcgaccucggcuuccucggccccgaggaccuccgcgucuucggcucccagaaccucaccaccgucaagcucaagggcgucggcgacuccuucaagaaguaccccgacuacgaguccaagggcaucaaggcccacuucaaccucgacgaguccggcguccucucccucgaccgcgucgaguccgucuucgagacccucgucgaggacuccgccgaggaggaguccacccucaccaagcucggcaacaccaucuccucccucuucggcggcggcaccacccccgacgccaaggagaacggcaccgacaccguccaggaggaggaggagucccccgccgagggcuccaaggacgagcccggcgagcaggucgagcucaaggaggaggccgaggcccccgucgaggacggcucccagccccccccccccgagcccaagggcgacgccacccccgagggcgagaaggccaccgagaaggagaacggcgacaaguccgaggcccagaagcccuccgagaaggccgaggccggccccgagggcgucgcccccgcccccgagggcgagaagaagcagaagcccgcccgcaagcgccgcauggucgaggagaucggcgucgagcucgucguccucgaccuccccgaccuccccgaggacaagcucgcccaguccguccagaagcuccaggaccucacccuccgcgaccucgagaagcaggagcgcgagaaggccgccaacucccucgaggccuucaucuucgagacccaggacaagcucuaccagcccgaguaccaggaggucuccaccgaggagcagcgcgaggagaucuccggcaagcucuccgccgccuccaccuggcucgaggacgagggcgucggcgccaccaccgucaugcucaaggagaagcucgccgagcuccgcaagcucugccagggccucuucuuccgcgucgaggagcgcaagaaguggcccgagcgccucuccgcccucgacaaccuccucaaccacuccuccauguuccucaagggcgcccgccucauccccgagauggaccagaucuucaccgaggucgagaugaccacccucgagaaggucaucaacgagaccugggccuggaagaacgccacccucgccgagcaggccaagcuccccgccaccgagaagcccguccuccucuccaaggacaucgaggccaagaugauggcccucgaccgcgagguccaguaccuccucaacaaggccaaguucaccaagccccgcccccgccccaaggacaagaacggcacccgcgccgagcccccccucaacgccuccgccuccgaccagggcgagaaggucaucccccccgccggccagaccgaggacgccgagcccaucuccgagcccgagaaggucgagaccggcuccgagcccggcgacaccgagccccucgagcucggcggccccggcgccgagcccgagcagaaggagcaguccaccggccagaagcgcccccucaagaacgacgagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2846 - RNA, 2581 nt, Artificial Sequence
  mRNA product Design2 comprising derived and/or modified sequence from Homo sapiens__NP_005339.3 __HsHSP90AA1 (opt2)
ggggcgcugccuacggagguggcagccaucuccuucucggcaucaagcuuaccaugcccgaggagacccagacccaggaccagcccauggaggaggaggaggucgagaccuucgccuuccaggccgagaucgcccagcucaugucccucaucaucaacaccuucuacuccaacaaggagaucuuccuccgcgagcucaucuccaacuccuccgacgcccucgacaagauccgcuacgagucccucaccgaccccuccaagcucgacuccggcaaggagcuccacaucaaccucauccccaacaagcaggaccgcacccucaccaucgucgacaccggcaucggcaugaccaaggccgaccucaucaacaaccucggcaccaucgccaaguccggcaccaaggccuucauggaggcccuccaggccggcgccgacaucuccaugaucggccaguucggcgucggcuucuacuccgccuaccucgucgccgagaaggucaccgucaucaccaagcacaacgacgacgagcaguacgccugggaguccuccgccggcggcuccuucaccguccgcaccgacaccggcgagcccaugggccgcggcaccaaggucauccuccaccucaaggaggaccagaccgaguaccucgaggagcgccgcaucaaggagaucgucaagaagcacucccaguucaucggcuaccccaucacccucuucgucgagaaggagcgcgacaaggaggucuccgacgacgaggccgaggagaaggaggacaaggaggaggagaaggagaaggaggagaaggaguccgaggacaagcccgagaucgaggacgucggcuccgacgaggaggaggagaagaaggacggcgacaagaagaagaagaagaagaucaaggagaaguacaucgaccaggaggagcucaacaagaccaagcccaucuggacccgcaaccccgacgacaucaccaacgaggaguacggcgaguucuacaagucccucaccaacgacugggaggaccaccucgccgucaagcacuucuccgucgagggccagcucgaguuccgcgcccuccucuucgucccccgccgcgcccccuucgaccucuucgagaaccgcaagaagaagaacaacaucaagcucuacguccgccgcgucuucaucauggacaacugcgaggagcucauccccgaguaccucaacuucauccgcggcgucgucgacuccgaggaccucccccucaacaucucccgcgagaugcuccagcaguccaagauccucaaggucauccgcaagaaccucgucaagaagugccucgagcucuucaccgagcucgccgaggacaaggagaacuacaagaaguucuacgagcaguucuccaagaacaucaagcucggcauccacgaggacucccagaaccgcaagaagcucuccgagcuccuccgcuacuacaccuccgccuccggcgacgagauggucucccucaaggacuacugcacccgcaugaaggagaaccagaagcacaucuacuacaucaccggcgagaccaaggaccaggucgccaacuccgccuucgucgagcgccuccgcaagcacggccucgaggucaucuacaugaucgagcccaucgacgaguacugcguccagcagcucaaggaguucgagggcaagacccucgucuccgucaccaaggagggccucgagcuccccgaggacgaggaggagaagaagaagcaggaggagaagaagaccaaguucgagaaccucugcaagaucaugaaggacauccucgagaagaaggucgagaaggucgucgucuccaaccgccucgucaccucccccugcugcaucgucaccuccaccuacggcuggaccgccaacauggagcgcaucaugaaggcccaggcccuccgcgacaacuccaccaugggcuacauggccgccaagaagcaccucgagaucaaccccgaccacuccaucaucgagacccuccgccagaaggccgaggccgacaagaacgacaaguccgucaaggaccucgucauccuccucuacgagaccgcccuccucuccuccggcuucucccucgaggacccccagacccacgccaaccgcaucuaccgcaugaucaagcucggccucggcaucgacgaggacgaccccaccgccgacgacaccuccgccgccgucaccgaggagaugcccccccucgagggcgacgacgacaccucccgcauggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2847 - RNA, 721 nt, Artificial Sequence
  mRNA product Design2 comprising derived and/or modified sequence from Homo sapiens__NG_005218__HsHSP90AA3P (opt2)
ggggcgcugccuacggagguggcagccaucuccuucucggcaucaagcuuaccauggacuccuccaagcucgacuccggcaagggccuccacaucaaccucguccccaacaagcagaaccagacccucaccaucgucgacacccgcaucggcaugaccaagaccgaccucaucaacaaccucggcaccgucaccaaguccggcaccaaggccuucauggaggcccuccaggccgacgccgacaucuccaugaucggccacuucggcgucggcuucuacuccgccuaccucgucgccaagaaggucaccgucaucuccaagcacaacaacgacgagcaguacaccugggaguccuccgccggcggcuccuucaccguccgcaccgacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2848 - RNA, 2557 nt, Artificial Sequence
  mRNA product Design2 comprising derived and/or modified sequence from Homo sapiens__NP_031381.2__HsHSP90AB1 (opt2)
ggggcgcugccuacggagguggcagccaucuccuucucggcaucaagcuuaccaugcccgaggagguccaccacggcgaggaggaggucgagaccuucgccuuccaggccgagaucgcccagcucaugucccucaucaucaacaccuucuacuccaacaaggagaucuuccuccgcgagcucaucuccaacgccuccgacgcccucgacaagauccgcuacgagucccucaccgaccccuccaagcucgacuccggcaaggagcucaagaucgacaucauccccaacccccaggagcgcacccucacccucgucgacaccggcaucggcaugaccaaggccgaccucaucaacaaccucggcaccaucgccaaguccggcaccaaggccuucauggaggcccuccaggccggcgccgacaucuccaugaucggccaguucggcgucggcuucuacuccgccuaccucgucgccgagaaggucgucgucaucaccaagcacaacgacgacgagcaguacgccugggaguccuccgccggcggcuccuucaccguccgcgccgaccacggcgagcccaucggccgcggcaccaaggucauccuccaccucaaggaggaccagaccgaguaccucgaggagcgccgcgucaaggaggucgucaagaagcacucccaguucaucggcuaccccaucacccucuaccucgagaaggagcgcgagaaggagaucuccgacgacgaggccgaggaggagaagggcgagaaggaggaggaggacaaggacgacgaggagaagcccaagaucgaggacgucggcuccgacgaggaggacgacuccggcaaggacaagaagaagaagaccaagaagaucaaggagaaguacaucgaccaggaggagcucaacaagaccaagcccaucuggacccgcaaccccgacgacaucacccaggaggaguacggcgaguucuacaagucccucaccaacgacugggaggaccaccucgccgucaagcacuucuccgucgagggccagcucgaguuccgcgcccuccucuucaucccccgccgcgcccccuucgaccucuucgagaacaagaagaagaagaacaacaucaagcucuacguccgccgcgucuucaucauggacuccugcgacgagcucauccccgaguaccucaacuucauccgcggcgucgucgacuccgaggaccucccccucaacaucucccgcgagaugcuccagcaguccaagauccucaaggucauccgcaagaacaucgucaagaagugccucgagcucuucuccgagcucgccgaggacaaggagaacuacaagaaguucuacgaggccuucuccaagaaccucaagcucggcauccacgaggacuccaccaaccgccgccgccucuccgagcuccuccgcuaccacaccucccaguccggcgacgagaugaccucccucuccgaguacgucucccgcaugaaggagacccagaaguccaucuacuacaucaccggcgaguccaaggagcaggucgccaacuccgccuucgucgagcgcguccgcaagcgcggcuucgaggucgucuacaugaccgagcccaucgacgaguacugcguccagcagcucaaggaguucgacggcaagucccucgucuccgucaccaaggagggccucgagcuccccgaggacgaggaggagaagaagaagauggaggaguccaaggccaaguucgagaaccucugcaagcucaugaaggagauccucgacaagaaggucgagaaggucaccaucuccaaccgccucgucuccucccccugcugcaucgucaccuccaccuacggcuggaccgccaacauggagcgcaucaugaaggcccaggcccuccgcgacaacuccaccaugggcuacaugauggccaagaagcaccucgagaucaaccccgaccaccccaucgucgagacccuccgccagaaggccgaggccgacaagaacgacaaggccgucaaggaccucgucguccuccucuucgagaccgcccuccucuccuccggcuucucccucgaggacccccagacccacuccaaccgcaucuaccgcaugaucaagcucggccucggcaucgacgaggacgaggucgccgccgaggagcccaacgccgccguccccgacgagauccccccccucgagggcgacgaggacgccucccgcauggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2849 - RNA, 2794 nt, Artificial Sequence
  mRNA product Design2 comprising derived and/or modified sequence from Homo sapiens__NP_003290.1__HsHSP90B1 (opt2)
ggggcgcugccuacggagguggcagccaucuccuucucggcaucaagcuuaccaugcgcgcccucuggguccucggccucugcugcguccuccucaccuucggcuccguccgcgccgacgacgaggucgacgucgacggcaccgucgaggaggaccucggcaagucccgcgagggcucccgcaccgacgacgaggucguccagcgcgaggaggaggccauccagcucgacggccucaacgccucccagauccgcgagcuccgcgagaaguccgagaaguucgccuuccaggccgaggucaaccgcaugaugaagcucaucaucaacucccucuacaagaacaaggagaucuuccuccgcgagcucaucuccaacgccuccgacgcccucgacaagauccgccucaucucccucaccgacgagaacgcccucuccggcaacgaggagcucaccgucaagaucaagugcgacaaggagaagaaccuccuccacgucaccgacaccggcgucggcaugacccgcgaggagcucgucaagaaccucggcaccaucgccaaguccggcaccuccgaguuccucaacaagaugaccgaggcccaggaggacggccaguccaccuccgagcucaucggccaguucggcgucggcuucuacuccgccuuccucgucgccgacaaggucaucgucaccuccaagcacaacaacgacacccagcacaucugggaguccgacuccaacgaguucuccgucaucgccgacccccgcggcaacacccucggccgcggcaccaccaucacccucguccucaaggaggaggccuccgacuaccucgagcucgacaccaucaagaaccucgucaagaaguacucccaguucaucaacuuccccaucuacgucugguccuccaagaccgagaccgucgaggagcccauggaggaggaggaggccgccaaggaggagaaggaggaguccgacgacgaggccgccgucgaggaggaggaggaggagaagaagcccaagaccaagaaggucgagaagaccgucugggacugggagcucaugaacgacaucaagcccaucuggcagcgccccuccaaggaggucgaggaggacgaguacaaggccuucuacaaguccuucuccaaggaguccgacgaccccauggccuacauccacuucaccgccgagggcgaggucaccuucaaguccauccucuucguccccaccuccgccccccgcggccucuucgacgaguacggcuccaagaaguccgacuacaucaagcucuacguccgccgcgucuucaucaccgacgacuuccacgacaugaugcccaaguaccucaacuucgucaagggcgucgucgacuccgacgaccucccccucaacgucucccgcgagacccuccagcagcacaagcuccucaaggucauccgcaagaagcucguccgcaagacccucgacaugaucaagaagaucgccgacgacaaguacaacgacaccuucuggaaggaguucggcaccaacaucaagcucggcgucaucgaggaccacuccaaccgcacccgccucgccaagcuccuccgcuuccaguccucccaccaccccaccgacaucaccucccucgaccaguacgucgagcgcaugaaggagaagcaggacaagaucuacuucauggccggcuccucccgcaaggaggccgaguccucccccuucgucgagcgccuccucaagaagggcuacgaggucaucuaccucaccgagcccgucgacgaguacugcauccaggcccuccccgaguucgacggcaagcgcuuccagaacgucgccaaggagggcgucaaguucgacgaguccgagaagaccaaggagucccgcgaggccgucgagaaggaguucgagccccuccucaacuggaugaaggacaaggcccucaaggacaagaucgagaaggccgucgucucccagcgccucaccgagucccccugcgcccucgucgccucccaguacggcugguccggcaacauggagcgcaucaugaaggcccaggccuaccagaccggcaaggacaucuccaccaacuacuacgccucccagaagaagaccuucgagaucaacccccgccacccccucauccgcgacaugcuccgccgcaucaaggaggacgaggacgacaagaccguccucgaccucgccgucguccucuucgagaccgccacccuccgcuccggcuaccuccuccccgacaccaaggccuacggcgaccgcaucgagcgcaugcuccgccucucccucaacaucgaccccgacgccaaggucgaggaggagcccgaggaggagcccgaggagaccgccgaggacaccaccgaggacaccgagcaggacgaggacgaggagauggacgucggcaccgacgaggaggaggagaccgccaaggaguccaccgccgagaaggacgagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2850 - RNA, 2497 nt, Artificial Sequence
  mRNA product Design2 comprising derived and/or modified sequence from Homo sapiens__NP_057376.2__HsTRAP1 (opt2)
ggggcgcugccuacggagguggcagccaucuccuucucggcaucaagcuuaccauggcccgcgagcuccgcgcccuccuccucuggggccgccgccuccgcccccuccuccgcgcccccgcccucgccgccguccccggcggcaagcccauccucugcccccgccgcaccaccgcccagcucggcccccgccgcaaccccgccuggucccuccaggccggccgccucuucuccacccagaccgccgaggacaaggaggagccccuccacuccaucaucuccuccaccgaguccguccagggcuccaccuccaagcacgaguuccaggccgagaccaagaagcuccucgacaucgucgcccgcucccucuacuccgagaaggaggucuucauccgcgagcucaucuccaacgccuccgacgcccucgagaagcuccgccacaagcucgucuccgacggccaggcccuccccgagauggagauccaccuccagaccaacgccgagaagggcaccaucaccauccaggacaccggcaucggcaugacccaggaggagcucgucuccaaccucggcaccaucgcccgcuccggcuccaaggccuuccucgacgcccuccagaaccaggccgaggccuccuccaagaucaucggccaguucggcgucggcuucuacuccgccuucauggucgccgaccgcgucgaggucuacucccgcuccgccgcccccggcucccucggcuaccaguggcucuccgacggcuccggcgucuucgagaucgccgaggccuccggcguccgcaccggcaccaagaucaucauccaccucaaguccgacugcaaggaguucuccuccgaggcccgcguccgcgacgucgucaccaaguacuccaacuucgucuccuucccccucuaccucaacggccgccgcaugaacacccuccaggccaucuggaugauggaccccaaggacguccgcgaguggcagcacgaggaguucuaccgcuacgucgcccaggcccacgacaagccccgcuacacccuccacuacaagaccgacgccccccucaacauccgcuccaucuucuacguccccgacaugaagcccuccauguucgacgucucccgcgagcucggcuccuccgucgcccucuacucccgcaagguccucauccagaccaaggccaccgacauccuccccaaguggcuccgcuucauccgcggcgucgucgacuccgaggacaucccccucaaccucucccgcgagcuccuccaggaguccgcccucauccgcaagcuccgcgacguccuccagcagcgccucaucaaguucuucaucgaccaguccaagaaggacgccgagaaguacgccaaguucuucgaggacuacggccucuucaugcgcgagggcaucgucaccgccaccgagcaggaggucaaggaggacaucgccaagcuccuccgcuacgaguccuccgcccuccccuccggccagcucaccucccucuccgaguacgccucccgcaugcgcgccggcacccgcaacaucuacuaccucugcgcccccaaccgccaccucgccgagcacucccccuacuacgaggccaugaagaagaaggacaccgagguccucuucugcuucgagcaguucgacgagcucacccuccuccaccuccgcgaguucgacaagaagaagcucaucuccgucgagaccgacaucgucgucgaccacuacaaggaggagaaguucgaggaccgcucccccgccgccgagugccucuccgagaaggagaccgaggagcucauggccuggaugcgcaacguccucggcucccgcgucaccaacgucaaggucacccuccgccucgacacccaccccgccauggucaccguccucgagaugggcgccgcccgccacuuccuccgcaugcagcagcucgccaagacccaggaggagcgcgcccagcuccuccagcccacccucgagaucaacccccgccacgcccucaucaagaagcucaaccagcuccgcgccuccgagcccggccucgcccagcuccucgucgaccagaucuacgagaacgccaugaucgccgccggccucgucgacgacccccgcgccauggucggccgccucaacgagcuccucgucaaggcccucgagcgccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2851 - RNA, 844 nt, Artificial Sequence
  mRNA product Design2 comprising derived and/or modified sequence from Homo sapiens__NP_000609.1__HsIGF1 (opt2)
ggggcgcugccuacggagguggcagccaucuccuucucggcaucaagcuuaccaugggcaagaucuccucccuccccacccagcucuucaagugcugcuucugcgacuuccucaaggucaagaugcacaccauguccuccucccaccucuucuaccucgcccucugccuccucaccuucaccuccuccgccaccgccggccccgagacccucugcggcgccgagcucgucgacgcccuccaguucgucugcggcgaccgcggcuucuacuucaacaagcccaccggcuacggcuccuccucccgccgcgccccccagaccggcaucgucgacgagugcugcuuccgcuccugcgaccuccgccgccucgagauguacugcgccccccucaagcccgccaaguccgcccgcuccguccgcgcccagcgccacaccgacaugcccaagacccagaaggagguccaccucaagaacgccucccgcggcuccgccggcaacaagaacuaccgcaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2852 - RNA, 925 nt, Artificial Sequence
  mRNA product Design2 comprising derived and/or modified sequence from Homo sapiens__NP_000603.1__HsIGF2 (opt2)
ggggcgcugccuacggagguggcagccaucuccuucucggcaucaagcuuaccaugggcauccccaugggcaaguccaugcucguccuccucaccuuccucgccuucgccuccugcugcaucgccgccuaccgccccuccgagacccucugcggcggcgagcucgucgacacccuccaguucgucugcggcgaccgcggcuucuacuucucccgccccgccucccgcgucucccgccgcucccgcggcaucgucgaggagugcugcuuccgcuccugcgaccucgcccuccucgagaccuacugcgccacccccgccaaguccgagcgcgacgucuccaccccccccaccguccuccccgacaacuucccccgcuaccccgucggcaaguucuuccaguacgacaccuggaagcaguccacccagcgccuccgccgcggccuccccgcccuccuccgcgcccgccgcggccacguccucgccaaggagcucgaggccuuccgcgaggccaagcgccaccgcccccucaucgcccuccccacccaggaccccgcccacggcggcgccccccccgagauggccuccaaccgcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2853 - RNA, 1021 nt, Artificial Sequence
  mRNA product Design2 comprising derived and/or modified sequence from Homo sapiens__NP_000591.1__HsIL6 (opt2)
ggggcgcugccuacggagguggcagccaucuccuucucggcaucaagcuuaccaugaacuccuucuccaccuccgccuucggccccgucgccuucucccucggccuccuccucguccuccccgccgccuuccccgcccccgucccccccggcgaggacuccaaggacgucgccgccccccaccgccagccccucaccuccuccgagcgcaucgacaagcagauccgcuacauccucgacggcaucuccgcccuccgcaaggagaccugcaacaaguccaacaugugcgaguccuccaaggaggcccucgccgagaacaaccucaaccuccccaagauggccgagaaggacggcugcuuccaguccggcuucaacgaggagaccugccucgucaagaucaucaccggccuccucgaguucgaggucuaccucgaguaccuccagaaccgcuucgaguccuccgaggagcaggcccgcgccguccagauguccaccaagguccucauccaguuccuccagaagaaggccaagaaccucgacgccaucaccacccccgaccccaccaccaacgccucccuccucaccaagcuccaggcccagaaccaguggcuccaggacaugaccacccaccucauccuccgcuccuucaaggaguuccuccaguccucccuccgcgcccuccgccagaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2854 - RNA, 1663 nt, Artificial Sequence
  mRNA product Design2 comprising derived and/or modified sequence from Homo sapiens__NP_002183.1__HsINHBA (opt2)
ggggcgcugccuacggagguggcagccaucuccuucucggcaucaagcuuaccaugccccuccucuggcuccgcggcuuccuccucgccuccugcuggaucaucguccgcuccucccccacccccggcuccgagggccacuccgccgcccccgacugccccuccugcgcccucgccgcccuccccaaggacguccccaacucccagcccgagauggucgaggccgucaagaagcacauccucaacaugcuccaccucaagaagcgccccgacgucacccagcccguccccaaggccgcccuccucaacgccauccgcaagcuccacgucggcaaggucggcgagaacggcuacgucgagaucgaggacgacaucggccgccgcgccgagaugaacgagcucauggagcagaccuccgagaucaucaccuucgccgaguccggcaccgcccgcaagacccuccacuucgagaucuccaaggagggcuccgaccucuccgucgucgagcgcgccgaggucuggcucuuccucaagguccccaaggccaaccgcacccgcaccaaggucaccauccgccucuuccagcagcagaagcacccccagggcucccucgacaccggcgaggaggccgaggaggucggccucaagggcgagcgcuccgagcuccuccucuccgagaaggucgucgacgcccgcaaguccaccuggcacgucuuccccgucuccuccuccauccagcgccuccucgaccagggcaaguccucccucgacguccgcaucgccugcgagcagugccaggaguccggcgccucccucguccuccucggcaagaagaagaagaaggaggaggagggcgagggcaagaagaagggcggcggcgagggcggcgccggcgccgacgaggagaaggagcagucccaccgccccuuccucaugcuccaggcccgccaguccgaggaccacccccaccgccgccgccgccgcggccucgagugcgacggcaaggucaacaucugcugcaagaagcaguucuucgucuccuucaaggacaucggcuggaacgacuggaucaucgcccccuccggcuaccacgccaacuacugcgagggcgagugccccucccacaucgccggcaccuccggcuccucccucuccuuccacuccaccgucaucaaccacuaccgcaugcgcggccacucccccuucgccaaccucaaguccugcugcguccccaccaagcuccgccccauguccaugcucuacuacgacgacggccagaacaucaucaagaaggacauccagaacaugaucgucgaggagugcggcugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2855 - RNA, 1606 nt, Artificial Sequence
  mRNA product Design2 comprising derived and/or modified sequence from Homo sapiens__NP_002184.2__HsINHBB (opt2)
ggggcgcugccuacggagguggcagccaucuccuucucggcaucaagcuuaccauggacggccuccccggccgcgcccucggcgccgccugccuccuccuccucgccgccggcuggcucggccccgaggccuggggcucccccacccccccccccacccccgccgcccccccccccccccccccccccggcucccccggcggcucccaggacaccugcaccuccugcggcggcuuccgccgccccgaggagcucggccgcgucgacggcgacuuccucgaggccgucaagcgccacauccucucccgccuccagaugcgcggccgccccaacaucacccacgccguccccaaggccgccauggucaccgcccuccgcaagcuccacgccggcaagguccgcgaggacggccgcgucgagaucccccaccucgacggccacgccucccccggcgccgacggccaggagcgcgucuccgagaucaucuccuucgccgagaccgacggccucgccuccucccgcguccgccucuacuucuucaucuccaacgagggcaaccagaaccucuucgucguccaggccucccucuggcucuaccucaagcuccuccccuacguccucgagaagggcucccgccgcaagguccgcgucaaggucuacuuccaggagcagggccacggcgaccgcuggaacauggucgagaagcgcgucgaccucaagcgcuccggcuggcacaccuucccccucaccgaggccauccaggcccucuucgagcgcggcgagcgccgccucaaccucgacguccagugcgacuccugccaggagcucgccgucguccccgucuucgucgaccccggcgaggagucccaccgccccuucgucgucguccaggcccgccucggcgacucccgccaccgcauccgcaagcgcggccucgagugcgacggccgcaccaaccucugcugccgccagcaguucuucaucgacuuccgccucaucggcuggaacgacuggaucaucgcccccaccggcuacuacggcaacuacugcgagggcuccugccccgccuaccucgccggcguccccggcuccgccuccuccuuccacaccgccgucgucaaccaguaccgcaugcgcggccucaaccccggcaccgucaacuccugcugcauccccaccaagcucuccaccauguccaugcucuacuucgacgacgaguacaacaucgucaagcgcgacguccccaacaugaucgucgaggagugcggcugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2856 - RNA, 3841 nt, Artificial Sequence
  mRNA product Design2 comprising derived and/or modified sequence from Homo sapiens__NP_000623.2__HsITGAM (opt2)
ggggcgcugccuacggagguggcagccaucuccuucucggcaucaagcuuaccauggcccuccgcguccuccuccucaccgcccucacccucugccacggcuucaaccucgacaccgagaacgccaugaccuuccaggagaacgcccgcggcuucggccaguccgucguccagcuccagggcucccgcgucgucgucggcgccccccaggagaucgucgccgccaaccagcgcggcucccucuaccagugcgacuacuccaccggcuccugcgagcccauccgccuccagguccccgucgaggccgucaacaugucccucggccucucccucgccgccaccaccucccccccccagcuccucgccugcggccccaccguccaccagaccugcuccgagaacaccuacgucaagggccucugcuuccucuucggcuccaaccuccgccagcagccccagaaguuccccgaggcccuccgcggcugcccccaggaggacuccgacaucgccuuccucaucgacggcuccggcuccaucaucccccacgacuuccgccgcaugaaggaguucgucuccaccgucauggagcagcucaagaaguccaagacccucuucucccucaugcaguacuccgaggaguuccgcauccacuucaccuucaaggaguuccagaacaaccccaacccccgcucccucgucaagcccaucacccagcuccucggccgcacccacaccgccaccggcauccgcaaggucguccgcgagcucuucaacaucaccaacggcgcccgcaagaacgccuucaagauccucgucgucaucaccgacggcgagaaguucggcgacccccucggcuacgaggacgucauccccgaggccgaccgcgagggcgucauccgcuacgucaucggcgucggcgacgccuuccgcuccgagaagucccgccaggagcucaacaccaucgccuccaagcccccccgcgaccacgucuuccaggucaacaacuucgaggcccucaagaccauccagaaccagcuccgcgagaagaucuucgccaucgagggcacccagaccggcuccuccuccuccuucgagcacgagaugucccaggagggcuucuccgccgccaucaccuccaacggcccccuccucuccaccgucggcuccuacgacugggccggcggcgucuuccucuacaccuccaaggagaaguccaccuucaucaacaugacccgcgucgacuccgacaugaacgacgccuaccucggcuacgccgccgccaucauccuccgcaaccgcguccagucccucguccucggcgccccccgcuaccagcacaucggccucgucgccauguuccgccagaacaccggcaugugggaguccaacgccaacgucaagggcacccagaucggcgccuacuucggcgccucccucugcuccgucgacgucgacuccaacggcuccaccgaccucguccucaucggcgccccccacuacuacgagcagacccgcggcggccaggucuccgucugcccccucccccgcggccgcgcccgcuggcagugcgacgccguccucuacggcgagcagggccagcccuggggccgcuucggcgccgcccucaccguccucggcgacgucaacggcgacaagcucaccgacgucgccaucggcgcccccggcgaggaggacaaccgcggcgccgucuaccucuuccacggcaccuccggcuccggcaucucccccucccacucccagcgcaucgccggcuccaagcucuccccccgccuccaguacuucggccagucccucuccggcggccaggaccucaccauggacggccucgucgaccucaccgucggcgcccagggccacguccuccuccuccgcucccagcccguccuccgcgucaaggccaucauggaguucaacccccgcgaggucgcccgcaacgucuucgagugcaacgaccaggucgucaagggcaaggaggccggcgagguccgcgucugccuccacguccagaaguccacccgcgaccgccuccgcgagggccagauccaguccgucgucaccuacgaccucgcccucgacuccggccgcccccacucccgcgccgucuucaacgagaccaagaacuccacccgccgccagacccagguccucggccucacccagaccugcgagacccucaagcuccagcuccccaacugcaucgaggaccccgucucccccaucguccuccgccucaacuucucccucgucggcaccccccucuccgccuucggcaaccuccgccccguccucgccgaggacgcccagcgccucuucaccgcccucuuccccuucgagaagaacugcggcaacgacaacaucugccaggacgaccucuccaucaccuucuccuucaugucccucgacugccucgucgucggcggcccccgcgaguucaacgucaccgucaccguccgcaacgacggcgaggacuccuaccgcacccaggucaccuucuucuucccccucgaccucuccuaccgcaaggucuccacccuccagaaccagcgcucccagcgcuccuggcgccucgccugcgaguccgccuccuccaccgaggucuccggcgcccucaaguccaccuccugcuccaucaaccaccccaucuuccccgagaacuccgaggucaccuucaacaucaccuucgacgucgacuccaaggccucccucggcaacaagcuccuccucaaggccaacgucaccuccgagaacaacaugccccgcaccaacaagaccgaguuccagcucgagcuccccgucaaguacgccgucuacauggucgucaccucccacggcgucuccaccaaguaccucaacuucaccgccuccgagaacaccucccgcgucaugcagcaccaguaccaggucuccaaccucggccagcgcucccuccccaucucccucgucuuccucguccccguccgccucaaccagaccgucaucugggaccgcccccaggucaccuucuccgagaaccucuccuccaccugccacaccaaggagcgccuccccucccacuccgacuuccucgccgagcuccgcaaggcccccgucgucaacugcuccaucgccgucugccagcgcauccagugcgacauccccuucuucggcauccaggaggaguucaacgccacccucaagggcaaccucuccuucgacugguacaucaagaccucccacaaccaccuccucaucgucuccaccgccgagauccucuucaacgacuccgucuucacccuccuccccggccagggcgccuucguccgcucccagaccgagaccaaggucgagcccuucgagguccccaacccccucccccucaucgucggcuccuccgucggcggccuccuccuccucgcccucaucaccgccgcccucuacaagcucggcuucuucaagcgccaguacaaggacaugauguccgagggcggcccccccggcgccgagccccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2857 - RNA, 1786 nt, Artificial Sequence
  mRNA product Design2 comprising derived and/or modified sequence from Homo sapiens__NP_002415.1__HsMMP8 (opt2)
ggggcgcugccuacggagguggcagccaucuccuucucggcaucaagcuuaccauguucucccucaagacccuccccuuccuccuccuccuccacguccagaucuccaaggccuuccccgucuccuccaaggagaagaacaccaagaccguccaggacuaccucgagaaguucuaccagcuccccuccaaccaguaccaguccacccgcaagaacggcaccaacgucaucgucgagaagcucaaggagaugcagcgcuucuucggccucaacgucaccggcaagcccaacgaggagacccucgacaugaugaagaagccccgcugcggcguccccgacuccggcggcuucaugcucacccccggcaaccccaagugggagcgcaccaaccucaccuaccgcauccgcaacuacaccccccagcucuccgaggccgaggucgagcgcgccaucaaggacgccuucgagcucugguccgucgccuccccccucaucuucacccgcaucucccagggcgaggccgacaucaacaucgccuucuaccagcgcgaccacggcgacaacucccccuucgacggccccaacggcauccucgcccacgccuuccagcccggccagggcaucggcggcgacgcccacuucgacgccgaggagaccuggaccaacaccuccgccaacuacaaccucuuccucgucgccgcccacgaguucggccacucccucggccucgcccacuccuccgaccccggcgcccucauguaccccaacuacgccuuccgcgagaccuccaacuacucccucccccaggacgacaucgacggcauccaggccaucuacggccucuccuccaaccccauccagcccaccggccccuccacccccaagcccugcgaccccucccucaccuucgacgccaucaccacccuccgcggcgagauccucuucuucaaggaccgcuacuucuggcgccgccacccccagcuccagcgcgucgagaugaacuucaucucccucuucuggcccucccuccccaccggcauccaggccgccuacgaggacuucgaccgcgaccucaucuuccucuucaagggcaaccaguacugggcccucuccggcuacgacauccuccagggcuaccccaaggacaucuccaacuacggcuuccccuccuccguccaggccaucgacgccgccgucuucuaccgcuccaagaccuacuucuucgucaacgaccaguucuggcgcuacgacaaccagcgccaguucauggagcccggcuaccccaaguccaucuccggcgccuuccccggcaucgaguccaaggucgacgccgucuuccagcaggagcacuucuuccacgucuucuccggcccccgcuacuacgccuucgaccucaucgcccagcgcgucacccgcgucgcccgcggcaacaaguggcucaacugccgcuacggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2858 - RNA, 2506 nt, Artificial Sequence
  mRNA product Design2 comprising derived and/or modified sequence from Homo sapiens__NP_004985.2__HsMMP9 (opt2)
ggggcgcugccuacggagguggcagccaucuccuucucggcaucaagcuuaccaugucccucuggcagccccucguccucguccuccucguccucggcugcugcuucgccgccccccgccagcgccaguccacccucguccucuuccccggcgaccuccgcaccaaccucaccgaccgccagcucgccgaggaguaccucuaccgcuacggcuacacccgcgucgccgagaugcgcggcgaguccaagucccucggccccgcccuccuccuccuccagaagcagcucucccuccccgagaccggcgagcucgacuccgccacccucaaggccaugcgcaccccccgcugcggcguccccgaccucggccgcuuccagaccuucgagggcgaccucaaguggcaccaccacaacaucaccuacuggauccagaacuacuccgaggaccucccccgcgccgucaucgacgacgccuucgcccgcgccuucgcccucugguccgccgucaccccccucaccuucacccgcgucuacucccgcgacgccgacaucgucauccaguucggcgucgccgagcacggcgacggcuaccccuucgacggcaaggacggccuccucgcccacgccuucccccccggccccggcauccagggcgacgcccacuucgacgacgacgagcucuggucccucggcaagggcgucgucguccccacccgcuucggcaacgccgacggcgccgccugccacuuccccuucaucuucgagggccgcuccuacuccgccugcaccaccgacggccgcuccgacggccuccccuggugcuccaccaccgccaacuacgacaccgacgaccgcuucggcuucugccccuccgagcgccucuacacccaggacggcaacgccgacggcaagcccugccaguuccccuucaucuuccagggccaguccuacuccgccugcaccaccgacggccgcuccgacggcuaccgcuggugcgccaccaccgccaacuacgaccgcgacaagcucuucggcuucugccccacccgcgccgacuccaccgucaugggcggcaacuccgccggcgagcucugcgucuuccccuucaccuuccucggcaaggaguacuccaccugcaccuccgagggccgcggcgacggccgccucuggugcgccaccaccuccaacuucgacuccgacaagaaguggggcuucugccccgaccagggcuacucccucuuccucgucgccgcccacgaguucggccacgcccucggccucgaccacuccuccguccccgaggcccucauguaccccauguaccgcuucaccgagggccccccccuccacaaggacgacgucaacggcauccgccaccucuacggcccccgccccgagcccgagccccgcccccccaccaccaccaccccccagcccaccgccccccccaccgucugccccaccggcccccccaccguccaccccuccgagcgccccaccgccggccccaccggcccccccuccgccggccccaccggcccccccaccgccggccccuccaccgccaccaccgucccccucucccccgucgacgacgccugcaacgucaacaucuucgacgccaucgccgagaucggcaaccagcucuaccucuucaaggacggcaaguacuggcgcuucuccgagggccgcggcucccgcccccagggccccuuccucaucgccgacaaguggcccgcccucccccgcaagcucgacuccgucuucgaggagcgccucuccaagaagcucuucuucuucuccggccgccaggucugggucuacaccggcgccuccguccucggcccccgccgccucgacaagcucggccucggcgccgacgucgcccaggucaccggcgcccuccgcuccggccgcggcaagaugcuccucuucuccggccgccgccucuggcgcuucgacgucaaggcccagauggucgacccccgcuccgccuccgaggucgaccgcauguuccccggcgucccccucgacacccacgacgucuuccaguaccgcgagaaggccuacuucugccaggaccgcuucuacuggcgcgucuccucccgcuccgagcucaaccaggucgaccaggucggcuacgucaccuacgacauccuccagugccccgaggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2859 - RNA, 1798 nt, Artificial Sequence
  mRNA product Design2 comprising derived and/or modified sequence from Homo sapiens__NP_002418.1__HsMMP13 (opt2)
ggggcgcugccuacggagguggcagccaucuccuucucggcaucaagcuuaccaugcaccccggcguccucgccgccuuccucuuccucuccuggacccacugccgcgcccucccccuccccuccggcggcgacgaggacgaccucuccgaggaggaccuccaguucgccgagcgcuaccuccgcuccuacuaccaccccaccaaccucgccggcauccucaaggagaacgccgccuccuccaugaccgagcgccuccgcgagaugcaguccuucuucggccucgaggucaccggcaagcucgacgacaacacccucgacgucaugaagaagccccgcugcggcguccccgacgucggcgaguacaacgucuucccccgcacccucaagugguccaagaugaaccucaccuaccgcaucgucaacuacacccccgacaugacccacuccgaggucgagaaggccuucaagaaggccuucaaggucugguccgacgucaccccccucaacuucacccgccuccacgacggcaucgccgacaucaugaucuccuucggcaucaaggagcacggcgacuucuaccccuucgacggccccuccggccuccucgcccacgccuucccccccggccccaacuacggcggcgacgcccacuucgacgacgacgagaccuggaccuccuccuccaagggcuacaaccucuuccucgucgccgcccacgaguucggccacucccucggccucgaccacuccaaggaccccggcgcccucauguuccccaucuacaccuacaccggcaagucccacuucaugcuccccgacgacgacguccagggcauccagucccucuacggccccggcgacgaggaccccaaccccaagcaccccaagacccccgacaagugcgaccccucccucucccucgacgccaucaccucccuccgcggcgagaccaugaucuucaaggaccgcuucuucuggcgccuccacccccagcaggucgacgccgagcucuuccucaccaaguccuucuggcccgagcuccccaaccgcaucgacgccgccuacgagcaccccucccacgaccucaucuucaucuuccgcggccgcaaguucugggcccucaacggcuacgacauccucgagggcuaccccaagaagaucuccgagcucggccuccccaaggaggucaagaagaucuccgccgccguccacuucgaggacaccggcaagacccuccucuucuccggcaaccaggucuggcgcuacgacgacaccaaccacaucauggacaaggacuacccccgccucaucgaggaggacuuccccggcaucggcgacaaggucgacgccgucuacgagaagaacggcuacaucuacuucuucaacggccccauccaguucgaguacuccaucugguccaaccgcaucguccgcgucaugcccgccaacuccauccucuggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2860 - RNA, 1450 nt, Artificial Sequence
  mRNA product Design2 comprising derived and/or modified sequence from Homo sapiens__NP_001286.1__HsCCR1 (opt2)
ggggcgcugccuacggagguggcagccaucuccuucucggcaucaagcuuaccauggagacccccaacaccaccgaggacuacgacaccaccaccgaguucgacuacggcgacgccacccccugccagaaggucaacgagcgcgccuucggcgcccagcuccuccccccccucuacucccucgucuucgucaucggccucgucggcaacauccucgucguccucguccucguccaguacaagcgccucaagaacaugaccuccaucuaccuccucaaccucgccaucuccgaccuccucuuccucuucacccuccccuucuggaucgacuacaagcucaaggacgacugggucuucggcgacgccaugugcaagauccucuccggcuucuacuacaccggccucuacuccgagaucuucuucaucauccuccucaccaucgaccgcuaccucgccaucguccacgccgucuucgcccuccgcgcccgcaccgucaccuucggcgucaucaccuccaucaucaucugggcccucgccauccucgccuccaugcccggccucuacuucuccaagacccagugggaguucacccaccacaccugcucccuccacuucccccacgagucccuccgcgaguggaagcucuuccaggcccucaagcucaaccucuucggccucguccucccccuccucgucaugaucaucugcuacaccggcaucaucaagauccuccuccgccgccccaacgagaagaaguccaaggccguccgccucaucuucgucaucaugaucaucuucuuccucuucuggacccccuacaaccucaccauccucaucuccgucuuccaggacuuccucuucacccacgagugcgagcagucccgccaccucgaccucgccguccaggucaccgaggucaucgccuacacccacugcugcgucaaccccgucaucuacgccuucgucggcgagcgcuuccgcaaguaccuccgccagcucuuccaccgccgcgucgccguccaccucgucaaguggcuccccuuccucuccgucgaccgccucgagcgcgucuccuccaccucccccuccaccggcgagcacgagcucuccgccggcuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2861 - RNA, 1018 nt, Artificial Sequence
  mRNA product Design2 comprising derived and/or modified sequence from Homo sapiens__NP_002598.4__HsPDGFA (opt2)
ggggcgcugccuacggagguggcagccaucuccuucucggcaucaagcuuaccaugcgcacccucgccugccuccuccuccucggcugcggcuaccucgcccacguccucgccgaggaggccgagaucccccgcgaggucaucgagcgccucgcccgcucccagauccacuccauccgcgaccuccagcgccuccucgagaucgacuccgucggcuccgaggacucccucgacaccucccuccgcgcccacggcguccacgccaccaagcacguccccgagaagcgcccccuccccauccgccgcaagcgcuccaucgaggaggccguccccgccgucugcaagacccgcaccgucaucuacgagaucccccgcucccaggucgaccccaccuccgccaacuuccucaucuggccccccugcgucgaggucaagcgcugcaccggcugcugcaacaccuccuccgucaagugccagcccucccgcguccaccaccgcuccgucaaggucgccaaggucgaguacguccgcaagaagcccaagcucaaggagguccagguccgccucgaggagcaccucgagugcgccugcgccaccaccucccucaaccccgacuaccgcgaggaggacaccggccgcccccgcgaguccggcaagaagcgcaagcgcaagcgccucaagcccaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2862 - RNA, 1108 nt, Artificial Sequence
  mRNA product Design2 comprising derived and/or modified sequence from Homo sapiens__NP_002599.1__HsPDGFB (opt2)
ggggcgcugccuacggagguggcagccaucuccuucucggcaucaagcuuaccaugaaccgcugcugggcccucuuccucucccucugcugcuaccuccgccucgucuccgccgagggcgaccccauccccgaggagcucuacgagaugcucuccgaccacuccauccgcuccuucgacgaccuccagcgccuccuccacggcgaccccggcgaggaggacggcgccgagcucgaccucaacaugacccgcucccacuccggcggcgagcucgagucccucgcccgcggccgccgcucccucggcucccucaccaucgccgagcccgccaugaucgccgagugcaagacccgcaccgaggucuucgagaucucccgccgccucaucgaccgcaccaacgccaacuuccucgucuggccccccugcgucgagguccagcgcugcuccggcugcugcaacaaccgcaacguccagugccgccccacccagguccagcuccgccccguccagguccgcaagaucgagaucguccgcaagaagcccaucuucaagaaggccaccgucacccucgaggaccaccucgccugcaagugcgagaccgucgccgccgcccgccccgucacccgcucccccggcggcucccaggagcagcgcgccaagaccccccagacccgcgucaccauccgcaccguccgcguccgccgcccccccaagggcaagcaccgcaaguucaagcacacccacgacaagaccgcccucaaggagacccucggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2863 - RNA, 1420 nt, Artificial Sequence
  mRNA product Design2 comprising derived and/or modified sequence from Homo sapiens__NP_057289.1__HsPDGFC (opt2)
ggggcgcugccuacggagguggcagccaucuccuucucggcaucaagcuuaccaugucccucuucggccuccuccuccucaccuccgcccucgccggccagcgccagggcacccaggccgaguccaaccucuccuccaaguuccaguucuccuccaacaaggagcagaacggcguccaggacccccagcacgagcgcaucaucaccgucuccaccaacggcuccauccacuccccccgcuucccccacaccuacccccgcaacaccguccucgucuggcgccucgucgccgucgaggagaacgucuggauccagcucaccuucgacgagcgcuucggccucgaggaccccgaggacgacaucugcaaguacgacuucgucgaggucgaggagcccuccgacggcaccauccucggccgcuggugcggcuccggcaccguccccggcaagcagaucuccaagggcaaccagauccgcauccgcuucgucuccgacgaguacuuccccuccgagcccggcuucugcauccacuacaacaucgucaugccccaguucaccgaggccgucucccccuccguccucccccccuccgcccucccccucgaccuccucaacaacgccaucaccgccuucuccacccucgaggaccucauccgcuaccucgagcccgagcgcuggcagcucgaccucgaggaccucuaccgccccaccuggcagcuccucggcaaggccuucgucuucggccgcaagucccgcgucgucgaccucaaccuccucaccgaggagguccgccucuacuccugcaccccccgcaacuucuccgucuccauccgcgaggagcucaagcgcaccgacaccaucuucuggcccggcugccuccucgucaagcgcugcggcggcaacugcgccugcugccuccacaacugcaacgagugccagugcguccccuccaaggucaccaagaaguaccacgagguccuccagcuccgccccaagaccggcguccgcggccuccacaagucccucaccgacgucgcccucgagcaccacgaggagugcgacugcgucugccgcggcuccaccggcggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2864 - RNA, 1477 nt, Artificial Sequence
  mRNA product Design2 comprising derived and/or modified sequence from Homo sapiens__NP_149126.1__HsPDGFD (opt2)
ggggcgcugccuacggagguggcagccaucuccuucucggcaucaagcuuaccaugcaccgccucaucuucgucuacacccucaucugcgccaacuucugcuccugccgcgacaccuccgccaccccccaguccgccuccaucaaggcccuccgcaacgccaaccuccgccgcgacgaccucuaccgccgcgacgagaccauccaggucaagggcaacggcuacguccaguccccccgcuuccccaacuccuacccccgcaaccuccuccucaccuggcgccuccacucccaggagaacacccgcauccagcucgucuucgacaaccaguucggccucgaggaggccgagaacgacaucugccgcuacgacuucgucgaggucgaggacaucuccgagaccuccaccaucauccgcggccgcuggugcggccacaaggagguccccccccgcaucaagucccgcaccaaccagaucaagaucaccuucaaguccgacgacuacuucgucgccaagcccggcuucaagaucuacuacucccuccucgaggacuuccagcccgccgccgccuccgagaccaacugggaguccgucaccuccuccaucuccggcgucuccuacaacucccccuccgucaccgaccccacccucaucgccgacgcccucgacaagaagaucgccgaguucgacaccgucgaggaccuccucaaguacuucaaccccgaguccuggcaggaggaccucgagaacauguaccucgacaccccccgcuaccgcggccgcuccuaccacgaccgcaaguccaaggucgaccucgaccgccucaacgacgacgccaagcgcuacuccugcaccccccgcaacuacuccgucaacauccgcgaggagcucaagcucgccaacgucgucuucuucccccgcugccuccucguccagcgcugcggcggcaacugcggcugcggcaccgucaacuggcgcuccugcaccugcaacuccggcaagaccgucaagaaguaccacgagguccuccaguucgagcccggccacaucaagcgccgcggccgcgccaagaccauggcccucgucgacauccagcucgaccaccacgagcgcugcgacugcaucugcuccucccgccccccccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2865 - RNA, 1060 nt, Artificial Sequence
  mRNA product Design2 comprising derived and/or modified sequence from Homo sapiens__NP_003946.3__HsSOCS3 (opt2)
ggggcgcugccuacggagguggcagccaucuccuucucggcaucaagcuuaccauggucacccacuccaaguuccccgccgccggcaugucccgcccccucgacaccucccuccgccucaagaccuucuccuccaaguccgaguaccagcucgucgucaacgccguccgcaagcuccaggaguccggcuucuacugguccgccgucaccggcggcgaggccaaccuccuccucuccgccgagcccgccggcaccuuccucauccgcgacuccuccgaccagcgccacuucuucacccucuccgucaagacccaguccggcaccaagaaccuccgcauccagugcgagggcggcuccuucucccuccaguccgacccccgcuccacccagcccgucccccgcuucgacugcguccucaagcucguccaccacuacaugcccccccccggcgcccccuccuuccccuccccccccaccgagcccuccuccgagguccccgagcagcccuccgcccagccccuccccggcucccccccccgccgcgccuacuacaucuacuccggcggcgagaagaucccccucguccucucccgcccccucuccuccaacgucgccacccuccagcaccucugccgcaagaccgucaacggccaccucgacuccuacgagaaggucacccagcuccccggccccauccgcgaguuccucgaccaguacgacgccccccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2866 - RNA, 865 nt, Artificial Sequence
  mRNA product Design2 comprising derived and/or modified sequence from Homo sapiens__NP_003227.1__HsTGFA (opt2)
ggggcgcugccuacggagguggcagccaucuccuucucggcaucaagcuuaccaugguccccuccgccggccagcucgcccucuucgcccucggcaucguccucgccgccugccaggcccucgagaacuccaccuccccccucuccgccgacccccccgucgccgccgccgucgucucccacuucaacgacugccccgacucccacacccaguucugcuuccacggcaccugccgcuuccucguccaggaggacaagcccgccugcgucugccacuccggcuacgucggcgcccgcugcgagcacgccgaccuccucgccgucgucgccgccucccagaagaagcaggccaucaccgcccucgucgucgucuccaucgucgcccucgccguccucaucaucaccugcguccucauccacugcugccagguccgcaagcacugcgaguggugccgcgcccucaucugccgccacgagaagcccuccgcccuccucaagggccgcaccgccugcugccacuccgagaccgucgucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2867 - RNA, 1555 nt, Artificial Sequence
  mRNA product Design2 comprising derived and/or modified sequence from Homo sapiens__NP_000651.3__HsTGFB1 (opt2)
ggggcgcugccuacggagguggcagccaucuccuucucggcaucaagcuuaccaugccccccuccggccuccgccuccucccccuccuccucccccuccucuggcuccucguccucacccccggccgccccgccgccggccucuccaccugcaagaccaucgacauggagcucgucaagcgcaagcgcaucgaggccauccgcggccagauccucuccaagcuccgccucgccuccccccccucccagggcgaggucccccccggcccccuccccgaggccguccucgcccucuacaacuccacccgcgaccgcgucgccggcgaguccgccgagcccgagcccgagcccgaggccgacuacuacgccaaggaggucacccgcguccucauggucgagacccacaacgagaucuacgacaaguucaagcaguccacccacuccaucuacauguucuucaacaccuccgagcuccgcgaggccguccccgagcccguccuccucucccgcgccgagcuccgccuccuccgccucaagcucaaggucgagcagcacgucgagcucuaccagaaguacuccaacaacuccuggcgcuaccucuccaaccgccuccucgcccccuccgacucccccgaguggcucuccuucgacgucaccggcgucguccgccaguggcucucccgcggcggcgagaucgagggcuuccgccucuccgcccacugcuccugcgacucccgcgacaacacccuccaggucgacaucaacggcuucaccaccggccgccgcggcgaccucgccaccauccacggcaugaaccgccccuuccuccuccucauggccaccccccucgagcgcgcccagcaccuccaguccucccgccaccgccgcgcccucgacaccaacuacugcuucuccuccaccgagaagaacugcugcguccgccagcucuacaucgacuuccgcaaggaccucggcuggaaguggauccacgagcccaagggcuaccacgccaacuucugccucggccccugccccuacaucuggucccucgacacccaguacuccaagguccucgcccucuacaaccagcacaaccccggcgccuccgccgcccccugcugcgucccccaggcccucgagccccuccccaucgucuacuacgucggccgcaagcccaaggucgagcagcucuccaacaugaucguccgcuccugcaagugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2868 - RNA, 1627 nt, Artificial Sequence
  mRNA product Design2 comprising derived and/or modified sequence from Homo sapiens__NP_003229.1__HsTGFB2 (opt2)
ggggcgcugccuacggagguggcagccaucuccuucucggcaucaagcuuaccaugcacuacugcguccucuccgccuuccucauccuccaccucgucaccgucgcccucucccucuccaccugcuccacccucgacauggaccaguucaugcgcaagcgcaucgaggccauccgcggccagauccucuccaagcucaagcucaccuccccccccgaggacuaccccgagcccgaggaggucccccccgaggucaucuccaucuacaacuccacccgcgaccuccuccaggagaaggccucccgccgcgccgccgccugcgagcgcgagcgcuccgacgaggaguacuacgccaaggaggucuacaagaucgacaugccccccuucuuccccuccgagaacgccaucccccccaccuucuaccgccccuacuuccgcaucguccgcuucgacgucuccgccauggagaagaacgccuccaaccucgucaaggccgaguuccgcgucuuccgccuccagaaccccaaggcccgcguccccgagcagcgcaucgagcucuaccagauccucaaguccaaggaccucaccucccccacccagcgcuacaucgacuccaaggucgucaagacccgcgccgagggcgaguggcucuccuucgacgucaccgacgccguccacgaguggcuccaccacaaggaccgcaaccucggcuucaagaucucccuccacugccccugcugcaccuucguccccuccaacaacuacaucauccccaacaaguccgaggagcucgaggcccgcuucgccggcaucgacggcaccuccaccuacaccuccggcgaccagaagaccaucaaguccacccgcaagaagaacuccggcaagaccccccaccuccuccucaugcuccuccccuccuaccgccucgagucccagcagaccaaccgccgcaagaagcgcgcccucgacgccgccuacugcuuccgcaacguccaggacaacugcugccuccgcccccucuacaucgacuucaagcgcgaccucggcuggaaguggauccacgagcccaagggcuacaacgccaacuucugcgccggcgccugccccuaccucugguccuccgacacccagcacucccgcguccucucccucuacaacaccaucaaccccgaggccuccgccucccccugcugcgucucccaggaccucgagccccucaccauccucuacuacaucggcaagacccccaagaucgagcagcucuccaacaugaucgucaaguccugcaagugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2869 - RNA, 1621 nt, Artificial Sequence
  mRNA product Design2 comprising derived and/or modified sequence from Homo sapiens__NP_003230.1__HsTGFB3 (opt2)
ggggcgcugccuacggagguggcagccaucuccuucucggcaucaagcuuaccaugaagaugcaccuccagcgcgcccucgucguccucgcccuccucaacuucgccaccgucucccucucccucuccaccugcaccacccucgacuucggccacaucaagaagaagcgcgucgaggccauccgcggccagauccucuccaagcuccgccucaccuccccccccgagcccaccgucaugacccacguccccuaccagguccucgcccucuacaacuccacccgcgagcuccucgaggagaugcacggcgagcgcgaggagggcugcacccaggagaacaccgaguccgaguacuacgccaaggagauccacaaguucgacaugauccagggccucgccgagcacaacgagcucgccgucugccccaagggcaucaccuccaaggucuuccgcuucaacgucuccuccgucgagaagaaccgcaccaaccucuuccgcgccgaguuccgcguccuccgcguccccaaccccuccuccaagcgcaacgagcagcgcaucgagcucuuccagauccuccgccccgacgagcacaucgccaagcagcgcuacaucggcggcaagaaccuccccacccgcggcaccgccgaguggcucuccuucgacgucaccgacaccguccgcgaguggcuccuccgccgcgaguccaaccucggccucgagaucuccauccacugccccugccacaccuuccagcccaacggcgacauccucgagaacauccacgaggucauggagaucaaguucaagggcgucgacaacgaggacgaccacggccgcggcgaccucggccgccucaagaagcagaaggaccaccacaacccccaccucauccucaugaugauccccccccaccgccucgacaaccccggccagggcggccagcgcaagaagcgcgcccucgacaccaacuacugcuuccgcaaccucgaggagaacugcugcguccgcccccucuacaucgacuuccgccaggaccucggcuggaaguggguccacgagcccaagggcuacuacgccaacuucugcuccggccccugccccuaccuccgcuccgccgacaccacccacuccaccguccucggccucuacaacacccucaaccccgaggccuccgccucccccugcugcgucccccaggaccucgagccccucaccauccucuacuacgucggccgcacccccaaggucgagcagcucuccaacauggucgucaaguccugcaagugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2870 - RNA, 1768 nt, Artificial Sequence
  mRNA product Design2 comprising derived and/or modified sequence from Homo sapiens__NP_001057.1__HsTNFRSF1B (opt2)
ggggcgcugccuacggagguggcagccaucuccuucucggcaucaagcuuaccauggcccccgucgccgucugggccgcccucgccgucggccucgagcucugggccgccgcccacgcccuccccgcccaggucgccuucacccccuacgcccccgagcccggcuccaccugccgccuccgcgaguacuacgaccagaccgcccagaugugcugcuccaagugcucccccggccagcacgccaaggucuucugcaccaagaccuccgacaccgucugcgacuccugcgaggacuccaccuacacccagcucuggaacuggguccccgagugccucuccugcggcucccgcugcuccuccgaccaggucgagacccaggccugcacccgcgagcagaaccgcaucugcaccugccgccccggcugguacugcgcccucuccaagcaggagggcugccgccucugcgccccccuccgcaagugccgccccggcuucggcgucgcccgccccggcaccgagaccuccgacgucgucugcaagcccugcgcccccggcaccuucuccaacaccaccuccuccaccgacaucugccgcccccaccagaucugcaacgucgucgccauccccggcaacgccuccauggacgccgucugcaccuccaccucccccacccgcuccauggcccccggcgccguccaccucccccagcccgucuccacccgcucccagcacacccagcccacccccgagcccuccaccgcccccuccaccuccuuccuccuccccaugggccccuccccccccgccgagggcuccaccggcgacuucgcccuccccgucggccucaucgucggcgucaccgcccucggccuccucaucaucggcgucgucaacugcgucaucaugacccaggucaagaagaagccccucugccuccagcgcgaggccaaggucccccaccuccccgccgacaaggcccgcggcacccagggccccgagcagcagcaccuccucaucaccgcccccuccuccuccuccuccucccucgaguccuccgccuccgcccucgaccgccgcgcccccacccgcaaccagccccaggcccccggcgucgaggccuccggcgccggcgaggcccgcgccuccaccggcuccuccgacuccucccccggcggccacggcacccaggucaacgucaccugcaucgucaacgucugcuccuccuccgaccacuccucccagugcuccucccaggccuccuccaccaugggcgacaccgacuccucccccuccgagucccccaaggacgagcagguccccuucuccaaggaggagugcgccuuccgcucccagcucgagacccccgagacccuccucggcuccaccgaggagaagccccucccccucggcguccccgacgccggcaugaagcccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2871 - RNA, 895 nt, Artificial Sequence
  mRNA product Design2 comprising derived and/or modified sequence from Homo sapiens__NP_002623.2__HsPGF (opt2)
ggggcgcugccuacggagguggcagccaucuccuucucggcaucaagcuuaccaugcccgucaugcgccucuuccccugcuuccuccagcuccucgccggccucgcccuccccgccguccccccccagcagugggcccucuccgccggcaacggcuccuccgaggucgaggucguccccuuccaggaggucuggggccgcuccuacugccgcgcccucgagcgccucgucgacgucgucuccgaguaccccuccgaggucgagcacauguucucccccuccugcgucucccuccuccgcugcaccggcugcugcggcgacgagaaccuccacugcguccccgucgagaccgccaacgucaccaugcagcuccucaagauccgcuccggcgaccgccccuccuacgucgagcucaccuucucccagcacguccgcugcgagugccgcccccuccgcgagaagaugaagcccgagcgccgccgccccaagggccgcggcaagcgccgccgcgagaagcagcgccccaccgacugccaccucugcggcgacgccgucccccgccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2872 - RNA, 1621 nt, Artificial Sequence
  mRNA product Design2 comprising derived and/or modified sequence from Homo sapiens__NP_001020537.2__HsVEGFA (opt2)
ggggcgcugccuacggagguggcagccaucuccuucucggcaucaagcuuaccaugaccgaccgccagaccgacaccgcccccucccccuccuaccaccuccuccccggccgccgccgcaccgucgacgccgccgccucccgcggccagggccccgagcccgcccccggcggcggcgucgagggcgucggcgcccgcggcgucgcccucaagcucuucguccagcuccucggcugcucccgcuucggcggcgccgucguccgcgccggcgaggccgagcccuccggcgccgcccgcuccgccuccuccggccgcgaggagccccagcccgaggagggcgaggaggaggaggagaaggaggaggagcgcggcccccaguggcgccucggcgcccgcaagcccggcuccuggaccggcgaggccgccgucugcgccgacuccgcccccgccgcccgcgccccccaggcccucgcccgcgccuccggccgcggcggccgcgucgcccgccgcggcgccgaggaguccggccccccccacucccccucccgccgcggcuccgccucccgcgccggccccggccgcgccuccgagaccaugaacuuccuccucuccuggguccacuggucccucgcccuccuccucuaccuccaccacgccaaguggucccaggccgcccccauggccgagggcggcggccagaaccaccacgaggucgucaaguucauggacgucuaccagcgcuccuacugccaccccaucgagacccucgucgacaucuuccaggaguaccccgacgagaucgaguacaucuucaagcccuccugcgucccccucaugcgcugcggcggcugcugcaacgacgagggccucgagugcguccccaccgaggaguccaacaucaccaugcagaucaugcgcaucaagccccaccagggccagcacaucggcgagauguccuuccuccagcacaacaagugcgagugccgccccaagaaggaccgcgcccgccaggagaagaaguccguccgcggcaagggcaagggccagaagcgcaagcgcaagaagucccgcuacaaguccugguccgucuacgucggcgcccgcugcugccucaugcccuggucccuccccggcccccaccccugcggccccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2873 - RNA, 1081 nt, Artificial Sequence
  mRNA product Design2 comprising derived and/or modified sequence from Homo sapiens__NP_001165094.1__HsVEGFA (opt2)
ggggcgcugccuacggagguggcagccaucuccuucucggcaucaagcuuaccaugaacuuccuccucuccuggguccacuggucccucgcccuccuccucuaccuccaccacgccaaguggucccaggccgcccccauggccgagggcggcggccagaaccaccacgaggucgucaaguucauggacgucuaccagcgcuccuacugccaccccaucgagacccucgucgacaucuuccaggaguaccccgacgagaucgaguacaucuucaagcccuccugcgucccccucaugcgcugcggcggcugcugcaacgacgagggccucgagugcguccccaccgaggaguccaacaucaccaugcagaucaugcgcaucaagccccaccagggccagcacaucggcgagauguccuuccuccagcacaacaagugcgagugccgccccaagaaggaccgcgcccgccaggagaagaaguccguccgcggcaagggcaagggccagaagcgcaagcgcaagaagucccgcuacaaguccugguccgucuacgucggcgcccgcugcugccucaugcccuggucccuccccggcccccaccccugcggccccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2874 - RNA, 1006 nt, Artificial Sequence
  mRNA product Design2 comprising derived and/or modified sequence from Homo sapiens__NP_003368.1__HsVEGFB (opt2)
ggggcgcugccuacggagguggcagccaucuccuucucggcaucaagcuuaccauguccccccuccuccgccgccuccuccucgccgcccuccuccagcucgcccccgcccaggcccccgucucccagcccgacgcccccggccaccagcgcaaggucgucuccuggaucgacgucuacacccgcgccaccugccagccccgcgaggucgucgucccccucaccgucgagcucaugggcaccgucgccaagcagcucguccccuccugcgucaccguccagcgcugcggcggcugcugccccgacgacggccucgagugcguccccaccggccagcaccagguccgcaugcagauccucaugauccgcuaccccuccucccagcucggcgagaugucccucgaggagcacucccagugcgagugccgccccaagaagaaggacuccgccgucaagcccgaccgcgccgccaccccccaccaccgcccccagccccgcuccguccccggcugggacuccgcccccggcgcccccucccccgccgacaucacccaccccacccccgcccccggccccuccgcccacgccgcccccuccaccaccuccgcccucacccccggccccgccgccgccgccgccgacgccgccgccuccuccgucgccaagggcggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2875 - RNA, 1642 nt, Artificial Sequence
  mRNA product Design2 comprising derived and/or modified sequence from Homo sapiens__NP_005420.1__HsVEGFC (opt2)
ggggcgcugccuacggagguggcagccaucuccuucucggcaucaagcuuaccaugcaccuccucggcuucuucuccgucgccugcucccuccucgccgccgcccuccuccccggcccccgcgaggcccccgccgccgccgccgccuucgaguccggccucgaccucuccgacgccgagcccgacgccggcgaggccaccgccuacgccuccaaggaccucgaggagcagcuccgcuccgucuccuccgucgacgagcucaugaccguccucuaccccgaguacuggaagauguacaagugccagcuccgcaagggcggcuggcagcacaaccgcgagcaggccaaccucaacucccgcaccgaggagaccaucaaguucgccgccgcccacuacaacaccgagauccucaaguccaucgacaacgaguggcgcaagacccagugcaugccccgcgaggucugcaucgacgucggcaaggaguucggcgucgccaccaacaccuucuucaagccccccugcgucuccgucuaccgcugcggcggcugcugcaacuccgagggccuccagugcaugaacaccuccaccuccuaccucuccaagacccucuucgagaucaccgucccccucucccagggccccaagcccgucaccaucuccuucgccaaccacaccuccugccgcugcauguccaagcucgacgucuaccgccagguccacuccaucauccgccgcucccuccccgccacccucccccagugccaggccgccaacaagaccugccccaccaacuacauguggaacaaccacaucugccgcugccucgcccaggaggacuucauguucuccuccgacgccggcgacgacuccaccgacggcuuccacgacaucugcggccccaacaaggagcucgacgaggagaccugccagugcgucugccgcgccggccuccgccccgccuccugcggcccccacaaggagcucgaccgcaacuccugccagugcgucugcaagaacaagcucuuccccucccagugcggcgccaaccgcgaguucgacgagaacaccugccagugcgucugcaagcgcaccugcccccgcaaccagccccucaaccccggcaagugcgccugcgagugcaccgaguccccccagaagugccuccucaagggcaagaaguuccaccaccagaccugcuccugcuaccgccgccccugcaccaaccgccagaaggccugcgagcccggcuucuccuacuccgaggaggucugccgcugcguccccuccuacuggaagcgcccccagauguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2876 - RNA, 1447 nt, Artificial Sequence
  mRNA product Design2 comprising derived and/or modified sequence from Homo sapiens__NP_004460.1__HsVEGFD (opt2)
ggggcgcugccuacggagguggcagccaucuccuucucggcaucaagcuuaccauguaccgcgagugggucgucgucaacgucuucaugaugcucuacguccagcucguccagggcuccuccaacgagcacggccccgucaagcgcuccucccaguccacccucgagcgcuccgagcagcagauccgcgccgccuccucccucgaggagcuccuccgcaucacccacuccgaggacuggaagcucuggcgcugccgccuccgccucaaguccuucaccuccauggacucccgcuccgccucccaccgcuccacccgcuucgccgccaccuucuacgacaucgagacccucaaggucaucgacgaggaguggcagcgcacccagugcuccccccgcgagaccugcgucgaggucgccuccgagcucggcaaguccaccaacaccuucuucaagccccccugcgucaacgucuuccgcugcggcggcugcugcaacgaggagucccucaucugcaugaacaccuccaccuccuacaucuccaagcagcucuucgagaucuccgucccccucaccuccguccccgagcucguccccgucaaggucgccaaccacaccggcugcaagugccuccccaccgccccccgccaccccuacuccaucauccgccgcuccauccagauccccgaggaggaccgcugcucccacuccaagaagcucugccccaucgacaugcucugggacuccaacaagugcaagugcguccuccaggaggagaacccccucgccggcaccgaggaccacucccaccuccaggagcccgcccucugcggcccccacaugauguucgacgaggaccgcugcgagugcgucugcaagacccccugccccaaggaccucauccagcaccccaagaacugcuccugcuucgagugcaaggagucccucgagaccugcugccagaagcacaagcucuuccaccccgacaccugcuccugcgaggaccgcugccccuuccacacccgccccugcgccuccggcaagaccgccugcgccaagcacugccgcuuccccaaggagaagcgcgccgcccagggcccccacucccgcaagaaccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2877 - RNA, 1012 nt, Artificial Sequence
  mRNA product Design2 comprising derived and/or modified sequence from Homo sapiens__NP_061986.1__HsFGF21 (opt3)
ggggcgcugccuacggagguggcagccaucuccuucucggcaucaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugaguuacugcuugaagauggguauaacgucuaccagagcgaggcacacggauugccccugcaucuaccugguaauaaaaguccacacagagaccccgccccuaggggcccagcucgguuucucccgcugcccgggcuuccuccagcccugcccgaaccuccaggaauuuuggcgccccagccgccugaugugggcuccucugacccccucagcaugguugguccaucccaggggcgcucaccuaguuaugcaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2878 - RNA, 1792 nt, Artificial Sequence
  mRNA product Design2 comprising derived and/or modified sequence from Homo sapiens__NP_002412.1__HsMMP1 (opt3)
ggggcgcugccuacggagguggcagccaucuccuucucggcaucaagcuuaccaugcacagcuuucccccucugcuccuucuguuguucuggggcguggucucccauucuuucccagccaccuuagagacacaggaacaagacguugaucuggugcagaaguaccuagagaaauauuacaaccucaagaaugacgggagacagguagagaaaaggcggaacucaggaccgguggucgaaaagcugaaacagaugcaagaauuuuucggucuuaaggugacuggcaagcccgaugcugagacgcugaaaguuaugaagcagccucgcugcggggugccagacgucgcacaguuuguguugaccgagggaaauccccgaugggaacagacacaccucacuuaucguaucgagaacuacaccccugaucugccaagagccgacguagaucaugcgauugaaaaggcuuuccaacuguggaguaauguuacaccccucaccuuuacuaaagugagcgagggccaggccgacauaaugaucuccuucgucaggggugaucaccgggacaacucuccuuuugaugggccaggaggcaauuuagcacaugccuuccagccgggccccgggauuggaggugacgcucacuuugaugaggacgaacgcuggacaaacaauuucagagaguauaaccugcacaggguggcagcccaugaacuuggccacucguuggggcugucacauagcaccgacaucggagcucuaauguacccuaguuauacguuuuccggcgaugugcagcucgcccaagacgauauugacgguauccaggcgauauacgggcggucucagaauccaguccaacccaucggaccucagacuccaaaagcaugugauagcaagcugaccuucgacgccauuacaacuauccgcggcgagguuauguucuuuaaggaucgauucuacaugagaaccaaccccuuuuauccggaaguggagcuuaauuucauuuccguauuuuggccucagcugcccaacggcuuggaggcugccuacgaguucgcagacagggaugaagugcgguuuuucaaagggaauaaguauugggcuguccagggacaaaacgugcuccacgguuacccaaaagacaucuauucaaguuuuggcuucccucguacaguuaagcacauagaugccgcgcugagcgaagagaacaccgggaaaacguacuuuuucguggccaauaaguauuggcgcuacgacgaauacaaaagaucuauggaccccggauauccaaagaugauugcacaugauuuucccggcaucggucacaaggucgacgcuguguucaugaaagauggguucuuuuacuucuuucauggcacuaggcaguauaaguucgacccuaaaacaaagcggauuuuaacccugcagaaagccaacuccugguuuaauugccgaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2879 - RNA, 1552 nt, Artificial Sequence
  mRNA product Design2 comprising derived and/or modified sequence from Homo sapiens__NP_002412.1__HsMMP1(1-19,100-469) (opt3)
ggggcgcugccuacggagguggcagccaucuccuucucggcaucaagcuuaccaugcacagcuuucccccucugcuccuucuguuguucuggggcguggucucccauucuuucguuuuaaccgaggggaacccaagaugggaacagacacaccugacuuacaggaucgagaauuauacgccggaccuaccccgggccgauguggaccaugcuauugaaaaggcauuucaacucuggucaaacguaaccccucugacauucacuaaagugagugagggacaggccgauauaaugaucagcuuuguccgcggugaccaccgagauaauuccccauucgacggccccgggggaaaccuugcgcaugcuuuucagccuggcccagguauugggggagaugcccacuucgacgaagaugagcguuggaccaauaacuuuagagaguacaaucugcacaggguggcagcccaugaauugggccacucucucggccugucgcauucaacagacaucggggcucugauguaucccagcuacaccuucaguggagauguucagcucgcacaagacgauauugacgguauccaggccauauauggccggucccagaacccugugcagccaaucgggccgcaaacucccaaggcuugcgacucuaaauuaacauuugaugccauuaccacgauccgcggagaggucauguucuuuaaggacagauucuacaugaggacuaauccuuucuauccagaaguggagcugaacuuuauuagcguauucuggccccagcuuccuaauggcuuggaggcggcauacgaauuugccgaucgggacgagguucgcuucuuuaaagguaacaaguacugggcugugcaggggcagaauguccugcacggauauccaaaggauaucuacuccucauucggcuuuccccgaaccgugaaacacauagacgccgcacuaagugaagagaacacaggcaagacuuauuucuuuguggcuaauaaauacuggagauaugaugaauacaagaggagcauggacccgggguauccuaaaaugauugcccaugauuuccccggaaucggucacaaggucgacgcgguuuuuaugaaggauggcuucuuuuacuucuuccaugggacccggcaauacaaauuugacccaaagacaaaacguauucucacccugcagaaggccaacucuugguucaacugucgcaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2880 - RNA, 3739 nt, Artificial Sequence
  mRNA product Design2 comprising derived and/or modified sequence from Clostridium histolyticum__BAA77453.1__ColG (opt3)
ggggcgcugccuacggagguggcagccaucuccuucucggcaucaagcuuaccaugaagaaaaacauccugaagauucucauggacagcuacuccaaagagucuaagauacagaccgugagaagggucacaucaguuagucuucuggccguguauuugacuaugaauacgagcuccuuaguacuggcuaaacccaucgaaaacaccaaugauacaucuauuaagaacguggagaagcuacggaaugcaccuaacgaagaaaauucgaaaaaggucgaagacucaaagaacgauaagguggagcacguuaaaaauaucgaggaagccaagguggagcaagucgcgccagaaguaaagagcaaaaguacucuccgcuccgcuucuauugccaacaccaauagcgagaaguacgacuucgaguaucugaacggccuuuccuacacagaacugaccaauuugaucaaaaacauaaaguggaaucagaucaacgggcucuuuaacuauucaacuggaagucagaaauucuuuggugauaagaaucgagugcaggcaauuaucaacgcccugcaagagagcggccguacauacaccgcuaaugacaugaaagggauugaaacguucacugagguucugagagcaggauuuuaucucggcuacuacaacgaugguuuaucuuaucugaaugacaggaacuuccaggauaagugcaucccggccaugauagcuauucagaagaaucccaacuuuaaacuugggaccgccgugcaggacgaagucaucacauccuugggaaagcugauuggcaaugcgucagcaaacgccgagguggugaauaacugugucccuguucuaaaacaauuccgggagaaucucaaccaguacgcuccagauuaugugaagggcacugccguaaaugaacugaucaaagggaucgaguuugacuucagcggagcagcuuacgaaaaggaugugaagaccaugcccugguaugguaaaauugacccuuuuauaaacgagcuuaaggcccugggcuuguacgggaacaucacaagugcgaccgaaugggccucugacgucggaauuuauuaccucuccaaauucggccuguacagcacgaaucgcaacgauaucgugcagucguuagagaaggcaguugacauguauaaauacgguaagauagcuuuuguggccauggagagaauuacuugggauuaugacgggaucggaucuaauggcaagaaagucgaucaugacaaguuccuggaugacgcugaaaaacacuaccucccaaagacauauaccuucgauaacggcacuuuuaucauuagggccggggacaaaguguccgaggaaaagaucaagcggcuuuacugggcaucacgcgagguaaaaagucaguuccaucgaguugugggaaaugauaaggcccuggaagucgguaacgcugacgacguguugacaaugaaaauuuuuaauagccccgaggaguauaaguucaacaccaauauaaacggcgucuccacggauaaugggggacuauacaucgaaccuagaggcaccuuuuacacauaugagaggacuccacaacagucuauuuucagccuggaggagcucuuucggcacgaguacacccauuaucugcaggcgcguuaccuuguggacggucugugggggcaaggcccguucuaugaaaagaaccgcuugacaugguuugaugagggaacugcagaguucuuugccggcucaaccagaacaagugggguucuccccaggaaguccauccugggauacuuagcuaaagacaagguggaucaccgguauagccugaagaaaacccuaaauucugguuacgacgauucagacuggauguucuacaacuauggcuuugccguagcacacuaccucuaugaaaaggauaugccuacuuucaucaaaaugaauaaggccauucugaacacggacgucaaaaguuacgaugaaauaaucaagaaacuuagcgacgaugcuaacaaaaauacagaguaucagaaccauauucaggaguuggccgacaaguaccagggggcaggaaucccacugguguccgacgauuaucucaaagaccacggcuacaagaaagcgucugaaguuuacucggagauuagcaaggcugccucccugaccaauacuucagugaccgcagaaaagagucaauauuucaacacauuuacccuucgagguacuuacacaggggagacgucuaaaggcgaguucaaggauugggacgaaaugagcaaaaagcuggauggaaccuuggagucccucgccaaaaauucauggagcggcuauaagacucugacagcuuacuuuaccaacuaucgcgucacaucugacaauaaggugcaguacgauguaguguuccaugggguuuuaacugacaacgccgauaucuccaauaacaaagcacccauagcuaaggucaccggaccuaguacgggugccgugggcagaaauaucgaauuuagcgggaaagacucuaaggaugaggacggaaaaauuguguccuaugauugggacuucggcgacggugcgaccucaagggggaagaacaguguccacgccuacaaaaaggcuggcacauacaauguuacucugaaggugaccgaugacaaaggagcaacagccacugagagcuuuaccaucgaaauuaagaacgaagauacgacaaccccaaucacuaaagagauggagcccaaugacgauauaaaggaagcuaacggcccgauuguggaggggguaacagucaaaggagaccuaaacggcucggaugacgccgauaccuucuauuuugacgugaaggaagauggugacguuacuaucgagcucccuuacuccgggucuagcaauuucaccuggcugguguauaaggagggagacgaucagaaccacauugcaucaggcaucgacaaaaauaacaguaaggucgguacauuuaaauccacgaagggccggcauuacguguucauauauaaacacgauucugcgagcaauaucuccuacucacuuaacauuaagggguugggaaaugaaaagcugaaagagaaggaaaacaaugacagcagugauaaagccaccguuauccccaacuuuaauacuacaaugcagggcucucuccugggggacgauucccgcgacuauuacagcuucgaggugaaggaagagggagagguaaacauugaauuagauaaaaaggacgaguucggcgucaccuggacacugcauccagaaucgaauaucaacgauagaauaacuuacggucaaguggacgggaauaaggugucaaacaaagucaaacuuaggccuggaaaauauuacuugcucguuuauaaguacucuggcagugguaauuaugagcugcgugugaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2881 - RNA, 3463 nt, Artificial Sequence
  mRNA product Design2 comprising derived and/or modified sequence from Clostridium histolyticum__BAA77453.1__HsALB(1-18)_ColG(111-1118) (opt3)
ggggcgcugccuacggagguggcagccaucuccuucucggcaucaagcuuaccaugaagugggugaccuucaucagccugcucuuucuuuucuccucugccuacucaauugcuaacacaaauagugagaaauaugacuuugaauaccugaacggcuugagcuauacugaguuaacgaaucugauaaagaacaucaaauggaaucagauuaacgggcuauucaauuacuccaccggaucucaaaaguuuuucggugauaaaaacagaguccaggcaaucauuaaugcccuccaggaaucgggcaggacauauacugcgaacgacaugaaggggaucgagaccuuuacagaaguucugcgggcuggauucuaccuuggcuauuacaaugauggucugucauacuugaacgaccgcaauuuucaggauaagugcauacccgccaugaucgcaauucagaaaaacccuaauuucaagcucgggaccgccgugcaagacgagguaaucacuagccugggaaaacugauuggcaacgcuagugcaaacgccgagguggucaauaacugugugccaguucucaagcaguuucgagaaaauuuaaaccaguaugcuccggauuacgugaaaggcacagccgucaaugagcugaucaaggggauagaauuugacuuuuccggagcggcauaugagaaggaugugaaaaccaugcccugguacgguaagauugacccuuucaucaacgagcuuaaagccuugggccuguaugggaauauuacgucugcuacugaaugggccagcgauguaggaaucuacuaucuauccaaguucggccucuacucaaccaaccguaaugacaucguucaaagucuggagaaagcaguggauauguacaaguaugguaaaauugcuuuugucgccauggaaagaauaacaugggacuacgacgggaucggaagcaacggcaagaagguggaucacgacaaauuccuugaugacgcggagaagcauuaucugccaaaaacuuacaccuuugauaauggcacauucauuaucagggccggggacaaggugucugaagagaaaauaaagcgguuguauugggcaucccgcgaggucaagucacaguuucacagaguugugggaaacgauaaagcucucgaaguagguaaugccgacgaugugcugaccaugaagauuuucaacagccccgaggaauacaaauuuaauacgaacaucaacggcgucaguacugacaaugggggauuauauaucgagccuaggggcacauucuacaccuacgaacggacuccacagcagucuauuuucucccuggaggagcuguuccgccaugaauauacacacuaccuucaagcucgauaucugguggaugguuugugggggcagggccccuuuuacgagaagaacagacuaaccugguucgacgaaggaacggccgaguuuuucgcaggcagcaccaggacaucggggguucugccucggaaaucuauccucggauaucuggccaaggacaagguggaucaucguuacucccuuaaaaagacucucaauucagguuaugacgauagugacuggauguucuacaacuacggcuuugcugucgcgcacuauuuguacgaaaaagauaugccaaccuucauuaagaugaauaaagcaauacucaacacagacguaaagagcuaugaugagaucauuaagaaacuguccgacgaugccaauaagaacacugaguaccagaaucacauccaagaauuagcugacaaauaucagggggccggaaucccgcuggugucugaugacuaccuaaaggaucauggcuauaaaaaggcaagcgagguuuacucagaaauuaguaaagccgcuucccucaccaacacaagcgugaccgccgagaagucucaguacuuuaauacuuucacgcugcgcgguacauauaccggggagacuucaaagggcgaauuuaaagacugggacgagaugaguaagaaacuugauggaaccuuggaaagccuggcaaagaacuccuggucuggcuacaaaacacucaccgcguauuucacuaauuacagagucacaucggacaacaaggugcaguaugaugucguguuucacgggguucugacggacaaugcugauauaagcaacaacaaggcccccaucgcaaaagugaccggaccuuccacuggugccguaggcaggaauauugaguucucagggaaggacaguaaagaugaagacggaaagaucgucucuuacgauugggacuuuggcgauggugcuacaagccgggggaaaaacuccgugcaugccuauaagaaggcaggcaccuacaauguuacacuuaaagugacugacgauaagggagcuaccgccacggagucauucaccauugagaucaaaaacgaagacacaacuaccccaauaacaaaggagauggaacccaaugacgauaucaaagaggcgaacggcccuauugucgaaggggugacuguaaagggagaccugaauggcagcgaugacgccgauaccuuuuacuucgacgugaaggaggauggugacguuacgaucgaguugccauauucuggguccaguaacuuuacauggcucgucuacaaagaaggagaugaccaaaaucacauugcuagcggcaucgauaagaacaauucuaaaguggguaccuucaaguccacuaaaggccgacacuauguguucauauacaagcaugacucagcaaguaacauuagcuauucgcugaauaucaaaggguuaggaaacgagaagcugaaggaaaaagagaauaacgacuccucugauaaggccacagucauucccaacuuuaauaccacuaugcagggcagccuacucggggacgauucacgcgacuacuauaguuucgaaguuaaagaggagggagaagugaacaucgagcuggauaagaaagacgaauuuggcgugaccuggacacuucacccggaguccaauauaaacgauagaaucacguacggucagguagacgggaauaaggucucuaacaaggugaaauugaggccuggaaaguacuaucugcucguuuacaaauauagcggcuccgguaauuacgagcugcgggugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2882 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt3)
ggggcgcugccuacggagguggcagccaucuccuucucggcaucaagcuuaccaugaagugggugaccuucaucagccugcucuuucuuuucuccucugccuacucaaugaaaaagaacauucugaaaauauugauggacaguuauagcaaggaguccaaaauccagacagucagaaggguuacuucugugucguuacuggcuguauaccuaacgaugaauaccucaagccucgugcuggcaaagcccauugaaaacacaaaugauacuagcaucaagaacgucgagaaacuucggaaugccccuaacgaagaaaauuccaagaaaguggaagacucuaagaacgauaaaguugagcacgugaagaauauugaggaagcgaaggucgagcaaguggcuccagaaguaaaaagcaaguccacccugcgcucagccagucgacguagaaggaaacggaucgcaaacacaaauagcgagaaguaugacuuugaguacuugaacggccucucuuauaccgaacugacuaaucugaucaaaaacauaaaguggaaucagauuaacggacucuucaacuacuccacaggaucacagaaauuuuucggugauaagaaucgcguucaggccaucauuaacgcuuuacaagagagcggcagaaccuauacggcaaaugacaugaaggggaucgaaacuuuuaccgaggugcugagggccggauucuaccuuggcuacuauaacgaugguuugaguuaccugaaugaccggaacuuucaggauaaaugcauaccggcuaugauugccauccagaagaaucccaacuucaaacuagggacagcgguccaggacgaagugauuacuucucucggaaagcugaucggcaaugcauccgccaacgcugagguggucaauaacuguguuccugugcuuaaacaauuucgcgagaaucugaaccaguaugccccagauuacguaaagggcaccgcagugaaugaauugaucaaggggauugaguucgacuuuagcggagcugccuaugaaaaagaugucaagacaaugcccugguacgguaaaauagacccuuucaucaacgagcucaaggcgcugggcuuauaugggaacauuaccucggccacggaaugggcaucugacgugggaaucuacuaccuguccaaauucggccucuauucaacuaaucgaaacgauauaguucagagucuugagaaggcuguggacauguacaaguaugguaaaauugccuuugucgcuauggagagaaucacaugggauuacgacgggaucggaagcaauggcaagaaaguggaucaugacaaguuccuggaugacgccgaaaaacacuauuugccaaagaccuacacuuuugauaacggcacauucauuaucagggcaggggacaagguauccgaggagaaaauuaagcggcuauauugggccucucgugagguuaaaagccaguuucaucgcguggucggaaaugauaaggcucuggaaguggguaacgcggacgacguccucaccaugaaaauauucaauucacccgaggaguacaaguuuaacacgaauaucaacggcgugaguaccgauaaugggggacuguacauugaaccuagaggcacauucuauacuuacgagaggaccccacaacaguccaucuuuagccuugaggaacuguuccggcacgaguauacacauuacuugcaggcacgauaucucguugacggucugugggggcaaggcccguuuuacgagaaaaaccgcuuaacuugguucgaugaaggaaccgccgaauuuuucgcuggcucuacaagaaccucaggggugcugcccaggaagaguauccuaggauaucucgccaaggacaaaguagaucaccgguacagccugaagaaaacucuuaauuccgguuacgacgauucugacuggauguucuauaacuacggcuuugcagucgcccacuauuuguacgagaaggauaugccuacguucauuaaaaugaauaaggcuauacugaacacagacgugaagucguaugaugaaaucauuaaaaagcucagcgacgaugccaacaaaaauaccgaguaccagaaccauauccaggagcuggcagacaaguaucagggggcggggauuccacuuguuuccgacgauuaccugaaagaccacggcuacaagaaggcuucagaaguguauagugagaucucuaaagccgcaaguuugacuaauaccuccgucacagccgaaaagucacaauacuuuaacaccuucacucuccgcgguacauauacgggggagaccagcaaaggcgaauuuaaggauugggacgagaugucuaaaaagcuggauggaacuuuagagucccuggcuaagaauaguuggagcggcuacaaaacacuaaccgccuauuucacaaacuacagagugacuucugacaauaagguacaguaugaugugguuuuucaugggguccucaccgacaacgcagauauauccaauaacaaagcucccaucgccaaggugacgggaccuucaaccggugcggugggcaggaauauugaguucagugggaaagacagcaaggaugaagacggaaaaaucgucucguacgauugggacuuuggcgacggugccacaucccgugggaagaacucuguucacgcuuacaagaaagcaggcacuuauaaugugacccugaaggugacagaugacaaaggagccacugcuaccgagagcuucacgauugaaaucaagaacgaagauacaaccacuccaauaacaaaagagauggagcccaaugacgauauuaaggaagccaacggcccgaucguagagggggucaccgugaagggagaccuuaacggcucagaugacgcagauacuuuuuacuucgacguuaaagaagauggugacgugaccauugaguugccuuauaguggguccucuaauuuuacauggcuggucuacaaggagggagacgaucagaaccacaucgcgagcggcauagacaaaaauaacuccaagguggguacguucaaaucaaccaagggccggcauuauguuuucaucuacaagcacgauagcgccaguaauauuucuuauucccucaacaucaaagggcugggaaaugaaaaguuaaaagagaaggaaaacaaugacagcucggauaaagcuacugugauucccaacuuuaauacaaccaugcagggcucacugcuuggggacgauucucgagacuacuacaguuucgagguaaaggaagagggagaggucaacaucgaauuggauaagaaagacgaguuuggcgugacauggacucuccauccagaauccaauauaaacgauagaauuaccuauggucaaguggacgggaauaaggucagcaacaaaguuaagcugaggccuggaaaauacuaucuacugguguacaaguauucuggcagcgguaauuacgagcuccgcguaaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2883 - RNA, 3487 nt, Artificial Sequence
  mRNA product Design2 comprising derived and/or modified sequence from Clostridium histolyticum__BAA34542.1__ColH (opt3)
ggggcgcugccuacggagguggcagccaucuccuucucggcaucaagcuuaccaugaacuuccugaagaucauucucaauagaggcaaaaccaugaagaggaaaugccuuagcaagcggcugauguuggccauaacaauggcuacuaucuuuacggugaacuccaccuuacccauuuacgcagccgucgacaaaaauaacgcgacagcugccguucagaaugagucuaagcgcuauacugugucauaccugaagacccuaaacuauuacgaucucguagaccugcuugugaaaacagaaaucgagaaucugccugauuuguuccaauauaguagcgacgcaaaggaauuuuacgggaacaaaacccgaauguccuucauuauggaugagaucggacguagagccccacaguauacugaaauagaccacaaggguaucccgacacucgucgaggugguuagggcuggcuuuuaccugggguuccauaauaaagagcugaacgaaauuaauaagcggucuuuuaaggagcgcgugauccccucgauucucgcaauccagaaaaacccuaauuucaaguuaggaaccgaaguccaggauaaaauagugucagccacgggccugcuugcugguaacgagacugccccacccgagguaguuaauaacuuuaccccuauuuugcaagacuguaucaagaacauugauagauacgcgcuggacgaucuaaaaagcaaggcacucuucaaugugcuggccgcuccaacauaugacaucacugaauaccuuagggccaccaaagagaagcccgaaaacacaccuugguaugggaagaucgauggauuuauuaaugagcugaaaaaguuggcacucuacggcaaaauaaacgacaauaacaguuggaucauugacaauggcaucuaucacauagcuccacuggggaaguuacauuccaacaauaaaauuggaaucgaaacccugacggaggucaugaagguguacccguaucucucuaugcagcaccuucagagcgccgaucagaucaagcggcauuacgacuccaaagaugcggaggguaacaagauuccccuggacaaauucaagaaagaaggcaaggagaaguacugcccuaaaacuuauacauuugaugacgggaaggugaucauuaaagccggagcacgcgucgaagaggaaaagguuaaacgauuguacugggcuucaaaggaggugaauagucaauucuucagaguauauggcauagauaagccacuagaggaagguaaccccgacgauauccugaccauggugauuuacaauagcccugaggaauauaaacucaacucuguccuguacggguaugacacuaauaacggaggcauguacaucgagccagaaggcacauuuuucaccuacgagagggaggcccaggaauccacguauacccuugaggaacuguuucggcacgaguacacacacuauuugcaggggcguuacgcugugcccggacaguggggucgcacuaagcucuaugauaacgacagacugaccugguacgaggaaggcggggccgaguuauucgcaggaucaacaaggacuagcggcauccugccgcggaaaaguauuguuucuaauauacauaacaccacacgaaauaaccgcuauaagcuauccgacaccgugcacagcaaauacggugccucguuugaguucuacaauuaugcuuguauguuuauggauuacauguauaacaaggacauggggauccucaauaaacugaacgaucuugcgaagaauaacgacgucgauggcuacgacaauuauauuagagauuugucuuccaacuacgcacugaaugacaaguaucaagaucauaugcaggaaaggaucgacaacuacgaaaaucucacugugccuuucguagccgaugacuaccugguucggcacgcuuauaaaaaccccaacgagauuuacucagagaucagugaaguggccaaacuuaaggaugcaaagagcgaggucaaaaagucccaguauuuuucuacguucacacugcgcggaagcuacaccggcggggccucaaagggaaaauuggaagaccaaaaggcuaugaauaaauuuauagacgauagucucaagaaacuggacacuuauuccuggagcgguuacaagaccuuaacagccuauuucaccaacuacaagguggauucuucaaauagagucacuuacgacgugguuuuucacggcuaucugccaaacgagggggauaguaaaaauagccuaccuuacggaaagaucaacggcacauauaaagguacggaaaaggagaaaauuaaguucuccucugaggggucguucgaccccgauggcaagaucgugagcuacgaaugggacuuuggagauggcaauaaauccaacgaggaaaauccagagcauucauaugacaagguagggaccuacacugucaaacucaaggugacagaugacaaaggagaaaguucuguuagcaccacaacugcagagauuaaggaucuguccgagaacaaacuucccgugaucuauaugcacgucccuaagucaggugcguugaaucagaaggugguauucuacggcaaagggaccuacgacccagacggaagcauagcuggcuaucagugggauuuuggugacgggucugauuucuccagugaacagaacccgagccauguguacacgaagaaaggcgaguauaccguuacacugagggucauggacucuuccggacaaaugucagaaaagacuaugaaaauuaagaucaccgaucccguguacccuauuggcacagagaaggagccaaauaacaguaaagaaacugccagcgggcccaucgugccuggaauaccagucucgggcaccaucgagaauacguccgaccaggauuauuuuuacuucgacguuauuacacccggugaagugaagaucgauauuaacaaacucggguauggaggcgcaaccugggugguauacgacgagaacaauaacgccgucucuuacgcuacugaugacggucagaaucugagcggcaaguuuaaagccgacaagccggggcguuauuacauccacuuauauauguucaacggaucauacaugccuuaucggauaaauauugaaggcaguguggggcgaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2884 - RNA, 3448 nt, Artificial Sequence
  mRNA product Design2 comprising derived and/or modified sequence from Clostridium histolyticum__BAA34542.1__ColH (opt3)
ggggcgcugccuacggagguggcagccaucuccuucucggcaucaagcuuaccaugaagagaaaaugccugagcaagaggcucaugcuugccaucaccauggcuacaauuuucacugugaacuccacgcugcccauauacgcagccgucgacaaaaauaacgcgaccgcugccguucagaaugagucuaagcgguauacagugucauacuugaaaacuuuaaacuauuacgaucugguagaccuacucgugaagaccgaaaucgagaaucugccugaucuuuuucaauauaguagcgacgcaaaggaguucuacggcaacaaaacacgcauguccuuuauuauggaugaaaucgggcgacgugccccacaguauaccgaaauugaccacaagggaaucccgacucuggucgaggugguuagagcugguuucuacuugggcuuucauaauaaagagcucaacgaaauaaauaagaggucuuucaaagagcgggugauccccucgauucuggcaauccagaagaacccuaauuuuaagcuggggacagaaguccaggauaaaauugugucagccaccggacucuuagcuggcaacgagacggccccacccgagguaguuaauaacuucacuccuauccugcaagacuguauaaagaauauugaucgcuacgcgcuugacgauuugaaaagcaaggcacuguuuaacgugcuagccgcuccaaccuaugacaucacagaauaccucagagccacuaaagagaagcccgaaaacaccccuugguaugguaaaauugauggguucaucaaugagcugaagaagcuggcacuguacggaaaaaucaacgacaauaacaguuggauuauagacaauggcaucuaucacauugcuccauugggcaagcuccauuccaacaauaaaaucgggauagaaacacugaccgaggucaugaagguguacccguauuuaucuaugcagcaccuucagagcgccgaucagauuaaaaggcauuacgacuccaaggaugcggagggaaacaagaucccccucgacaaauuuaagaaagaagguaaggagaaauacugcccuaagacguauacuuucgaugacggcaaggugaucauuaaagccggggcacgggucgaagaggaaaagguuaaacgccuuuacugggcuucaaaggaggugaauagucaauuuuuccgaguauauggaaucgauaaaccacuggaggaaggcaaccccgacgauauuuugacaauggugauauacaauagcccugaggaauauaagcuaaacucuguccuguacgguuaugacaccaauaacgggggaauguacaucgagccagaaggcacuuucuuuacauacgagagagaggcccaggaauccaccuauacgcucgaggaacuguucaggcacgaguacacccacuaucuucagggccgguacgcugugcccgggcaguggggacguacaaagcuguaugauaaugaccgcuugacuugguacgaggaagguggcgccgagcucuuugcagggucaaccagaacaagcggcauucugccgaggaaaaguaucguuucuaacauccauaacacuacccggaauaaccgauauaaguuauccgacacagugcacagcaaauacggagccucguucgaauuuuacaauuaugcuuguauguucauggauuacauguauaacaaggacauggguauucugaauaaacuaaacgaucucgcgaagaauaacgacgucgauggguacgacaauuauauacgcgaucugucuuccaacuacgcacuuaaugacaaauaucaagaucauaugcaggagagaaucgacaacuacgaaaauuugaccgugccuuuuguagccgaugacuaccugguuaggcacgcuuauaagaaccccaaugagauuuacucagagaucagugaaguggccaagcucaaagaugcaaagagcgaggucaaaaagucccaguauuucucuacuuuuacgcugcggggcagcuacacaggaggcgccucaaaagggaaacuugaagaccaaaaggcuaugaacaaguucauugacgauagucugaagaaauuggacaccuauuccuggagcggauacaagacucucaccgccuauuuuacaaacuacaaaguggauucuucaaaucgcgucaccuacgacgugguuuuccacgguuaucugccaaacgagggcgauaguaagaauagcuuaccuuacgggaagaucaacggaacuuauaaaggcacagaaaaggagaaaauaaaguuuuccucugaggguucguucgaccccgaugggaaaaucgugagcuacgaaugggacuucggcgauggaaauaaguccaacgaggaaaauccagagcauucauaugacaagguaggcacguacaccgucaaacugaaggugacugaugacaaaggggaaaguucuguuagcacaaccacagcagagauuaaggaucuauccgagaacaaacuccccgugaucuauaugcacgucccuaagucaggagcgcugaaucagaaagugguauuuuacgguaagggcacuuacgacccagacgggagcauugcuggauaucagugggauuucggcgacgguucugauuuuuccagugaacagaacccgagccauguguacaccaagaaaggggaguauacgguuacccuuagagucauggacucuuccggccaaaugucagaaaagacaaugaaaaucaagauaacugaucccguguacccuauuggaaccgagaaagagccaaauaacaguaaggaaacagccagcggccccaucgugccugggauuccagucucgggaacuaucgagaauaccuccgaccaggauuauuucuacuuugacguuauaacgcccggcgaagugaagaucgauauuaacaaauuggguuaugggggagcaacaugggugguauacgacgagaauaacaacgccgucucuuacgcuaccgaugacggccagaaucugagcgguaaguucaaagccgacaagccgggcagguauuacauccaccucuauauguuuaacgggucauacaugccuuaucguauuaauaucgaaggaagugugggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2885 - RNA, 3382 nt, Artificial Sequence
  mRNA product Design2 comprising derived and/or modified sequence from Clostridium histolyticum__BAA34542.1__HsALB(1-18)_ColH(41-1021) (opt3)
ggggcgcugccuacggagguggcagccaucuccuucucggcaucaagcuuaccaugaagugggugaccuucaucagccugcucuuucuuuucuccucugccuacucaguccagaacgagaguaaaagauauacaguuagcuaccugaagacuuugaauuauuacgacuuaguggaucugcuaguaaaaacggaaauugagaaccuccccgaccuguuucaauauuccucugaugcuaaggaguucuacggcaauaaaaccaggaugucguuuauaauggacgaaaucggccggcgcgcaccucaguauacagaaauugaucacaagggaaucccaacucuuguggaggucgugcgagccgguuucuaccugggcuuucauaacaaggaguugaaugaaauuaacaaacguucauucaaggagagaguuaucccgagcauacucgcgauccagaaaaaucccaacuuuaagcuggggaccgaagugcaggacaaaauugucagugcuacaggacugcucgccggcaaugagaccgcaccuccagaggugguaaacaauuucacucccaucuuacaagauugcauuaagaacaucgacagguacgcccuggaugaccuuaaguccaaggcuuuguuuaauguucuggcagccccuacauaugauauaaccgaauaccuacgggcuacgaaggagaaaccagaaaacacucccugguaugguaagauugacggguucaucaaugagcucaaaaagcuggcccuuuacggaaaaauuaacgauaacaauucuuggaucaucgacaacggcauuuaucacauagcgccucugggcaaguugcauagcaauaacaagaucgggauugaaacccucacagaggugaugaaagucuacccauaucuguccaugcagcacuuacagucagcagaccagaucaagcgccauuacgauaguaaagacgccgagggaaauaagauaccgcuggauaaauuuaagaaggaagguaaagagaaguacugucccaaaacuuauaccuucgacgauggcaaggugauuaucaaagcuggggccagaguggaagaggaaaaggucaagaggcucuacugggcaagcaaagagguuaacucucaauucuuucggguguauggaaucgacaagccucuugaggaaggcaauccagaugacauucugacaaugguaaucuacaacucccccgaggaauauaaacuaaauucaguguuguacgguuaugauaccaacaaugggggaauguacauugagccugaaggcacguucuuuacuuacgagcgcgaggcucaggaaagcacauauacccuggaggaacucuuccgacacgaguacacucacuaucugcagggcagauacgccgucccagggcaguggggaaggacaaaacuuuaugacaacgaucggcugaccugguacgaggaagguggcgcggaguuguuugccgggaguacgcguaccucuggaauacucccccgcaaauccaucgugagcaauauucauaacacaacuagaaauaacagguauaagcugucggacaccguucacucuaaguacggcgcauccuucgaauuuuacaacuaugcuugcauguucauggacuacauguauaauaaagauauggguaucuuaaacaagcugaaugaccuagccaaaaacaaugauguggacggguacgauaacuauauccgggaccucucaaguaauuacgcucugaacgauaaguaucaagaccauaugcaggagcgaauugauaauuacgaaaaccuuacagucccguuuguggccgacgauuacuugguacgccacgcauauaaaaauccuaacgagauauacagcgagaucuccgaaguugccaagcugaaagacgcuaagucugaggugaagaaaagccaguauuucucaacuuuuacccucagaggcaguuacacaggaggcgcguccaaggggaaacuggaagaucaaaaggcaaugaauaaauucauugacgacagccuuaagaagcuggauaccuauucuuggucaggauacaaaacuuugacggccuauuuuacaaacuacaaggucgacaguagcaauagggugaccuacgaugucguguuccacgguuaucuccccaacgagggcgacuccaaaaacucucugccauacgggaagaucaauggaacuuauaaaggcaccgaaaaggagaagauuaaauucucgagcgaggguuccuuugauccugacgggaagaucguuucauacgaaugggauuucggcgacggaaacaaaaguaaugaggaaaaccccgagcauucuuaugauaaggugggcacauacaccguaaaauuaaaggucacugacgauaagggggaaagcuccgugucaacaacgaccgcugagauaaaagaccugagcgagaauaagcuaccaguuaucuauaugcacgugcccaaaucuggagcccucaaccagaaggucguguuuuacgguaaaggcacuuacgauccugacggguccauugcaggauaucagugggacuucggcgaugguagugacuuuagcucugaacagaauccaucccauguauacacaaagaaaggggaguauaccgugacacugcggguuauggauucaaguggccaaaugagcgaaaagacuaugaagaucaaaauuaccgacccggucuaccccaucggaacggagaaggagccuaacaauucgaaagaaaccgccuccggcccaauagugcccgggauuccugugucuggaacaaucgagaacacuagcgaucaggacuauuucuacuuugaugucauuaccccaggcgaaguuaagaucgacauaaauaaacuugguuaugggggagcuacaugggugguguacgaugagaacaauaacgccguaucauacgcaacugacgauggccagaauuugagugguaaguucaaggcggacaaacccggccgcuauuacauccaccuguauauguuuaacggguccuacaugccguauagaauuaacaucgaaggaucugucgggaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2886 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt3)
ggggcgcugccuacggagguggcagccaucuccuucucggcaucaagcuuaccaugaagugggugaccuucaucagccugcucuuucuuuucuccucugccuacucaaugaaaagaaagugccugaguaaaagguugauguuagcuauuacaauggcaacuauauuuacggucaacagcacccugcccaucuaugccgcgguugacaagaauaacgcuacagccgcacggcgccgacguaaaagagugcagaaugaguccaagagguacacuguaucuuaucuaaagacccucaacuacuaugaucugguggaccuucuggucaaaacagaaauugagaauuugccugaucucuuccaauacucgucagacgccaaggaauuuuauggcaacaaaacccggaugagcuucaucauggaugagauugggcgcagagcuccacaguacacugaaaucgaccacaagggaauaccgacacugguggagguugugagggcagguuuuuaccugggcuuccauaauaaagagcucaacgaaaucaauaagcggaguuuuaaggagcgcgucauucccuccaucuuagccauucagaaaaacccuaauuucaagcuggggaccgaagugcaggauaaaaucguaucugcuacgggacuuuuggccggcaacgagacugcgccacccgagguugugaauaacuuuaccccuauacugcaagacuguauuaagaauaucgaucgauaugcacuagacgaucucaaaagcaaggcccuguucaacguccuugcugccccaacauacgacauuacugaauaucugagagcaaccaaagagaagcccgaaaacacaccuugguacgguaagaucgauggguuuaucaaugaguugaaaaagcucgcucuguauggaaaaauuaacgacaauaacuccuggauaaucgacaauggcauuuaccacaucgccccauuaggcaagcugcauucaaacaauaaaauagggauugaaacccucacggaggugaugaagguguauccguaccuuaguaugcagcaucugcagagcgcggaucagaucaagaggcacuacgacucuaaagaugccgagggaaacaagauccccuuggacaaauucaagaaagaagguaaggagaaguauugcccuaaaacuuacacauucgaugacggcaaggucauuaucaaagcaggggcucggguugaagaggaaaaggugaaacgucuauauugggccuccaaggagguaaauucacaauuuuuccgcguguacggaauugauaagccacuggaggaaggcaaccccgacgauauacucaccauggucaucuauaauagcccugaggaauacaaacugaacagugugcuuuaugguuacgacacuaauaacgggggaauguacauugagccagaaggcacauuuuucaccuaugagagagaggcucaggaaucuacguacacccuggaggaauuguuuaggcacgaguauacacacuaccuccagggccgguaugccguucccgggcaguggggacgaacuaagcuguacgauaaugaccgcuuaaccugguaugaggaagguggcgcagagcuguucgccggguccacaagaacuagcggaauccuaccgaggaaaucgaucgugucuaacauucauaacaccacacggaauaaccgcuacaagcucuccgacaccguccacucaaaauacggcgcuaguuuugaguucuauaauuacgcguguauguuuauggauuauauguacaacaaggacauggguauacugaauaaacuuaacgauuuggcaaagaauaacgacguggauggguaugacaauuacaucagagaucugagcuccaacuaugcccucaaugacaaguaccaagaucauaugcaggaaaggauugacaacuacgaaaaucugacuguaccuuucguugcugaugacuaucuugugcgucacgccuacaaaaaccccaaugagaucuauucugagauuagcgaagucgcaaagcugaaagaugccaagucagaggugaaaaagagucaguacuuuuccacguucacauugcggggcagcuauaccggaggcgcuucuaaggggaaacucgaagaccaaaaggccaugaacaaauuuaucgacgauucacugaagaaauuagacacuuacaguuggagcggauauaagacccugacagcauacuucaccaacuacaaggucgauuccucuaaucgagugacuuaugacguuguguuccacgguuaccuaccaaacgagggcgauucgaaaaauagccucccuuaugggaagauaaacggaacauacaaaggcacggaaaaggagaaaaucaaguuuuccucagaggguaguuucgaccccgaugggaagauuguaucuuaugaaugggacuuuggcgauggaaauaaaagcaacgaggaaaauccagagcauuccuacgacaaggucggcaccuauacugugaaacugaagguuacagaugacaaaggggaaucaagcgugucuaccacaacugcggagaucaaggaucuuuccgagaacaaauugcccgucauuuacaugcacgugccuaagaguggagcucugaaucagaagguaguguucuacgguaaaggcaccuaugacccagacgggagcaucgccggauaccagugggauuuuggcgacgguucugauuucuccucagaacagaacccgagucauguuuauacgaagaaaggggaguacaccgucacacucagagugauggacagcucgggccaaauguccgaaaagacuaugaaaauaaagauuaccgaucccguguauccuaucggaacagagaaggagccaaauaacucuaaagaaacugcaagcggccccauugucccugggaucccaguuucaggaaccauagagaauacgagugaccaggauuacuuuuauuucgacgugaucacacccggcgaagugaagauugauaucaacaaacuggguuacgggggagccaccuggguagucuacgacgagaauaacaacgcuguguccuaugccacugaugacggccagaauuuaucugguaaguuuaaagcagacaagccgggcagguacuauauucaccuguacauguucaacgggagcuauaugccuuaccgcaucaauauagaaggauccguuggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2887 - RNA, 958 nt, Artificial Sequence
  mRNA product Design2 comprising derived and/or modified sequence from Homo sapiens__NP_001133.1__HsAMELX (opt3)
ggggcgcugccuacggagguggcagccaucuccuucucggcaucaagcuuaccaugggcaccuggauccuguucgccugccuccuuggggcugcauuugccaugccccugccuccacacccgggacaucccgguuacauuaacuucagcuaugagguguugacaccuuuaaagugguaccaguccauaagaccacccuauccuucuuacggcuaugaaccaaugggaggguggcugcaccaucaaaucauucccguccuaucacagcagcacccuccaacucauacgcuccagccgcaccaccauauccccguugugccugcgcaacagccaguaauuccccagcagccuaugaugccagugcccggccaacacaguaugaccccgauccagcaucaccagccuaaucugcccccuccagcucagcaacccuaccagccacagcccguccaaccucagccacaccagccgaugcagccccaaccuccagugcaucccaugcagccucuuccaccccagccgccucugccacccauguuuccuaugcagcccuugccaccuaugcuccccgaccugacacuggaggccuggccaagcacugauaaaaccaagagggaagagguugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2888 - RNA, 517 nt, Artificial Sequence
  mRNA product Design2 comprising derived and/or modified sequence from Homo sapiens__NP_001133.1__HsAMELX-TRAP (opt3)
ggggcgcugccuacggagguggcagccaucuccuucucggcaucaagcuuaccaugccccugccuccacacccgggccaucccggguacaucaacuucagcuaugaggugcucaccccucuuaagugguaccaguccauuagaccacccuauccuucuuacggauaugaaccaauggguggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2889 - RNA, 550 nt, Artificial Sequence
  mRNA product Design2 comprising derived and/or modified sequence from Homo sapiens__NP_001133.1__HsAMELX-LRAP (opt3)
ggggcgcugccuacggagguggcagccaucuccuucucggcaucaagcuuaccaugccccugccuccacacccgggccaucccggguacaucaacuucagcuaugaggugcucaccccucuuaagugguaccaguccauuagaccacccccuaugcugccagacuugacauuagaagccuggcccucuacugauaaaacgaagagggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2890 - RNA, 589 nt, Artificial Sequence
  mRNA product Design2 comprising derived and/or modified sequence from Homo sapiens__NP_001133.1__HLA-A2-SP_HsAMELX(17-60) (opt3)
ggggcgcugccuacggagguggcagccaucuccuucucggcaucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuauuaggcccccuuauccaucauacgguuaugaacccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2891 - RNA, 622 nt, Artificial Sequence
  mRNA product Design2 comprising derived and/or modified sequence from Homo sapiens__NP_001133.1__HLA-A2-SP_HsAMELX(17-47,168-191) (opt3)
ggggcgcugccuacggagguggcagccaucuccuucucggcaucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuauuaggcccccuccaaugcugcccgaccuuacccuggaggcuuggccuucaacagauaaaacuaagcgggaagaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2892 - RNA, 961 nt, Artificial Sequence
  mRNA product Design2 comprising derived and/or modified sequence from Homo sapiens__NP_001134.1__HsAMELY (opt3)
ggggcgcugccuacggagguggcagccaucuccuucucggcaucaagcuuaccaugggcaccuggauccuguucgccugccucgugggggcugcauuugccaugccccuuccuccacacccgggacaucccgguuacauuaacuucagcuaugagguccugacaccuuugaagugguaccaguccaugauaagaccacccuauucuucauacggcuaugaaccuaugggagggugguuacaccaucaaaucauuccaguugugagucagcagcacccccugacucauacgcuacagagccaccaccauaucccuguagugccagcgcaacagccgaggguccggcagcaggcucucaugcccgugccuggccaacaguccaugaccccaacacagcaccaucagcccaaucugccucuuccagcccaacagcccuuucagccgcaaccuguucagccccagccacaccagccuaugcaaccccagccacccgugcagccuaugcagccacuguugccgcaacccccucucccacccauguucccucugcgcccacugcccccgauucucccugacuuacaccuggaggcauggccagccacugauaaaaccaagcaggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2893 - RNA, 520 nt, Artificial Sequence
  mRNA product Design2 comprising derived and/or modified sequence from Homo sapiens__NP_001134.1__HsAMELY-TRAP (opt3)
ggggcgcugccuacggagguggcagccaucuccuucucggcaucaagcuuaccaugccccugccuccacacccgggccaucccggguacaucaacuucagcuaugaggugcucaccccucuuaagugguaccaguccaugauuagaccacccuauucuucauacggauaugaaccuauggguggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2894 - RNA, 553 nt, Artificial Sequence
  mRNA product Design2 comprising derived and/or modified sequence from Homo sapiens__NP_001134.1__HsAMELY-LRAP (opt3)
ggggcgcugccuacggagguggcagccaucuccuucucggcaucaagcuuaccaugccccugccuccacacccgggccaucccggguacaucaacuucagcuaugaggugcucaccccucuuaagugguaccaguccaugauuagaccacccccuauacugccagacuugcacuuagaagccuggcccgcuacagauaaaacuaagcaagaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2895 - RNA, 592 nt, Artificial Sequence
  mRNA product Design2 comprising derived and/or modified sequence from Homo sapiens__NP_001134.1__HLA-A2-SP_HsAMELY(17-61) (opt3)
ggggcgcugccuacggagguggcagccaucuccuucucggcaucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuaugauuaggcccccuuauucaaguuacgguuaugaaccaaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2896 - RNA, 625 nt, Artificial Sequence
  mRNA product Design2 comprising derived and/or modified sequence from Homo sapiens__NP_001134.1__HLA-A2-SP_HsAMELY(17-48,169-192) (opt3)
ggggcgcugccuacggagguggcagccaucuccuucucggcaucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuaugauuaggcccccuccaauacugcccgaccuucaccuggaggcuuggccugccaccgauaaaacaaagcaggaagaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2897 - RNA, 952 nt, Artificial Sequence
  mRNA product Design2 comprising derived and/or modified sequence from Sus scrofa__NP_999071.1__SsAMELX-001-1 (opt3)
ggggcgcugccuacggagguggcagccaucuccuucucggcaucaagcuuaccaugggcaccuggauccuguucgccugccuccuuggggcugcauuuagcaugccccugccuccacacccgggacaucccgguuacauuaacuucuccuaugagguguugacaccuuuaaagugguaccagaauaugauaagacacccauauacuucuuacggcuaugaacccaugggaggguggcugcaucaccaaaucauuccugucguuucacagcagacgccacagagucaugcccuacaaccccaccaccauaucccuauggugccagcgcagcagccgggcauuccccagcaaccuaugaugccacuccccggucagcacagcaugaccccuacacagcaucaccagccaaaccugccccuuccggcucaacagccuuuucagccccaaccaguacagccucagccccaccagccacugcaaccccaguccccuaugcauccaauccagccguugcucccccagccuccacugcccccuauguucucuaugcaaucgcugcucccagacuuaccccuggaggccuggccggcaacugauaaaaccaagagggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2898 - RNA, 520 nt, Artificial Sequence
  mRNA product Design2 comprising derived and/or modified sequence from Sus scrofa__NP_999071.1__SsAMELX-TRAP (opt3)
ggggcgcugccuacggagguggcagccaucuccuucucggcaucaagcuuaccaugccccugccuccacacccgggccaucccggguacaucaacuucagcuaugaggugcucaccccucuuaagugguaccagaauaugauuagacacccauauacauccuacggauaugaacccauggguggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2899 - RNA, 553 nt, Artificial Sequence
  mRNA product Design2 comprising derived and/or modified sequence from Sus scrofa__NP_999071.1__SsAMELX-LRAP (opt3)
ggggcgcugccuacggagguggcagccaucuccuucucggcaucaagcuuaccaugccccugccuccacacccgggccaucccggguacaucaacuucagcuaugaggugcucaccccucuuaagugguaccagaauaugauuagacacccaucccuguugcccgacuuaccucuggaagccuggccagcuacagauaaaacuaagagggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2900 - RNA, 592 nt, Artificial Sequence
  mRNA product Design2 comprising derived and/or modified sequence from Sus scrofa__NP_999071.1__HLA-A2-SP_SsAMEL(17-61) (opt3)
ggggcgcugccuacggagguggcagccaucuccuucucggcaucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaaauaugauuaggcaccccuauaccucuuacgguuaugaaccuaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2901 - RNA, 625 nt, Artificial Sequence
  mRNA product Design2 comprising derived and/or modified sequence from Sus scrofa__NP_999071.1__HLA-A2-SP_SsAMEL(17-49,167-189) (opt3)
ggggcgcugccuacggagguggcagccaucuccuucucggcaucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaaauaugauuaggcaccccucucugcuuccugaccugccauuggaggcuuggcccgccaccgauaaaacaaagcgggaagaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2902 - RNA, 916 nt, Artificial Sequence
  mRNA product Design2 comprising derived and/or modified sequence from Sus scrofa__P45561-2__SsAMELX-001-2 (opt3)
ggggcgcugccuacggagguggcagccaucuccuucucggcaucaagcuuaccaugggcaccuggauccuguucgccugccuccuuggggcugcauuuagcaugccccugccuccacacccgggacaucccgguuacauuaacuucuccuauauaagacacccuuacacaucuuauggcuacgagccaaugggagggugguugcaucaccagaucauucccguggucucacaacagacuccucagagucaugccuuacagccacaccaccauauccccaugguuccugcgcaacagccaggcauuccgcagcagcccaugaugccucugccaggucaacacagcaugacgcccacccagcaucaccagccuaaucuaccacuccccgcucagcaaccguuucagccucagcccgugcaaccacagccucaccagccccugcagccacaaucccccaugcauccuauccagccacuucugccgcagcccccuuugccacccauguucucuaugcagucgcuccugccugaccugccacucgaagccuggcccgcaacagauaagacuaaaagggaggaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2903 - RNA, 952 nt, Artificial Sequence
  mRNA product Design2 comprising derived and/or modified sequence from Sus scrofa__NP_998965.1__SsAMELX-001-3 (opt3)
ggggcgcugccuacggagguggcagccaucuccuucucggcaucaagcuuaccaugggcaccuggaucuucuuugccugccugcucggggcuagccuugcaaugccccugccuccacacccgggacaucccgguuacauuaacuucuccuaugagguguugacaccuuuaaagugguaccagaauaugauaagacacccauauacuucuuacggcuaugaacccaugggaggguggcugcaucaccaaaucauuccugucguuucacagcagacgccacagagucaugcccuacaaccccaccaccauaucccuauggugccagcgcagcagccgggcauuccccagcaaccuaugaugccacuccccggucagcacagcaugaccccuacacagcaucaccagccaaaccugccccuuccggcucaacagccuuuucagccccaaccaguacagccucagccccaccagccacugcaaccccaguccccuaugcauccaauccagccguugcucccccagccuccacugcccccuauguucucuaugcaaucgcugcucccagacuuaccccuggaggccuggccggcaacugauaaaaccaagagggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2904 - RNA, 601 nt, Artificial Sequence
  mRNA product Design2 comprising derived and/or modified sequence from Sus scrofa__K7GPB2__SsAMELX-002 (opt3)
ggggcgcugccuacggagguggcagccaucuccuucucggcaucaagcuuaccaugggcaccuggauccuguucgccugccuccuuggggcugcauuuagcaugccccugccuccacacccgggacaucccgguuacauuaacuucuccuaugagguguugacaccuuuaaagugguaccagaauaugauaagacacccaucucugcuacccgaccucccucuggaagccuggccagcgacugauaaaacgaagagggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2905 - RNA, 994 nt, Artificial Sequence
  mRNA product Design2 comprising derived and/or modified sequence from Sus scrofa__K7GLD0__SsAMELX-003 (opt3)
ggggcgcugccuacggagguggcagccaucuccuucucggcaucaagcuuaccaugggcaccuggauccuguucgccugccuccuuggggcugcauuuagcaugccccugccuccacacccgggacaucccgguuacauuaacuucuccuaugaggacuuguacuuagaagccauaagaaucgauaggacagcguuugugcugacuccucuaaagugguaucagaauaugauucggcacccauacacgucuuauggcuacgagcccaugggaggguggcuccaucaccaaaucauuccugucguuucacagcagaccccacagagucaugcucugcaaccccaccaccauaucccuauggugccagcccagcagccgggcauaccccagcaaccuaugaugccacuucccggucagcacagcaugacaccuacucagcaucaccagccaaaccugcccuugccggcacaacagccuuuccagccccaaccaguacagccucagccccaccagccacuccaaccccaguccccuaugcauccaauccagccgcugcugccccagccuccauuacccccuauguuuucuaugcaaucgcuccugccagaccuucccuuggaagccuggccggcuaccgauaaaacaaagcgcgaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2906 - RNA, 880 nt, Artificial Sequence
  mRNA product Design2 comprising derived and/or modified sequence from Sus scrofa__K7GPE9__SsAMELX-004 (opt3)
ggggcgcugccuacggagguggcagccaucuccuucucggcaucaagcuuaccaugggcaccuggauccuguucgccugccuccuuggggcugcauuuagcaugccccugccuccacacccgggacaucccgguuacauuaacuucuccuaugagguguugacaccuuuaaagugguaccagaauaugauaagacacccaacuccccaaucucaugcccugcagccucaccaucacaucccaaugguccccgcgcagcagccuggcauuccacaacagccgaugaugccccuaccugggcagcacucaaugacgccaacccagcaucaccaacccaaccucccucugccagcucagcagcccuuucagccgcaaccuguucagccccagccacaucaaccucuucagccccagaguccaaugcaccccauccagccucuguugccacaaccgccccucccuccaauguucagcaugcagucccugcugcccgaccucccuuuagaagccuggccagcaacagauaaaacuaagagggaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2907 - RNA, 904 nt, Artificial Sequence
  mRNA product Design2 comprising derived and/or modified sequence from Sus scrofa__J9JIM4__SsAMELX-201 (opt3)
ggggcgcugccuacggagguggcagccaucuccuucucggcaucaagcuuaccaugccccugccuccacacccgggccaucccggguacaucaacuucagcuaugaggugcucaccccucuuaagugguaccagaauaugauuagacacccauauacauccuacggauaugaacccauggguggcuggcugcaucaccaaauaaucccugucguuucucagcagacuccacagucacaugccuugcaaccccaccaccauauuccuauggugccagcucagcagccggggaucccccagcaaccuaugaugccauuacccggacagcacaguaugacgccuacccagcaucaccagccaaaccugccccuaccggcacaacagccuuuucagccccaaccaguacagccucagccccaccagccacuccaaccccagagcccuaugcauccaauucagccgcugcuuccccagccuccacugcccccuauguucuccaugcaaucuuugcucccagaccugccccuggaggccuggccggcgacagauaaaacuaagagggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2908 - RNA, 3343 nt, Artificial Sequence
  mRNA product Design2 comprising derived and/or modified sequence from Homo sapiens__NP_006120.1__HsBMP1 (opt3)
ggggcgcugccuacggagguggcagccaucuccuucucggcaucaagcuuaccaugcccggcguggccagacugccucuccuucugggguuguuacugcuaccaaggccgggacggccccucgaccuggcugauuacaccuaugaccuugcagaggaagaugacagcgagccucugaacuacaaggauccaugcaaagccgcggcuuucuugggugacaucgcccucgaugaagaggaccugcgcgcauuucagguccaacaggccguugaucugcgacgucacacagcuagaaaguccucuauuaaagcagccgugcccggcaauacuucaacgccuaguugucagagcaccaacgggcagccacaaaggggagcuugcggccgguggcgcgguagauccaggucucggcgcgccgcgacaucgcgacccgaaagaguauggccugacggggugauaccauucgucaucggaggcaauuuuacuggcucacagagggcaguguuccggcaggccaugcgucauugggagaagcacaccuguguuacauuucucgagcgcaccgaugaagacagcuauauuguguucacuuacagaccgugcggguguugcaguuaugucggaaggcgggguggcgggccccaggcuaucuccauuggaaagaacugugauaaguuuggcaucgugguacaugaguuaggucacguugugggguucuggcaugaacacacacgaccugaccgcgacagacacgucucuauagugagggagaauauccaaccaggacaggaguacaacuuucugaagauggaaccccaggagguggaaagccuuggcgagaccuaugauuucgacuccauuaugcauuacgcccggaauacguuuucacgcggcaucuucuuggauacuauugucccuaaauacgaaguuaacggggugaagccacccaucggacagagaaccaggcugaguaaaggugacauagcacaagcucguaagcuauauaaaugcccggccuguggcgagacacuccaggauagcacugggaauuuuucuuccccugaguaccccaacggauauucagcgcacaugcauugcguauggcggauuagcgugaccccaggcgaaaagaucauucugaauuucacaagucuugaccuguaccgaucuagauuguguugguaugauuacgucgaggugagggacgguuucuggcgcaaggccccucuccgggggagauuuugcggcuccaaacugcccgaaccaaucguuagcaccgauucgagguuauggguggaguuccgaucuuccucaaacugggucggaaagggcuuuuucgcaguguaugaagcuaucugcgggggagacguuaaaaaggauuacggucacauucagagucccaauuacccugacgacuaucgcccaagcaaaguauguauauggcggauccaaguguccgagggcuuucacgucgggcugacguuccagucuuuugagauugaacgucaugauagcugcgccuacgacuaucucgaggugagagauggacacucagaaaguuccacucuuaucggcagguacugugguuaugagaagccggacgauauaaaaagcacaucuucacgccugugguugaaguucgucagugacgggagcauuaacaaggcuggcuuugccgugaauuucuuuaaagaaguugaugagugcucccggcccaacagaggaggcugugagcagaggugccuaaacacccuggggucuuacaaguguucgugcgacccuggauaugaacucgcaccagauaaacgacgcugugaggccgcuugcgguggcuuccugacuaaacuuaaugggagcaucacaucccccggauggccuaaagaauacccacccaacaagaauuguaucuggcagcugguggcgccgacccaauaccggauuucauugcaguuugacuucuucgagacggagggcaacgauguaugcaaguaugacuuugucgaagugagaaguggucucaccgcagauucuaaacugcaugggaaguucugcggcagcgagaaaccugaaguuaucacaucccaguacaauaacaugaggguggaguuuaagucagacaauacugucagcaaaaagggauucaaggcccacuuuuucucugacaaagaugaauguuccaaggacaacggcgggugccagcaagauugugugaauaccuuuggaaguuaugagugccagugucguagcggcuucguauuacaugacaacaaacacgauugcaaggaggcugguugugaccacaaagugacaucuacuuccgggaccauuacaucaccaaauuggcccgauaaguacccuaguaagaaagaaugcaccugggccauaagcucgacucccggacaucgcguuaagcugacguuuauggagauggacaucgaaucccagccagagugugcauaugaucaccuagaagucuucgacggccgggaugccaaagcuccugugcucgguagauuuugcggcucuaagaaacccgagccagugcuggccacagggagcaggauguuccuucgauuuuacucagacaacaguguccagcggaagggauuccaagcaucccaugcgaccgaguguggcgggcagguucgcgcugaugugaaaacuaaggacuuguauucucacgcccaguucggagacaauaacuacccgggcgguguggauugcgaauggguaauugucgcagaggaaggguacggaguggagcugguuuuucagaccuucgaaguggaggaggaaacagacugcggcuaugauuacauggagcucuuugacgguuaugauagcaccgccccuagacugggcagguacuguggguccggacccccagaagaggucuauucagcuggcgacagcgugcuuguuaaguuccacagugaugacacuaucacgaaaaagggguuucaucugcgguacacaucuaccaaauuccaagauacuuugcacucccgaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2909 - RNA, 1573 nt, Artificial Sequence
  mRNA product Design2 comprising derived and/or modified sequence from Homo sapiens__NP_001191.1__HsBMP2 (opt3)
ggggcgcugccuacggagguggcagccaucuccuucucggcaucaagcuuaccaugguggccggcaccagaugccugcucgcuuugcuguugccccaggucuuacugggaggggcagccggucuaguuccugagcucggcaggcggaaguucgcggcugccagcuccgggcgcccaucuucacaaccgagugacgaagugcugagcgaguuugaacuucgacuguuguccauguucggacucaaacagcgucccacaccuucuagagaugcaguagugccacccuacaugcuggaccuguauaggcggcacucgggccagccugguucaccagcccccgaucaucgccucgagagagcugcaagcagggccaacacuguccggaguuuucaccaugaagaguccuuagaggaacugccugagacgucugggaagaccacacgccgauucuuuuucaaucuuagcuccaucccaacugaagaguuuauuaccucagcugagcuucagguguucagagaacaaaugcaggacgcccugggaaacaauaguagcuuucaccauaggauaaacaucuacgagauuaucaaaccggcgacagcaaauucuaaguuccccguuacccggcuacucgauacucgucuggugaaccagaaugccucccgcugggaaucauuugacgucaccccugcugugaugagauggacagcccagggccacgcaaaccacggcuucguaguugagguggcucaucuugaagagaaacaaggggucagcaagaggcacgugcggauuagucgaucucugcaucaggaugagcacuccuggagccagauccgcccauugcucgugacguuuggacacgacgguaagggccauccccugcacaaaagagaaaagaggcaggccaaacauaagcaacggaaacgcuuaaagucgucuuguaagagacacccucuguaugucgauuucuccgacguuggguggaaugauuggauaguggcgccacccggauaccaugccuucuauugccacggcgaguguccguuuccucucgcagaccaccuuaacucaacuaaucaugcuaucguacagacccuggugaacagugucaauagcaaaauucccaaggccugcugugugccaacagaauuguccgcuaucucuaugcuauaccuggaugagaacgaaaaaguugugcucaagaauuaucaggacauggucguggaggguugcggguguaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2910 - RNA, 1609 nt, Artificial Sequence
  mRNA product Design2 comprising derived and/or modified sequence from Homo sapiens__NP_001193.2__HsBMP4 (opt3)
ggggcgcugccuacggagguggcagccaucuccuucucggcaucaagcuuaccaugauccccggcaacagaaugcugauggugguccuccuuugccagguucuguuagggggagccagccacgcuuccuugauuccugagaccgguaagaaaaagguggcagaaauacaaggccaugccgggggaaggcggucuggccagucacacgagcugcuacgcgacuucgaagcgacacuccugcagauguuuggucuucgacguagaccacagccgaguaaaagcgcuguaauccccgauuacaugagggaccuguaucgguugcaauccggggaggaagaggaggaacagauucauucuacuggacucgaguacccugaacgcccagccucgagagcaaauacggugaggucauuccaccaugaggagcaccuggaaaacauccccggcaccagcgagaauagugccuuucgguuccuguuuaaccucuccucuauuccugaaaaugaggucaucagcuccgcugaauuacgccuguuccgagaacagguggaucagggcccagacugggagagaggguuucacaggauaaacaucuaugagguuaugaagcccccugcagagguggucccaggacaucuuauuacacgguugcuggauacucgucuagugcaccauaauguaacccgcugggaaacauucgacguuucaccggccgugcucagauggaccagggagaaacaacccaacuacggucuggcuaucgaagucacucaccuucaccagacacggacccaucagggccagcacgugcgaauuagucgcagccugccucaagggucuggaaauugggcccaguugagaccacuccuggugacguuuggccaugaugguagggggcacgcguuaacucggcgcagaagggcaaagcguucccccaagcaucacucacagcgggcccgaaagaaaaacaaaaauuguagaaggcacagccuguaugucgacuucagugauguuggauggaacgacuggaucguggcuccuccaggcuaccaagccuuuuauugccauggcgauugucccuucccgcucgcagaccaccuuaauucuaccaaccaugcuauaguacagacacuggucaauuccgugaacagcucgauuccuaaggccugcugugugcccacugaguugucugcgaucuccaugcuauaccuggaugaguacgacaaaguugugcucaagaacuaucaggaaauggucguggaggggugcggaugucgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2911 - RNA, 1924 nt, Artificial Sequence
  mRNA product Design2 comprising derived and/or modified sequence from Homo sapiens__NP_001709.1__HsBMP6 (opt3)
ggggcgcugccuacggagguggcagccaucuccuucucggcaucaagcuuaccaugcccggccuagggagaagggcccaguggcucugcuggugguggggacuucuguguagcugcugugguccuccaccguugcggcccccuuuaccagcugcagccgcggcugccgcaggcgggcaacugcuaggagacggcgguucccccgggcgcaccgagcagccuccacccucuccucagucaaguagcggauuccucuaccgacgucugaagacacaggagaaaagagaaaugcaaaaggaaauccuuuccgugcugggcuugccacacaggccgcggccccuccauggccugcagcagccucagccacccgcccugcgccaacaggaggaacagcagcaacagcagcaacucccuagaggggagccacccccgggaagguuaaaaucugcuccucuguuuaugcuugauuuguauaacgcacugucggccgacaaugaugaggacggugcuucagaaggcgagcggcagcagagcuggccccacgaagccgcgaguuccucucagcgccgacaaccaccucccggggcagcccauccacuaaacagaaagagccuccuggcucccggauccggcucagguggggccaguccucuuacuagcgcacaggauucugcuuuccugaaugacgccgauauggucauguccuuuguuaacuugguggaguacgacaaagaguucucaccaaggcagcggcaccauaaggaauuuaaguucaaucucagccagauuccggagggagaaguagugacggcggccgaguuucguauauauaaagauugcgucaugggcaguuucaagaaccaaaccuuucugaucucuauuuaccagguguuacaggaacaccagcaccgcgacuccgaucuguuccuccuugacacaagaguugugugggcaagcgaggagggcuggcuggaauuugauaucacugcuaccucgaauuugugggucgugacaccccaacauaacauggggcuacagcugucuguaguuaccagggacggagugcacguccauccucgggccgcuggucucgugggccgagacgggccauaugauaaacagcccuucaugguggccuuuuucaaggucuccgagguucacgugcgcacuacaagaucagcaaguagcaggcggcgccagcaauccagaaauaggucuacccagagccaggacguagcccgugugucaagugcuuccgauuacaacagcucugaacugaaaacggcgugucggaagcacgagcuuuaugucucauuccaagaccugggauggcaggauuggauuaucgcaccuaagggcuacgccgcuaauuacugcgacggugaauguaguuuuccauugaacgcccauaugaaugcaacuaaccacgccauagugcagacccucguucaucugaugaaucccgaguaugugccgaaaccuugcugugcuccaacaaaguuaaacgccaucagcguccuguacuucgaugacaacuccaaugugauucugaaaaaguaucgaaacaugguaguuagagcaugcgggugucacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2912 - RNA, 1678 nt, Artificial Sequence
  mRNA product Design2 comprising derived and/or modified sequence from Homo sapiens__NP_001710.1__HsBMP7 (opt3)
ggggcgcugccuacggagguggcagccaucuccuucucggcaucaagcuuaccaugcacgugagaagccugagggccgcugcaccccauuccuucgucgcccucugggcgccucuuuuucuguugcggucugcuuuagccgacuucucacuggauaacgagguucacaguagcuuuauccaucgccgacuacguucccaggaaagaagggagaugcaacgggaaauucucucuauacugggccuuccacaccgcccgagaccccaucugcaggggaagcacaauucggcaccuauguucauguuggaccucuacaacgccauggcuguggaggaaggagguggcccagggggacagggcuuuucauaucccuacaaagcaguauucagcacccaggguccuccacuggccagucugcaagauucccacuuucucacagacgcugauauggugaugucuuucgucaauuuaguggagcaugacaaggaguuuuuccaccccagguaucaucaccgggaauuucgcuucgaucugagcaaaaucccugagggggaagccguuacugcggcagaguuucgaauuuacaaggacuauaucagagagagguucgauaacgaaacguuccggauuuccguguaccagguccuucaggagcacuugggacgugaaucagaccuguuucuacucgauagucgcacccugugggccagcgaggaaggcuggcuuguguucgacaucacagcuacuucuaaucauuggguaguuaacccaagacacaaucugggcuugcagcucuccguggagacccuggaugggcaaucaauaaacccgaaauuagccggacugaucgguaggcauggcccccagaauaagcagccuuuuauggucgcauucuuuaaggcuacagaggugcacuuccggagcauucgaaguaccgggucuaaacagcgcucccaaaacagaagcaagacucccaaaaaucaggaagcccucaggauggcgaacguggccgaaaauucgucuuccgaccagcggcaagcaugcaagaaacaugagcuuuaugucucauuucgcgaccugggauggcaggauuggaucauugcuccagagggcuacgccgcuuacuauugugaaggugagugcgccuucccuuugaacaguuacaugaaugcaacaaaccacgccaucguucagacccuagugcacuuuauaaacccagagacgguacccaagccguguugcgcuccuacucagcugaaugcgauuagcgugcucuauuucgacgauuccucuaacgucauccugaagaaauacagaaauauggugguuagggcaugugggugccauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2913 - RNA, 682 nt, Artificial Sequence
  mRNA product Design2 comprising derived and/or modified sequence from Homo sapiens__NP_006264.2__HsCCL7 (opt3)
ggggcgcugccuacggagguggcagccaucuccuucucggcaucaagcuuaccaugaaggccagcgcugcacugcucugccuucuguugaccgccgcggcuuucucuccccagggcuuagcccaaccuguggggaucaacacauccacuacguguugcuacagauuuauuaauaaaaagauaccaaaacagaggcuggagucauaucggcgcaccacaaguagccacuguccgcgagaagcagucaucuucaagacuaaacuagacaaggagauuugcgccgaucccacccagaaguggguucaggacuuuaugaaacaucucgauaagaaaacacaaaccccuaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2914 - RNA, 4006 nt, Artificial Sequence
  mRNA product Design2 comprising derived and/or modified sequence from Homo sapiens__NP_001954.2__HsEGF (opt3)
ggggcgcugccuacggagguggcagccaucuccuucucggcaucaagcuuaccaugcugcucacccuuaucauucuguugcccguggucagcaaguucuccuuuguuucuuuaucagccccucagcacuggaguugcccagagggcacacuggcugggaacggaaauagcacuuguguggguccggcacccuuccuaauauuuucccauggcaacucuaucuucagaauugacacggaagggaccaauuacgagcaacucguaguggacgccggagucucggugaucauggacuuucacuauaacgaaaagaggauuuacuggguugaucuggagcggcagcuucugcagcgcguguucuugaauggcucacgacaggaacgugucugcaacaucgagaagaaugugagcgguauggcgauaaacuggaucaaugaggaaguaauuuggaguaaccaacaggaggggaucauuacaguuacugacaugaaaggaaauaacucccauauccuccugucugcucugaaguauccugccaauguggcagucgauccaguggaaagauuuauauucuggagcuccgagguggccggcucacucuacagggcugacuuagauggcgucgggguuaaagcacugcuugagaccagugaaaagauuacagccgugagcuuggacguacuggauaagcggcuauuuuggauccaguauaaccgcgagggaucuaauucccucauuuguucaugcgacuacgaugguggcagcgugcacaucaguaaacaucccacccagcacaaccuguucgcuaugucucuuuuuggggacagaaucuucuauuccacuuggaagaugaaaacaauuuggauagccaacaagcacaccggaaaagauauggucaggaucaaucugcauagcucguuugugccuuugggcgaacucaagguugugcacccacuggcgcaacccaaggcagaggacgacacgugggaaccugagcagaaauuauguaagcugcggaaagguaacugcucauccacugucugugggcaggaucuccagucacaucuuugcaugugugccgagggauacgcucugagucgcgaccgaaaguacugcgaagaugugaaugagugugccuucuggaaccacggcugcaccuugggcugcaaaaauacaccagggagcuauuacuguacuugcccgguaggauucguucuacugcccgacgguaagagaugucaccaacucguguccugcccuaggaacgucucugaauguagccaugauugcgugcugaccucagagggcccacuuuguuuuugccccgaagggaguguccuggagcgggacggaaaaacauguuccggcugcagcucuccugauaaugguggguguucacaguugugcgugccacucagucccguuagcugggagugcgacuguuucccgggcuaugaucugcaguuagacgaaaaguccugcgcagcuucuggaccucaacccuuucugcuauucgccaacucgcaggauauucgucacaugcauuuugacggcaccgacuacgggacgcuccugagccagcagaugggaaugguguaugcgcuugaucacgacccaguagagaauaagaucuacuucgcccauacugcauugaaauggauagaacgcgcuaacauggaugguucccaaagagagaggcugauugaagagggcgucgacgugccugaggggcucgccguugauuggaucggacggcgauuuuauuggacagaccgcggcaagucacugaucgguagaagugaucuuaaugggaaaaggucuaagauuaucaccaaagaaaacauuagccagccccggggcauagcugugcacccaauggccaagcgccuguucuggacugacacaggaaucaaucccagaauugaguccucuagcuugcagggccucgggaggcuggucaucgcaucuuccgauuuaaucuggccuaguggaauuaccauagacuuucugacggauaagcuauacuggugugacgccaaacagagcgugaucgaaauggcuaaccucgaugguucuaagcgucggcgacugacccaaaaugacguaggccacccauucgcgguggcaguuuuugaggacuacgucugguucuccgauugggccaugccgucagugaugagagugaacaaaaggacagggaaggaccgcguccggcuucagggaaguauguugaaacccagcucgcugguuguggugcauccucucgcuaagccaggcgccgaucccugccuguaucagaacggugggugugagcacauuugcaagaaaagauuaggcacugcaugguguuccugcagggaaggauuuaugaaggccucugacggcaaaaccugucuggcucuugaugggcaucaguugcucgccggaggcgagguagaccugaagaaucaagucacaccucuagauauccugagcaaaacucgcgugucagaagacaacauuaccgagagucagcacaugcucguugcagaaaucaugguguccgaucaggacgauugcgcgccagucgguuguucuauguacgcucgaugcauaagcgagggggaggacgccacaugccagugucugaagggauucgcaggcgaugguaaacuuugcuccgacaucgacgaaugugagaugggcgugcccguuugcccgccugccucaagcaaauguauuaauaccgaagggggauaugugugccgguguagugagggcuaccaaggggauggaauccacugcuuggacauugaugaaugucagcugggcgagcauucuugcggugagaacgcuuccuguacuaauacggaagggggauauacaugcaugugcgccggccguuuaagcgagccaggucucaucugucccgacucgaccccucccccacaccugagagaagaugaccaucacuacucaguaaggaacucugauagugagugcccucuuucccaugacggcuauugucugcacgauggggucugcauguacauagaagcauuggacaaguacgcuuguaauugcguggugggauauauuggcgagcgcugucaguaccgggaucucaaauggugggagcugagacacgccgggcauggacaacagcagaaggucaucguuguggcgguaugcguggucgugcuaguuaugcugcuccugcuuagcuuguggggcgcccacuauuacaggacucagaaacuguuaucuaagaaccccaaaaauccauaugaagagagcucccgagacgugcgcucacggagaccggcugacaccgaagaugguaugaguagcuguccucaacccugguucgucgugauuaaggagcaucaggaccucaagaacgggggacagccaguugcaggcgaggauggucaggccgcugacggcucuaugcaacccacauccuggaggcaggaaccucagcugugcgggaugggaaccgagcagggcuguuggaucccagugucaagugauaaagggagcugcccccaagucauggaacguuccuuucacaugccuucuuacggaacucagacacuugagggcgguguagaaaagccgcauucgcugcuaagcgccaauccacucuggcagcaacgcgcacuggaucccccucaccagauggaguugacgcagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2915 - RNA, 892 nt, Artificial Sequence
  mRNA product Design2 comprising derived and/or modified sequence from Homo sapiens__NP_001423.1__HsEREG (opt3)
ggggcgcugccuacggagguggcagccaucuccuucucggcaucaagcuuaccaugaccgccggcagaaggauggagaugcugugcgcugggcgggugcccgcacuccuucuguguuugggauuccacuuacugcaggccguccuaagcacaacuguuaucccuuccugcauuccaggugaaucuucagacaacuguacggcgcucgugcaaaccgaggauaauccgcgcguagcucaggugaguauaacaaagugcagcuccgacaugaacggcuacugucugcaugggcagugcaucuaucuugucgauaugucucagaauuacugucgaugcgaagugggauauacuggcguucguugugagcacuuuuuccugaccgugcaucaacccuugucgaaagaauacgucgcccucacagugauucugaucauucuguuucucaucaccguaguugguucaacuuauuacuucugcagaugguauaggaaccgcaagagcaaagagccuaagaaagaguacgaacgggugacaaguggggacccagaguuaccccaggucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2916 - RNA, 850 nt, Artificial Sequence
  mRNA product Design2 comprising derived and/or modified sequence from Homo sapiens__NP_000791.1__HsFGF1 (opt3)
ggggcgcugccuacggagguggcagccaucuccuucucggcaucaagcuuaccauggccgagggcgaaaucaccacauucacugcucugacggagaaguuuaaccuucccccugggaauuacaaaaagccaaaacuccuguauugcagcaacggaggucacuucuugagaauuuuaccggacggcaccguggaugggacaagggaccgguccgaucagcauauacaacugcagcuaucugcagaaucagucggagagguuuacaucaagaguacugaaaccggccaguaucucgccauggacacagauggucugcuuuacgggagccagacccccaaugaggagugucuguuuuuggaacgccucgaggaaaaccacuauaauacuuacauuuccaaaaagcaugcggagaagaacugguucgugggacugaaaaagaauggcucuugcaaacgaggcccucguacacacuaugggcaaaaggcuauccuguuucucccauuacccguaucgucagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2917 - RNA, 1249 nt, Artificial Sequence
  mRNA product Design2 comprising derived and/or modified sequence from Homo sapiens__NP_001997.5__HsFGF2 (opt3)
ggggcgcugccuacggagguggcagccaucuccuucucggcaucaagcuuaccauggugggcgucgggggaggugacguugaggaugugacccccagaccuggcgggugccagaucagcggaaggggcgcccgggguuguaacgggauuccaggagcugcagccugggaagcggcucugccgcgccgacgucccagaaggcacccuuccguaaauccacggucucgcgccgcaggcucacccagaacaaggggccggcgcacugaggaacgaccuagugggagcagacucggagacaggggucggggccgugcccuuccagggggacgccugggcgguagagggaggggacgggcucccgagcgagugggcggccgcgggagaggaagggguacggcagccccucgggcugccccagcggcacgcggcuccagaccggggcccgccggaaccauggcugccggcucuauaacaacuuugccugcauuaccagaagauggugggucgggcgcuuuucccccuggacauuucaaggacccaaaaaggcuguacugcaagaacggcggguucuuucuacguauccaccccgauggacgggucgacggugugcgagagaaaucagauccgcauauuaagcuccaacugcaggccgaggaaagaggcguugugagcaucaaaggggucugugcgaauagguaucuugccaugaaggaggacggacgccuguuggcaaguaagugcgugaccgaugaauguuucuuuuucgagcggcucgaguccaacaauuacaacacauauagaucuaggaaauacaccagcugguauguagcucugaagcgcacuggccaguacaaacuggguuccaagacagggccuggccagaaagccauucucuuuuuacccaugucagcuaagaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2918 - RNA, 967 nt, Artificial Sequence
  mRNA product Design2 comprising derived and/or modified sequence from Homo sapiens__NP_002000.1__HsFGF7 (opt3)
ggggcgcugccuacggagguggcagccaucuccuucucggcaucaagcuuaccaugcacaaguggauccugaccuggauucuccccacacuucuguacagaagcugcuuccauauaaucuguuuggugggcacuauuuccuuagccugcaacgacaugacgccugagcagauggcuaccaaugucaacuguucuucaccagaaaggcacacacggaguuaugauuacauggagggaggagacauccgcguucgacgucuguuuugcagaacucaaugguaucuaaggauugauaaacgggguaaggugaaaggcacccaggaaaugaagaauaacuacaauaucauggagauacgcacaguagcaguggggaucgucgccauuaaaggaguggaaagcgaguucuaucucgcgaugaacaaggagggcaagcuguacgcuaaaaaggaauguaaugaggacugcaacuuuaaagaacuuauccuggagaaucauuauaacaccuacgccuccgcaaaguggacucacaaugguggggagauguucguugccuugaaccagaaagggauuccggugagaggcaagaagaccaaaaaggaacagaaaacagcucauuuucuccccauggcaaucacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2919 - RNA, 1009 nt, Artificial Sequence
  mRNA product Design2 comprising derived and/or modified sequence from Homo sapiens__NP_001936.1__HsHBEGF (opt3)
ggggcgcugccuacggagguggcagccaucuccuucucggcaucaagcuuaccaugaagcugcuccccagcgugguccuuaaacuguucuuggccgcuguuuuauccgcacuggugaccggcgagucucuagaaagacucaggcgggggcuggccgcgggaacaucaaacccugacccaccgacuguaaguacggaucagcuucugcccuuggguggcgggcgcgaccgaaaggugcgugaucuccaagaggcugaccuggaucugcucagagucaccuuaagcuccaaaccucaggcccuggcaacaccaaauaaggaggaacacggaaaaaggaagaagaaaggcaagggucuugggaaaaagcgggaccccugcuugcgcaaauacaaggauuuuuguauccauggagaaugcaaguaugugaaagagcugagagccccuucuuguauuugccacccaggcuaccauggcgagaggugucacgggcuaucgcuccccguugaaaaccggcuguauacuuacgaccauaccacaauacuugcuguggucgcagugguacugucaagcguuugcuugcucgugaucgucggacuguuaauguuccgcuaucaccgaagagguggcuacgauguggagaaugaagagaaggugaaacuggggaugaccaacagucacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2920 - RNA, 2569 nt, Artificial Sequence
  mRNA product Design2 comprising derived and/or modified sequence from Homo sapiens__NP_000592.3__HsHGF (opt3)
ggggcgcugccuacggagguggcagccaucuccuucucggcaucaagcuuaccaugugggugaccaagcugcuccccgcccuucuguugcagcacgucuuacugcaucuacuccugcuuccuaucgcuauuccauacgcagagggccaaagaaaaaggcggaacacaauacacgaguucaagaaaagcgccaagacuacgcugaucaaaauugacccggcguugaagaucaagaccaaaaagguuaauacagcugaucagugcgccaaccgcuguacucgaaauaaagggcuccccuuuaccugcaaggcauucguguuugacaaagcccguaagcagugucugugguucccuuuuaacuccaugucuucaggaguaaagaaagaguucggucaugaauuugaucuguaugagaauaaggacuacauuagaaacugcaucauaggcaaagggaggaguuauaagggaacagugagcaucaccaaauccggcauuaagugucagccauggucuucgaugaucccccacgaacauucauuccucccuagcaguuaccgggguaaagauuuacaagagaauuauugccgcaacccaagaggggaggaaggaggccccugguguuuuacuuccaauccugaggucagguacgaagugugcgacauuccacaguguucugagguugagugcaugacauguaacggcgaaagcuaucgggggcugauggaucacaccgaguccggaaagaucugccagcgcugggaccaccagacgccgcaucgacacaaguuccuucccgaaagauacccugauaaagguuuugacgauaauuacugcaggaacccagacggccaaccccggccuugguguuauacuuuggauccacauacccguugggaauacugcgcuauaaagacaugugcagacaauacuaugaacgacaccgaugugccccuggaaacaaccgagugcauucaggggcagggagagggcuaucgcgguacggucaauacuaucuggaacgggauuccgugucagagaugggacucacaauacccucacgaacacgauaugacacccgagaacuucaaaugcaaggaccuaagggaaaauuauugucggaacccagauggaagugagagcccuuggugcuuuaccacugaccccaauauccgagugggcuacuguucucagaucccaaacugcgauaugucccauggccaggacuguuaucgcgggaaugguaaaaacuacaugggaaaucucucacaaacaagaagcggccugaccugcaguaugugggauaagaacauggaagaccuucacaggcauauuuucugggagcccgaugccucuaagcugaaugagaacuacugccggaauccugacgacgaugcucacgggccaugguguuauacgggaaacccguugauacccugggacuacugcccuaucucccgcugugaaggcgauaccacaccaacuauuguaaaucucgaccaucccguuaucagcugcgccaaaaccaagcagcugagaguggucaacgguauaccuacaaggacuaauauuggguggauggugucguuacguuaucggaacaaacacaucuguggcggaucucugaucaaggaguccugggugcucaccgcgcgacagugcuucccaucaagagaucuuaaagacuacgaagcauggcugggcauucacgauguccaugggaggggagacgagaaguguaagcagguuuugaacgugagucagcuaguauauggucccgaaggcagcgaucuggugcucaugaaacuggcccgcccggcuguccuugacgauuuuguguccacaaucgaccugccuaauuacgggugcaccauuccagagaagacuucuuguagcguuuauggauggggcuacacggguuugauaaacuacgaugggcuccugcggguggcccacuuauauaucaugggcaaugagaaaugcucacaacaucacagaggaaaggucacacugaacgaaagugagauuugugcaggcgcugagaaaaucggguccggacccugcgaaggugacuacggcgggccucuagugugcgagcagcacaagaugaggaugguacucggaguuaucgugcccggccgcgguugugccauuccaaaucgaccugggauauucguccggguggcguauuacgccaaguggauccauaaaauuauccugaccuauaaggucccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2921 - RNA, 2308 nt, Artificial Sequence
  mRNA product Design2 comprising derived and/or modified sequence from Homo sapiens__NP_005336.3 __HsHSPA1A (opt3)
ggggcgcugccuacggagguggcagccaucuccuucucggcaucaagcuuaccauggccaaggcugcagccaucggcauugaccuggggaccacauacagcugcgugggagucuuccagcacgguaaaguugagauaaucgcgaacgaucaaggcaauagaacuacgcccuccuauguggcuuuuaccgacacagaaaggcucauuggggaugccgcaaagaaccagguagcccuuaauccucagaacacuguguucgacgcuaaacggcugaucggacgcaaguuuggcgauccagucgugcagucugacaugaaacauuggccguuccaaguuauuaaugauggugacaagcccaaggugcaggucucauacaaaggggagaccaaggcauuuuauccugaagagaucaguagcaugguguugacaaaaaugaaggaaauagccgaggcuuacuuaggauauccaguaaccaacgccguuaucacugugcccgcguacuucaaugauucccagcgacaggcaacaaaagacgccggcgucauugcuggccugaacgugcuacguaucauuaaugagccuaccgccgcagcuaucgccuaugggcucgauagaacgggaaagggugaaaggaacgugcugauauuugaccuuggcgggggaacuuucgaugucucuauucugaccaucgacgacggcauuuuugagguuaaggcgacagccggugauacucaccuugggggagaagacuucgauaaucggcucgugaaccauuuuguagaggaguucaaacgcaagcacaaaaaggacaucucgcaaaauaaaagagcagugaggcggcugcgcaccgcuugugaacgagccaagagaacacugucaagcaguacccaggcuucccucgagaucgauucuuuauuugaaggcauugacuucuacacgagcauaacuagggcccgguucgaggaacugugcuccgaucuuuuucguucaacauuggagccagucgagaaagcacugcgcgacgccaagcuagauaaggcucagauccaugaccucgugcugguuggcgggaguacccggauucccaaagugcagaaguugcugcaagauuucuuuaacggaagggacuugaauaaaagcaucaacccugacgaagcggucgcauacggugccgcugugcaggccgcaauacucaugggcgauaagucugagaacguacaggaccuguuacugcucgauguugccccacuuucccugggguuggaaacugcuggaggcgugaugacagcccuaauuaaaagaaauucaaccaucccgacgaagcaaacccagaucuucacaacuuauagcgacaaccagcccgguguccugauucagguguacgagggggaacgagcaaugaccaaggauaauaaccuccugggccgcuuugagcuuaguggaaucccuccagcgcccagaggcgucccucaaauugaggugacauucgacauagaugcuaaugggauccugaacguuacugccaccgacaaaucuacaggaaaggcaaauaaaauuaccaucacuaacgauaaggguagguuguccaaagaagagaucgaacggauggugcaggaggccgaaaaguauaaggcugaggacgagguacagcgcgaaagagucagcgccaaaaaugcacucgagucguacgcuuuuaacaugaagucugccguggaagaugagggccugaaagggaagauuuccgaggcggacaaaaagaagguuuuagauaaaugucaggaagugauaucauggcuggacgccaauacgcuagcugagaaggacgaguucgaacacaaaaggaaggaacucgagcaagucugcaacccaaucauuaguggacuguaucagggcgccggugggcccggcccgggaggcuuuggggcacagggaccuaaagguggcagcggguccggacccacaaucgaggaaguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2922 - RNA, 2308 nt, Artificial Sequence; identical to SEQ ID NO: 2921
  mRNA product Design2 comprising derived and/or modified sequence from Homo sapiens__NP_005337.2 __HsHSPA1B (opt3)

SEQ ID NO: 2923 - RNA, 2308 nt, Artificial Sequence
  mRNA product Design2 comprising derived and/or modified sequence from Homo sapiens__NP_005518.3 __HsHSPA1L (opt3)
ggggcgcugccuacggagguggcagccaucuccuucucggcaucaagcuuaccauggccaccgcuaagggcaucgcaauugggauagaccugggaacaacuuacagcugcgugggugucuuccagcacggcaaaguugagaucauugccaacgaucaagggaauagaacgacccccuccuauguggcguuuacagacacugaaaggcucaucggagaugcugccaagaaccagguagcaaugaauccucagaacaccguguucgacgccaaacggcuuauuggccgcaaguuuaaugauccagucgugcaggcugacaugaaacuguggccguuccaaguuaucaacgagggugggaagcccaagguguuggucucuuacaaaggagaaaauaaggcauuuuauccugaggaaauaucaaguaugguguuaacaaaacugaaggagaccgccgaggcuuuccuaggccauccaguaacuaacgccguuaucacagugcccgcguacuuuaaugauagccagcgacaggcaaccaaagacgccggcgucauugcugggcucaacgugcugcguaucauuaaugaaccuacggccgcagcuaucgccuauggacuugauaaggguggccagggggagagacacgugcugauauucgacuugggaggcgguacuuuugaugucuccauucucaccaucgacgaugggauuuucgaaguuaaggcgacagccggagacacucaucugggcggcgaggacuuugauaacaggcuggugucucacuucguagaggaauuuaaacggaagcauaaaaaggacaucucgcaaaauaaacgcgcagugagaaggcuccggaccgcuugugagcgcgccaagcgaacauuaucaagcaguacccaggcuaaccuggaaaucgauucccuuuacgaggggauugacuucuauacgucuauaacuagagccagguucgaagaguugugcgcagaucuguuucggggaacacuagagccagucgaaaaagcccuccgugacgcuaagauggauaaggcgaaaauccacgacauugugcugguugguggcagcacccgcauccccaaggugcagagacuucugcaggauuacuucaaugggagggacuugaacaaauccauaaacccugaugaggcagucgccuacggagcugccgugcaagcagccauucucaugggcgacaagucagaaaaaguacaggaccuguuacugcucgauguugcuccacuuagucuggguuuggagacugccgggggcgugaugacagcacuaaucaagcggaauagcaccaucccgacgaagcagacccaaauuuuuacaacuuauucugacaaccagcccggaguccugauccagguguacgaaggcgagcgagcgaugaccaaagauaauaaccuccuggggcgcuucgaccuuacagggauuccuccagcucccagaggugucccucagauagaggugacuuuugauaucgacgccaauggcauucugaacguuaccgcaacagauaaguccaccgggaaagugaauaagaucacuaucacgaacgacaaaggaagguugucaaaggaagagauugaacggaugguacucgaugccgagaaguauaaagcugaagacgagguccaacgcgagaagauagccgcuaaaaaugcacuggaaagcuacgccuucaacaugaagagugugguuucugaugagggcuuaaaagguaagaucuccgaaagcgacaagaauaaaauucuggauaaguguaacgagcuacucucguggcuggaggugaaucagcuugcggaaaaagacgaguuugaccacaagagaaaagaauuggagcagaugugcaacccaaucauuacaaagcuguaucagggaggcuguaccggacccgccugcggcacuggguacgucccgggaaggccugcuaccggucccacaaucgaagagguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2924 - RNA, 2302 nt, Artificial Sequence
  mRNA product Design2 comprising derived and/or modified sequence from Homo sapiens__NP_068814.2 __HsHSPA2 (opt3)
ggggcgcugccuacggagguggcagccaucuccuucucggcaucaagcuuaccaugagcgccagaggccccgcuaucgggauugaccugggaaccacauacuccugcgugggugucuuccagcacggcaagguugagauaaucgcaaacgaucaagggaauaggacuacgccuucuuauguggccuuuaccgacacagaacggcucauuggagaugcggcuaaaaaccagguagccaugaauccaacuaacaccaucuucgacgcaaagcgccuuauuggccgaaaauuugaggaugccacagugcagucagacaugaagcauuggccguuccgugucgugagugaaggugggaaacccaagguucagguggaguacaagggagaaaccaaaacauuuuucccugaggagaucagcuccaugguccugacuaagaugaaagaaauagcugaggcauauuugggcggcaaggugcacucugccguaaucaccguuccagcuuacuuuaaugauucgcaaagacaggccacgaaagacgcggggacuauuaccggauuaaacgugcugaggaucauuaaugaacccacagcagccgcuaucgccuauggucuagauaagaagggcugugcagggggagagaaaaacguccucauauucgaccugggcggugggacuuuugaugugucaauucuuaccaucgaggacggaauuuucgaagucaagagcacagcuggcgauacccaucugggcggggaggacuuugacaaucggauggugagucacuuggccgaagaguucaaacgcaagcauaaaaaggauaucggaccuaacaaaagagcgguuaggcggcuccgcacggccugcgaacgagcaaagagaacucuguccucuagcacacaggcuuccaucgagauugacucacuguacgaggguguggauuuuuauaccaguauaacuagggcccgguucgaggaacucaaugcugacuuauuccguggcacacuggaaccaguagagaaggcccuucgcgaugcaaaauuggacaaggggcagauccaagaaauugugcuggucggaggcagcaccagaauccccaaaauacagaagcuacuccaggacuuuuucaacgguaaagagcugaauaagucuauuaacccugaugaggccguggcuuacggggcggcaguucaggccgcuauccuuaucggcgauaaguccgaaaaugugcaagaccuguugcuccuggaugucacgccauuaucacugggaauugagaccgccggcggggugaugacaccgcucaucaaaaggaacacuaccauucccacaaagcagacucagaccuuuacaaccuacagcgacaaccaaaguucuguacuuguucagguguaugaaggagagcgggcaaugacuaaagacaauaaccuguuggguaaguucgaucuaacgggcauaccuccagcuccccgaggggucccucagaucgaagugacauuugacauugaugccaauggaauccugaacgucaccgccgcagacaaauccacuggcaaggagaauaagaucaccauuacaaacgauaaaggucgccucagcaaggacgauauagacagaauggugcaggaggcggaaagguacaaaucggaggaugaagcuaaucgggaccgcguugccgcaaagaacgcccuggagucuuauaccuacaauaucaaacaaacuguggaggaugaaaaacuuagagggaagauuuccgagcaggacaagaacaagauccuggauaaaugucaggaaguaauuaauugguuggacaggaaccagauggcugagaaggacgaauaugagcacaaacaaaaggagcucgaacgugucugcaauccaaucauaucaaaacuguaccagggcggacccggcgggggaagugguggcgggggaagcggcgccuccggugggccgacaaucgaggaaguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2925 - RNA, 2905 nt, Artificial Sequence
  mRNA product Design2 comprising derived and/or modified sequence from Homo sapiens__NP_002145.3 __HsHSPA4 (opt3)
ggggcgcugccuacggagguggcagccaucuccuucucggcaucaagcuuaccaugagcguggucggcaucgaccugggguuccaguccugcuacguugccguggcuagagcaggagguauugagaccauagccaacgaauauucugauagguguacacccgcgugcaucucauuuggcccuaagaaucggaguauuggggcugccgcaaaaagccaaguaaucuccaacgccaagaauacugugcagggauucaaacgcuuucacggccgagcuuucucugacccauuugucgaggcagaaaagucgaaccucgccuacgauauugugcagcuuccgacgggucugaccgggaucaaaguuacauauauggaggaagaacguaauuucacuaccgaacaggugacagcuauguuguuaucaaagcugaaggaaaccgccgagagcguccucaaaaagcccgugguagacuguguugugagugucccuugcuuuuacacugaugcggaaagaagguccgugauggacgcaacacaaauagccggacuaaacugucugcggcuuaugaaugagaccacggcuguggcccuggcauauggcaucuacaaacaggauuugccagcucucgaggaaaagccccgcaacgucguuuucguggacaugggccauucugccuaucagguaagcgugugcgcguuuaauagagggaaacugaagguccuggccacugcauucgauaccacacucggagguaggaaguuugacgagguguuaguuaaccacuucugugaagaguuuggcaaaaaguacaaacuggauauuaaguccaaaauccgggcucuuuugcgccugucacaggaaugcgagaagcucaaaaagcuaaugagugccaaugcuagcgaccugccucuuucuauugaguguuucaugaacgauguggacgucuccgggacuaugaaucgaggaaaguuccuggaaaugugcaacgacuugcucgccagaguggagccaccccugaggucaguauuagaacaaaccaaacugaagaaagaggauaucuacgcaguugaaauagugggcggugccacacggauuccugcugucaaggagaaaaucagcaaguuuuucgggaaggagcucaguaccacgcuuaaugcggacgaagcagugacucguggaugugcccugcagugcgcuauuuugucuccagccuuuaaaguccgcgaguucuccaucacagaugugguuccguaucccaucagccuaagauggaacucgccugcagaagaggggucuuccgacugcgaaguguuuucaaagaaccaugccgcuccauucaguaaaguacugaccuuuuacaggaaggagcccuucacucucgaggccuauuacagcuccccucaggaucugccauaucccgacccggcaauugcgcaguuuucuguccaaaaagugacaccucagagcgauggcucaaguuccaagguuaaggugaaaguccgggugaauguacacggcauauucagcgugucuucagcuagucuuguugaaguccauaagagcgaggaaaacgaggagcccauggaaaccgaccagaaugccaaagaggaagagaagaugcaaguggaucaggaggagccacacguggaggaacagcagcaacagacgccugcagagaacaaagccgaauccgaggaaauggagaccucucaggcuggaucgaaggacaagaaaauggaucagcccccacaagccaagaaagcaaaggucaaaacaagcacuguugaccugcccaucgagaaucaguugcucuggcagauugaccgagaaaugcugaacuuauacaucgagaaugaagguaagaugauaaugcaggauaaacuggagaaggaacgcaacgacgcuaagaaugccguggaggaguauguguacgaaaugagagauaaacuauccggcgaguacgaaaaguuuguaucagaggacgauaggaacaguuucacccucaaacuggaggacacagaaaauuggcuuuaugaggauggggaagaccaaccuaagcaggucuacguggauaaauuggcggagcugaagaaccucggacagccaauuaagauccgguuucaggaaucugaggagcgcccgaaacuguucgaggagcuuggcaagcaaauccagcaguauaugaaaauuaucagcuccuucaagaauaaagaagaccaauacgaucaccuggacgccgcugauaugacuaagguugagaagucaaccaacgaagcaauggaguggaugaauaacaaauugaaccuccagaauaagcagagccugacaauggaccccguggucaaaucuaaggagauugaagccaaaauaaaggaguuaaccuccacuuguaguccuaucauuagcaagccaaaacccaagguggaaccuccaaaagaggaacagaagaacgcugagcaaaauggucccguugacgggcagggcgauaacccgggaccucaggccgcagagcagggcacggacacagcggugccaucugauuccgacaaaaagcugcccgaaauggauaucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2926 - RNA, 2902 nt, Artificial Sequence
  mRNA product Design2 comprising derived and/or modified sequence from Homo sapiens__NP_055093.2 __HsHSPA4L (opt3)
ggggcgcugccuacggagguggcagccaucuccuucucggcaucaagcuuaccaugagcguggucggcaucgaccugggguuccucaacugcuacauugccguugcuagauccggagguauagagaccaucgcaaaugaauauucugauagguguacacccgccugcauuucacuuggcagucggacucgcgcgaucgggaacgcugccaagagccagauugugacgaauguacgaaacaccauccacggauuuaaaaagcugcauggccguuccuucgacgauccuauagugcaaacagagagaaucagguugccauacgaauuacagaaaaugccgaaugguucugcaggggucaaggugcgguaucuggaggaagagagacccuuugccauugagcagguuacuggaaugcuacucgcuaaacugaaggaaaccucggagaacgcacuuaagaaaccuguggccgacugugucaucucaauucccagcuucuuuacagaugcugaaagaaggagugugauggccgcggcacagguagccggccugaauugcuugcggcucaugaacgagaccacugcuguugcccuggcauacggcaucuauaagcaagaccugccaccucucgaugagaaaccacgcaauguggucuucauagacauggggcacuccgcuuaccagguguuagugugugccuuuaacaagggaaaacugaagguccuugcgacaaccuucgaucccuauuuggguggccgaaauuuugacgaagcccugguugauuacuucugcgacgaguuuaagacgaaauacaagauuaacgugaaagaaaauucuagagcacuacucaggcuguaucaggagugugaaaaacuuaagaagcugaugagcgcuaacgccuccgauuugccucucaauaucgagugcuucaugaacgaccuggacguaucaaguaaaaugaaccgggcucaguuugagcaauuaugugccagccugcucgcacguguggaaccaccgcuuaaggccgucauggagcaggcuaaucugcagcgcgaagauauuucuuccaucgagaucguugggggagcgacucgcauucccgcagugaaggaacagauaaccaaauucuucuugaaggacaucucaacaacucuaaacgccgaugaggcuguggccaggggcugcgcacugcaaugugccauucucagcccugcuuuuaaaguccgggaguucaguaucaccgaccuggugccauacucuauaacacuucgauggaagaccuccuuugaagaugguagcggggagugcgaaguauucugcaaaaaucaucccgccccuuuuucgaagguuauuacguuccacaagaaagagccauuugaacuggaggcauucuauacuaacuugcaugaggugcccuacccggacgcgcgcaucggaucuuuuacaauccagaaugucuucccucaguccgauggcgacucaaguaaggugaaagucaaggugagaguuaacauucacggcaucuuuagcguggcuuccgccucuguaauugaaaaacaaaaucucgagggggaucacagcgacgcacccauggaaaccgagacuucauucaagaacgagaauaaggauaacauggacaaaaugcaggucgaccaggaagagggacaucagaagugucacgccgaacauacaccagaggaagagauagaucacaccggugcuaaaacgaagagugccguguccgacaaacaagauaggcugaaucagaccuuaaagaagggcaaaguuaagagcaucgaccugccuauucagucuucacuaugccggcagcucgggcaagaucugcuuaacaguuauaucgagaaugaaggaaaaaugaucaugcaggacaaguuggagaaagaacgcaacgaugcaaagaaugcuguggaggaauacgucuaugacuuuagagauaggcugggcacaguguacgagaaauucauuacucccgaggaccucagcaagcuguccgccguacuugaagauaccgagaacuggcuguacgaagacggugaggaucagccaaaacagguguauguugacaaguugcaagaacucaagaaauacgggcagcccauacagaugaaguauauggagcacgaggaacguccuaaagcgcugaacgacuuaggcaagaagauccagcuggucaugaaagugauugaggccuaccggaauaaggaugaacgauaugaccaucuagauccaacagagauggagaaaguggaaaaguguaucucugacgcuaugucguggcucaacagcaaaaugaaugcacaaaacaagcugucccuuacucaggauccggucguuaaggugucagagauuguggccaaaaguaaggaauuggacaauuucugcaaccccaucauauacaaaccuaagccaaaagcugagguacccgaagauaagccuaaggccaauucugagcacaacggaccaauggacggccagagcgggaccgagacaaaauccgauucaaccaaggacagcucucaacauacuaaauccaguggagaaauggaggucgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2927 - RNA, 2347 nt, Artificial Sequence
  mRNA product Design2 comprising derived and/or modified sequence from Homo sapiens__NP_005338.1__HsHSPA5 (opt3)
ggggcgcugccuacggagguggcagccaucuccuucucggcaucaagcuuaccaugaagcugagccucguggccgcuaugcuucuguuguuauccgcagccagagcggaggaagaggacaaaaaggaagaugucggcaccguuguggggaucgaccugggaacaacuuacucuugcguagguguguucaaaaacggcagggucgagauuauagcuaaugaucaggggaaccggaucacgcccucauauguggccuuuaccccugaaggagagcgccuaauuggcgacgcagccaagaaucaacucacaaguaacccagagaauacuguuuucgaugcuaaacgacugaucggucguaccuggaacgacccgagcgugcagcaggauauuaaguuucuucccuucaaggucguggaaaagaagacaaaaccuuacauccagguagacauagggggaggccaaaccaagacuuuugcaccagaggaaaucuccgccaugguucugacaaaaaugaaggagaccgcugaggccuauuugggcaagaaagugacgcacgcggucgugacugugcccgcauacuucaaugaugcccagagacaggcuaccaaggacgccgggacaauugcaggacucaacgucaugaggaucauuaaugaaccuacugcugccgcgaucgccuauggucuggauaaacgggagggcgaaaagaacauacugguuuuugaccucgggggaggcaccuucgaugugucuuuacugacaauugacaaugguguauuugagguggucgcaaccaacggggacacgcaucuuggaggcgaagauuucgaccagcgcgugauggagcacuuuaucaaauuguacaagaaaaagacuggcaaggauguuagaaaagacaauagggcugugcaaaagcugcggcgcgaggucgaaaaagccaagcgagcucuaucgucacagcaucaggccagaauugagaucgaaucuuucuaugagggggaagauuuuagugagacacucaccagggcaaaauucgaggaacugaacauggaccuuuuccgguccacuaugaagccagugcagaagguacuggaggauucugacuugaaaaagagcgauaucgacgaaauuguucucgugggagguuccacacguauacccaaaauccaacagcuggucaaggaguuuuucaauggcaaagaaccuucacgcgggauuaacccagaugaggccguggcuuacggagcggcaguccaggccggcguguuaaguggugaccaagacaccggggaucugguucuccuugacguguguccgcugacguugggcaucgagaccguaggaggcgucaugacaaagcuaauacccagaaacacugugguuccuaccaagaaaagccagauuuuuagcacagcuuccgauaaucagccaacugugaccaucaaggucuacgaaggggagaggccccugacaaaagacaaccaccuccugggaaccuucgaucuuacugguaucccuccagcaccccggggcgugccgcagauugaaguaacguuugagaucgacgugaaugggauucugcgaguuacagccgaggauaagggaaccggcaacaaaaauaagauaacuaucaccaacgaccaaaaucgcuugacaccugaagagauugaaagaauggucaacgaugccgagaaguucgcugaagaggacaaaaagcucaaagagaggaucgauacccggaaugaacuggagucauaugccuacagcuuaaagaaccagaucggugacaaagaaaagcuagggggcaaacugaguucugaggauaaggaaacuauggagaaggcaguggaggagaaaauugaauggcucgaaucccaucaggacgcggacauagaggauuuuaaggcuaaaaagaaagaacuggaggagaucgugcagcccauuaucagcaaacuuuauggaucggccggcccaccucccacaggggaagaggacacggcagaaaaggaugaguugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2928 - RNA, 2314 nt, Artificial Sequence
  mRNA product Design2 comprising derived and/or modified sequence from Homo sapiens__NP_002146.2__HsHSPA6 (opt3)
ggggcgcugccuacggagguggcagccaucuccuucucggcaucaagcuuaccaugcaggcccccagagagcuggcugugggcaucgaccucgggaccacauacagcugcgucggaguuuuccaacaggguaggguggaaauucuugcaaacgaucagggcaaucggacuacgccuuccuauguagccuuuaccgacacagagcgccuggugggggaugcggcuaagucucaggccgcauugaacccacacaauacugucuucgacgccaaacgauuaauaggacguaaguuugcugauaccacagugcaaucagacaugaaacauuggccguucagaguugugagugaaggcgguaagcccaaagucaggguguguuaccgcggggaggauaagaccuuuuauccugaagagaucagcuccaugguacugucuaagaugaaagagacugcagaagccuaccuaggacagccaguuaagcacgcugugauuacaguccccgccuauuucaacgacucgcagcggcaggcgaccaaagaugcaggcgccaucgcuggccucaaugugcugagaauuaucaacgagccuacggccgcagcuauagccuacgggcuugacaggcggggagcgggugaacgcaaugugcugaucuuugauuugggcgggggaacuuucgacgucucaguucucagcauugaugccggcguguuugagguaaaggcaaccgcuggugacacacaucucgggggagaggacuucgauaaccgacuggugaaucacuuuauggaagaguucagaaggaaacauggcaaggaccugaguggcaacaagcgggccuuacgucgccugagaacugcuugcgaaagggccaaacggacccuuuccucuagcacacaagcaaccuuggagaucgauucccuguuugaaggggucgacuucuauacgucaauuacucgagcccgcuucgaggagcuauguagugaucucuuuagaagcacacuggaaccaguggagaaggcucuuagggacgcgaaacuggauaaggcacagauccacgacguuguguuggucggagguucuacccggauacccaaagugcagaagcuccugcaggauuucuuuaauggcaaagaauuaaacaaguccauuaauccugacgaggccguagcuuacggggccgcaguucaagccgcugugcugaugggagauaagugcgaaaaaguccaggaccuccuucuguuggacguggccccacuaucacugggccucgagacugccgguggggucaugacaacccugauccagcgcaacgcgacgauuccgaccaagcaaacacagacuuucaccacauacagcgauaaucagcccggcguguuuauccagguuuaugagggagaaagagcuaugacuaaagacaacaaccuucugggcagguucgaguugagugggaucccuccagcaccccguggagugccucaaauugaaguaaccuuugauauagacgcaaaugguauccucucugucacagccaccgaucgguccacuggcaaggcuaacaaaauuacgaucacaaaugacaaggggcgacugagcaaggaggaaguggagagaaugguucacgaggccgaacaguacaaagcagaggaugaagcucagagggaccgcguggccgcgaagaacucguuagaggcccaugucuuccacgugaaaggaucucugcaggaggaaucccuacgggauaagauaccagaggaagacagaaggaaaaugcaagauaagugucgcgagguacucgcuuggcuggaacauaaucagcuugcagagaaggaggaauaugagcaccagaaacgagaauuggagcagauuugccggcccaucuuuucacgucuguacggcgguccgggggugccuggcggaaguagcuguggcacccaagccagacagggggaccccuccacuggaccaaucauugaagagguugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2929 - RNA, 1486 nt, Artificial Sequence
  mRNA product Design2 comprising derived and/or modified sequence from Homo sapiens__P48741__HsHSPA7 (opt3)
ggggcgcugccuacggagguggcagccaucuccuucucggcaucaagcuuaccaugcaggcccccagagagcuggcugugggcaucgaccucgggaccacauacagcugcgucggaguuuuccaacaggguaggguggaaauucuugcaaacgaucagggcaaucggacuacgccuuccuauguagccuuuaccgacacagagcgccuggugggggaugcggcuaagucucaggccgcauugaacccacacaauacugucuucgacgccaaacgauuaauaggacguaaguuugcugauaccacagugcaaucagacaugaaacauuggccguuccagguugugagugaaggcgguaagcccaaagucagaguguguuacaggggagaggauaagaccuuuuauccugaagagaucagcuccaugguacugucuaagaugaaagagacugcagaagccuaccuagggcagccaguuaagcacgcugugauuacaguccccaccuauuucucgaacucacagcggcaagccacgaaagacgcgggcgcaaucgccggccucaaggugcugccuauuaucaaugaggcuacugccgcagcuauagccuacgggcuugaucgcagaggagcggguaaaaggaacgugcugaucuuugacuugggcgggggaaccuucgaugucagcguucucaguauugacgccggcguguuugaaguaaaggcaacagcuggugauacucaucuugggggagaggacuucgacaaucggcuggugaaccacuuuauggaggaguuccgccgaaagcauggcaaagaucucuccggcaauaagagagccuuaaggcggcugcguaccgcuugcgagcgcgccaaaagaacaccaucuagcuccacccaggcaacgcuugaaaucgacucauuguuugagggggucgauuucuauaagaguauuacuagggcccgguucgaagaacuguguagcgaccuauuucgaucuacacucgagcccguggaaaaagcucugcgcgaugcgaagcuggacaaagcacagauccacgauuucguucugggagguggcuugcacucccauccucagggggccgagguggcugccggacuccugcaaagacagggcgcagaacaggagcaccaaccaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2930 - RNA, 2323 nt, Artificial Sequence
  mRNA product Design2 comprising derived and/or modified sequence from Homo sapiens__NP_006588.1 __HsHSPA8 (opt3)
ggggcgcugccuacggagguggcagccaucuccuucucggcaucaagcuuaccaugagcaagggccccgccguggggaucgaccugggaaccacauacuccugcgucgguguuuuccagcacggcaaaguggagauuauagcuaacgaucaagggaauagaacuacgccuucuuauguagcauuuaccgacacagaaaggcucaucggagaugccgcgaagaaccagguggcuaugaauccaacuaacaccgucuucgacgccaaacggcuuauuggccgccgauuugaugacgcagugguucagucagauaugaagcauuggccguucaugguggucaaugacgccggucgucccaaagugcagguagaguacaagggggaaacaaagaguuuuuauccugaggaaguuagcuccauggugcugaccaaaaugaaggagaucgcugaggcauacuugggaaaaacugucacaaacgccguggugaccgucccagcuuauuucaaugauucucaaagacaggccacgaaggacgcgggcacuauugcaggcuuaaacguucugaggaucauaaaugaacccaccgccgcugccaucgcauacgggcuagauaaaaaggugggagcugagcggaacguacucauuuuugaccuggguggcgggacauucgaugugucgauccuuacuauugaagacggaaucuuugaggucaagucaaccgccggcgacacacaccuggguggggaggauuucgacaaucgcauggugaaccauuuuauagcggaauuuaaaagaaagcacaaaaaggauauuagcgagaauaaaagggccguucggcgcuugcgaaccgcaugugaaagagcuaagaggacgcucaguuccucuacucaggccagcaucgagauugacucccuguaugaaggaaucgauuuuuacacaucaaucacccgggcucguuucgaggagcugaacgccgaccucuuccgcggcacuuuagauccuguggaaaaagcacugagagacgccaaacuugauaagagucagauucaugacauagucuuggugggcgggagcacaaggaucccaaagauucaaaagcugcuacaggauuucuucaauggaaaagagcucaacaagucuaucaaccccgacgaagcuguagcguacggugcagccguucaggcugccauacuguccggcgacaaaucagagaaugugcaggaucuucuguugcucgacgucaccccucugagcuuagggauugaaacggcaggaggcgugaugaccguccugaucaagcggaacacaacuaucccaaccaagcaaacacagacuuuuaccacauauagugauaaucagccgggugugcucauucaaguuuacgagggggagcgagccaugaccaaagacaacaaucuucugggcaaguucgaauugacuggaaucccucccgcuccacgcggcgugccccagauugagguaacguuugauauagacgccaacgggauccuaaaugucucugcaguggauaaauccacaggaaaggaaaacaaaauuaccaucacuaaugacaaggguagacugagcaaggaggauaucgaaaggaugguucaggaggcggagaaauauaaggcugaagacgagaaacagcgggauaaggugucgucuaaaaacucccucgaaucauacgccuucaauaugaaggcaaccgucgaggacgagaagcugcaaggcaaaauuaacgaugaagacaagcagaaaauacuugacaagugcaaugagaucauuaacuggcuggauaaaaaucagacagccgaaaaggaggaauuugagcaccagcaaaaagaguuggaaaagguguguaacccuaucauuaccaagcucuaucagagugcugggggaaugccaggcgguaugcccgggggcuucccgggaggcggggccccucccagcggaggugcauccucuggcccaacuaucgaggaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2931 - RNA, 2422 nt, Artificial Sequence
  mRNA product Design2 comprising derived and/or modified sequence from Homo sapiens__NP_004125.3 __HsHSPA9 (opt3)
ggggcgcugccuacggagguggcagccaucuccuucucggcaucaagcuuaccaugaucagcgccuccagagcugcagccgcgaggcuggugggcgcugccgcaucucgggggcccaccgccgcucgccaccaggacucauggaacggacucagucaugaggcauuccgacuugucagccguagagauuacgccuccgaagcuauuaagggugccguugugggcauagaccuggggacaacuaauucuugcguagcggugauggagggaaaacaagcaaaggucuuggaaaacgccgagggcgcuaggacgaccccuucggugguugccuuuacagcagauggugaacgguuaguggggaugccagcuaaacgccaggccgucacuaauccgaacaauaccuucuaugcgacaaagagacugaucggaaggcgguacgacgaucccgaggugcagaaagacauuaagaacguaccuuuuaagaucguucgcgccucaaauggcgaugcauggguggaggcucacggcaaacuauauagcccaagucagauuggggccuucguccucaugaagaugaaagaaaccgcugagaacuaccugggacauacugccaagaaugcagugaucacagugcccgccuauuuuaacgacucccaacgacaggcuaccaaagaugcgggucagauaucuggccuuaauguccugagaguuaucaacgaaccuacggcagccgcuuuggccuacgggcucgacaagagcgaggauaaggugauugcaguauaugaccugggaggcgguacuuucgauaucuccauucuggagauccagaaagggguguuugaagucaagucaaccaauggagacacauuccucggcggcgaggacuuugaucaagccuuacugaggcacauagugaaagaguucaagcgggaaacugggguugaccuuaccaaagauaacauggcuuugcagcgugugcgcgaagccgcagagaaggcgaaaugugagcugaguagcucuguccagacagacauuaaucuaccauaccucaccauggauuccucaggacccaagcaucugaacaugaaguugacgagagcucaguuugaagguaucgugacugaccugauuaggcggacaaucgccccuugccaaaaagcaaugcaggaugccgagguaagcaagagugacaucggcgaaguuauuuuggucgggggaaugacccgaaugccaaaagugcagcaaacugugcaggaucucuucggccgcgcuccgucuaaggccgucaaccccgacgaggcaguggcuauaggugccgcgauccaagggggcguucuggccggagaugugacagacguauuacugcucgacgucaccccucuuucccugggcauugaaacgcuugggggaguguuuaccaaacuaaucaauagaaacacaacuauaccaaccaaaaagagccagguuuucucgacagcugcagauggucagacucagguggagauuaaggucugucagggcgagagggaaauggccggggacaauaagcugcucggacaguucacccugaucggcauucccccugcuccacggggugugccccaaaucgagguaacauuugauaucgacgccaacgggauugugcacguuucugcaaaagauaagggcaccggacgcgaacagcagauagucauccaguccucaggcgggcuuaguaaagacgauauugagaauauggugaagaacgcggaaaaguacgccgaggaggacagaaggaaaaaggaacguguggaggcugucaauauggccgaaggaaucauccacgauacugagacgaaaauggaggaguucaaggaccaacugccggcagaugaaugcaacaaauugaaggaagagauuagcaagaugcgggaacuccuggcucgaaaagacuccgagacaggugagaauauaagacaggccgcaucuagcuuacagcaggccucacugaagcuauuugaaauggcuuauaaaaagauggcgagugagagggaaggcuccgggagcucuggaaccggcgagcaaaaagaagaucagaaggaggagaaacagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2932 - RNA, 2410 nt, Artificial Sequence
  mRNA product Design2 comprising derived and/or modified sequence from Homo sapiens__NP_079291.2__HsHSPA12A (opt3)
ggggcgcugccuacggagguggcagccaucuccuucucggcaucaagcuuaccauggccgacaaggaggcuggcgggagcgauggacccagagaaaccgcaccuacauccgccuacucuucaccagcgaggagucugggugacacuggcaucacgccgcucagccccucccacauugugaacgauaccgacucuaaugucucggagcagcaaucauuccuuguugugguagcuguggauuuugggacaacuagcaguggauaugccuacuccuucaccaaagaaccugagugcauacaugucaugcggcgcugggaaggcggugacccaggggugucuaaccagaagacacccaccacuauccuguugacaccugagcgaaaauuucacagcuucggauaugcagcccgugauuuuuaccaugacuuagauccaaaugaggcuaagcaguggcuguaucuagaaaaauucaagaugaagcuccacaccacgggcgaccugacuauggauaccgaccuuacagcagccaacggcaaaaagguuaaagcucuggagauuuuugccuacgcguugcaguauuucaaggaacaagcacucaaagagcuguccgaucaggccgggucagaguuugaaaauagugacgugagaugggucaucacugugcccgcuauuuggaagcagccugccaagcaguucaugaggcaagcagcuuaccaggccggacuggcgagcccagagaacucugaacagcucaucauagccuuagagccggaagcagcuuccaucuacugucggaaacugcgccuucaucagaugauugaguugucaagcaaggccgcuguaaaugguuauaguggcucugacaccguuggggccggauuuacacaagcaaaagagcacaucagaaggaaccggcagucccgcaccuuccugguggaaaaugucauuggcgagaucuggagcgaacuagaggaaggugauaaguacgugguggucgacuccgggggaggcacgguugaucucacugugcaccagauacgacugcccgagggccaucuuaaagagcuguauaaggccacagggggaccuuacgguucuuugggcguagacuaugaauuugagaaacuccuguacaagauuuucggggaagauuucaucgagcaauuuaagauuaaaagaccagcugcguggguggacuuaaugaucgcauucgaauccaggaagcgggccgcugcccccgaucguaccaacccucugaauaucacucucccauuuucauucauugacuauuacaaaaaguuucgcggacacagugucgagcaugcacuuagaaaaagcaacguggauuucguuaagugguccucucagggcaugcugaggaugagccccgacgccaugaaugcuuuguuuaagccgacaauagauucaaucauugagcaccuacgggaccuguuccagaaaccugaagugaguaccgucaaguuucucuuccugguggguggguuugccgaggcaccccuucugcagcaagcgguacaggcugccuucggcgaccagugccgaaucauaauuccacaggauguuggauugacgauccucaaaggcgcagugcuguuuggguuagacccugccgucaucaaggugcgcagaucgccccugaccuacggagucggugugcuaaacagguauguugaaggcaaacacccacccgagaagcuccuggugaaggaugggacacggugguguacugacguauucgauaaauucauuagcgcugaccaaucugucgcccuuggagaguuggugaagcgcucauacaccccugcaaaaccaagucagcugguuaucgugauuaauauauauagcuccgaacaugauaacgucucuuuuaucacagacccgggcgugaagaaaugcgguacucucagacuggaucuuaccgggacaucgggcaccgcuguacccgccaggcgugagauucagacucugaugcaguucggagacacggaaaucaaggcgacagccaucgauauugcuaccagcaaguccgugaaaguuggcauagacuuuuugaacuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2933 - RNA, 2443 nt, Artificial Sequence
  mRNA product Design2 comprising derived and/or modified sequence from Homo sapiens__NP_443202.3 __HsHSPA12B (opt3)
ggggcgcugccuacggagguggcagccaucuccuucucggcaucaagcuuaccaugcuggccgugcccgagaugggccuccaggggcuuuacaucggaagcuccccugaaagaucuccagucccgucacccccugguaguccaaggacccaagagagcugcggcauugcuccccugacaccuucccagucuccaaagcccgaaguucgggcaccucagcaggccucguucucagugguaguggcgauagacuuugggacuacgagcaguggauaugcuuucuccuuugccucugauccagaggcaauccacaugaugcgcaaaugggaaggcggugacccgggggucgcccaccaaaagacccccacauguuuguuacugacuccugagggagcuuuccacagcuuuggcuacaccgcacgagauuauuaccaugaccuagauccagaggaagcccgugacuggcucuauuucgagaaauuuaagaugaaaauucacuccgcuacagaucugacccuuaagacucagcuggaagccgugaacggcaagacaaugcccgcguuggagguuuucgcacaugcccucagauuuuucagggagcacgcucugcaggaacugcgggagcagucaccuagucucccagaaaaagacaccgugcgcugggucuuaacggugcccgccaucuggaagcaaccggcaaaacaguuuaugagagaggcugccuaccuggcggggcuuguaagcagggaaaaugccgagcaguugcugauugcacuagagccugaagcugccucuguuuauugccggaagcuccgccugcaccagcuucuggauuuguccggacgagcucccgguggcgggagacucggagagaggcggucaaucgacagcaguuuccgucaagcccgcgaacagcugagaaggucucggcauucccgaaccuuuuuaguggagagcggcgucggugaacugugggcagagaugcaggccggggaucgcuacgugguggcugacuguggaggcggcacugucgaucucacaguucaccaacuugagcagccacaugggacucugaaagaauuguacaaggcgucgggagguccuuauggcgcaguggggguagaccuagccuucgagcagcugcucugcagaauauucggagaagacuuuaucgcuaccuucaagaggcagcggcccgccgcauggguggaucugacaauugccuuugaggcucgcaaaagaaccgccggcccacacagggcgggugcacuuaacaucucucugcccuucuccuuuauugacuucuaccguaagcaacgggggcacaaugucgaaacggcuuugcgaagaucaagugugaacuuuguuaaauggagcucccagggcaugcucaggaugucuugugaggccaugaaugagcuguuccagccuacugugagcggaaucauacagcauauugaagcauuacuggcccgcccagagguccaaggcgugaagcuacucuuucugguagggggauucgcugaaucagccguucuucagcacgcagugcaggcugccuugggugcgcggggccugagagucguggucccgcaugauguggggcucacaauccugaaaggagccguucuuuuuggccaggcucccggugugguaaggguccgccgaaguccucugaccuauggggugggcguuuugaaccgguucgugccaggacgucaucccccugagaagcuccuggucagagacggcaggcgcuggugcacugauguguuugagcgguucguagcagccgaacaauccguggcuuuaggggaggaaguuagaaggagcuacuguccagcccgacccggacagcgccggguccugauuaaucuauauugcugugcagcggaggacgccagauucaucacagauccgggugugaggaaaugcggcgcucucucucuggaacuugagccugccgacugugggcaggauaccgcaggagcuccacccggccgucgcgagauccgggccgcaaugcaguuuggugacacggaaauuaaggugaccgccgucgauguuucaacaaacagaagugugagggcuagcauagacuucuuguccaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2934 - RNA, 1798 nt, Artificial Sequence
  mRNA product Design2 comprising derived and/or modified sequence from Homo sapiens__NP_008879.3__HsHSPA13 (opt3)
ggggcgcugccuacggagguggcagccaucuccuucucggcaucaagcuuaccauggcccgggagaugaccauccugggcagcgcugugcucacacuucuguuggcaggguacuuagcccagcaauaucugccccuaccuacuccaaaggucauuggaauagaccucgguacgaccuacugcuccguuggcguguucuuuccggggacaggaaaaguaaaggugauccccgaugaaaacggccacauuucuaucccuucaauggucaguuucacugacaaugauguguauguugguuacgagagcguggaacuggcggacuccaacccacagaauaccauuuaugaugcuaaaagguuuaucgggaagauauucacagccgaggaacuugaggcagagaucggacgguaccccuuuaaaguccugaacaagaauggcaugguggaguucucuguaaccucgaacgaaacuauuacaguuucaccugaauaugugggcagccgcuugcuccugaagcugaaagagauggccgaggcuuaccucgggaugccagucgcaaaugccgugaucagugugcccgcugaauuugacuuaaagcagcgaaacuccaccauugaggccgcgaaucuggcaggacuuaaaaucuugcgugucauaaacgaaccuacggccgcugccauggcauacggucugcauaaggcugauguuuuccacgugcuaguaauugaccucggcgggggaacucuggaugugucucuucugaauaaacagggcgguauguuuuugaccagagccaugagcgggaacaauaagcucggaggccaagacuucaaccagaggcuguuacaguaucuguacaagcagaucuaucaaacauacggcuuugucccaucccggaaagaggaaauucaucgccucagacaggcgguggagaugguuaaguugaaucugacuuugcaccagucagcccagcuaagugugcugcucaccgucgaggaacaagauaggaaagagccgcauagcucugacacagaacugcccaaggauaaacuuuccucagcagacgaccaccgggugaacagcggguucggacgcggucugagugauaagaaaucuggcgagucccagguauuguuugaaaccgagaucagccgaaaacucuucgacacgcugaacgaggauuuauuccagaagauccugguuccuauucaacaggugcuaaaggaagggcaccucgagaagacugaaauagacgaggucgugcuggucggaggcucgacaagaaucccaaggauuagacaggugauccaggaauuuuucgguaaagaucccaauaccucuguugacccugaucuugcugugguaacuggggucgccauacaagcuggcauugacggaggcuccuggccacuucaggugucagcccuggagauccccaacaagcaucuccagaaaacaaauuuuaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2935 - RNA, 1912 nt, Artificial Sequence
  mRNA product Design2 comprising derived and/or modified sequence from Homo sapiens__NP_057383.2__HsHSPA14 (opt3)
ggggcgcugccuacggagguggcagccaucuccuucucggcaucaagcuuaccauggccgcuaucggcgugcaccuggggugcaccagcgcaugugucgccguuuacaaggacgguagagcgggagugguagcuaacgaugccggcgacagggugacacccgcagucguggccuauuccgagaaugaagagauuguugggcucgcugcaaaacagucucggauacgcaacaucucaaauacugugaugaaggucaaacaaauucuuggacgaaguagcuccgauccucaggcccagaaguacaucgcugaaucuaaaugccuggugauugagaagaacggcaaguugcguuaugaaaucgacacgggugaggagaccaaauucguaaauccagaagauguugccagauuaauauuuucgaagaugaaagagacagcgcauucagugcuggggagcgacgcaaacgaugucgugaucacugugccguucgacuuuggagaaaagcagaaaaaugcccuaggcgaggcugccagggcagcuggcuucaacguccuccggcugauucacgagcccagugccgcgcuucuggccuacgggaucggacaagauuccccuaccgguaagucuaauauuuugguuuuuaagcucggcgggacaagccugucccugucagugauggaaguaaacaguggaaucuaucgcgugcucagcaccaauacugacgauaacauaggcggugcacauuucacagagaccuuagcucaguaccuggccucugaauuucagagauccuucaaacacgacgucagggggaaugcucgggccaugaugaagcugacgaacucagcagagguggccaaacauagcuugaguacucugggaucugcuaauuguuuucuagauucccucuaugaaggccaggacuucgacugcaacguuagccgcgcgcgauuugagcugcuuuguucgccacuguucaacaagugcauugaggcaaucagaggcuugcucgaucaaaauggguuuaccgccgacgauauuaacaaagugguccuguguggagguucuuccaggauccccaaguuacagcagcugaucaaagaccucuucccugcuguggaacuucuuaauucaauuccacccgaugagguaauaccuaucggcgccgcaauugaagccgggaucuugauaggaaaggagaaccuacugguugaagacagucucaugauugagugcagcgcucgggauauccuggugaagggcgucgacgaguccggugccucucguuucacagugcuuuuuccaagcgggacuccgcugcccgcacgcagacagcacaccuugcaagcgccuggcucaaucaguuccgucugucucgaacuguacgagagcgauggcaaaaauucugcuaaggaagagacaaaauucgcccaggugguuuuacaggaccuggauaagaaagaaaacggacuaagggacauucucgcagugcugaccaugaagcgggacgggucacuucacguaacgugcacugaucaagagacaggaaagugugaggccaucaguauugaaauagcuagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2936 - RNA, 2959 nt, Artificial Sequence
  mRNA product Design2 comprising derived and/or modified sequence from Homo sapiens__NP_006635.2 __HsHSPH1 (opt3)
ggggcgcugccuacggagguggcagccaucuccuucucggcaucaagcuuaccaugagcguggucggccuggacguugggucccagucuugcuacaucgccguggcuagagcaggagguauugagaccauagccaacgaguucucagauagguguacacccaguguaaucagcuuuggcuccaagaaucggacuauugggguggcggcuaaaaaccaacagaucacgcacgccaauaacaccgucucuaauuucaagcgcuuucauggacgagcauucaacgacccuuuuauucagaaagagaaggaaaaucucucguaugaucuugugccacugaaaaacggcgguguugggaucaaggugauguacaugggagaggaacacuuguucucagucgagcagauaacagccauguuacugacuaagcuaaaagagaccgcugaaaauagccucaagaaaccggugacagacugcguaaucaguguucccuccuuuuucaccgaugcagagcguagaucugugcuggacgccgcucaaauugucggccuuaacugucugagguugaugaaugauaugacugccguggcgcucaacuauggcaucuacaagcaggaccugccuagccuggaugaaaaaccacggauuguggucuuuguugacauggggcauuccgcauuccaggugucagccugcgcuuuuaauaagggaaagcucaaaguauuagguacagccuucgaucccuuucugggcgggaagaacuucgacgagaaacuuguggagcacuucugugcagaauuuaagaccaaauauaaguuggaugcuaaaaguaagauccgcgcccugcuaagacucuaccaggagugcgaaaagcugaaaaagcugaugagcucuaauuccacggaccuuccuuugaacauagaguguuucaugaacgacaaagaugucucaggaaagaugaauaggagccaauuugaagaacucugcgcggagcuguuacagaaaauugaagugccacuguauagucuccuugagcagacucaucugaagguugaagacgugucugccgucgagaucgugggcggugcaacccggauucccgcuguaaaggaacgcaucgccaaauucuuugggaaggauaucuccacaacuuugaacgcugacgaggccguugcacgaggaugugcccuacagugcgcuauucugagcccugcguucaaagugagagaguuuucggucaccgaugcagugccauucccgauaucucucaucuggaaucacgacuccgaagauacagagggcguccacgaaguguuuucaaggaaccaugccgcucccuucaguaagguucugaccuuucuucggcguggcccuuucgagcuggaagccuuuuacagcgacccacaaggggugcccuacccugaggcaaaaauuggacgcuucguaguccagaauguguccgcccagaaggauggugagaagucuagaguuaaagugaaggucagggugaacacgcacggcaucuucacuauaagcacagcuucaaugguagaaaaagugccaaccgaggaaaaugagaugaguuccgaggccgacauggaauguuugaaccaacggcccccggagaauccugauacugacaagaacguucagcaggacaauagcgaagcagggacacagccccaaguccagaccgaugcgcagcagacgucucaaucaccaccuagucccgagcucaccagcgaagagaacaaaauuccagacgcugauaaggccaaugagaagaaaguggaccagcccccugaagcaaagaaaccaaagaucaaaguggucaacguugagcugccgaucgaagccaauuuaguguggcagcugggaaaggaucuacucaacauguauauugagacagaaggcaaaaugaucaugcaggacaagcuggagaaggagcgaaacgaugcuaaaaaugccguggaagaguacguauaugaauuucgcgacaaacuuugcggucccuacgagaaauucauuugcgaacaagaucaucagaacuuuuugagacugcucacugagaccgaggacuggcuguaugaagagggggaagaucaggcaaagcaggcuuacgucgacaaacuugaggagcugaugaagauaggcacaccugugaagguuagguuccaagaagccgaggaacggccaaaaauguuugaggaauugggacagcgccuccagcacuaugcgaagaucgccgcugauuucagaaauaaagacgagaaguacaaccacauugacgaguccgaaaugaaaaagguggagaagucugucaaugaagugauggaguggaugaacaauguuaugaacgcacaagccaaaaagucgcuggaucaggaccccgugguaagggcucaggaaaucaaaacuaagaucaaagaguuaaauaacaccugugagccugucgugacacagccaaagcccaagauugaaagcccgaaacuggagcguaccccuaauggcccaaacauagauaagaaagaagaggaccuagaagauaagaauaacuuuggggccgagcccccucaucaaaauggagagugcuaccccaacgaaaagaacuccgugaauauggaccucgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2937 - RNA, 3382 nt, Artificial Sequence
  mRNA product Design2 comprising derived and/or modified sequence from Homo sapiens__NP_006380.1 __HsHYOU1 (opt3)
ggggcgcugccuacggagguggcagccaucuccuucucggcaucaagcuuaccauggccgacaaggugagaaggcagcggccccgccgacgugucugcugggcucugguugcagugcuccuugccgaucuguuggcguuaagcgacacccuggcuguaauguccguggaucuaggcucugagucaaugaaagucgccaucgugaagccugggguuccaauggaaauugugcucaacaaagagaguagaaggaagacaccggucauagugacucugaaagaaaaugagcgguucuuuggagacagcgcagccuccauggcuaucaagaaccccaaggcaacgcuucgcuacuuccaacaccuguuggguaaacaggccgauaauccucauguagcucucuaucaggccagauuuccagaacacgagcugaccuucgacccccagaggcaaacaguucauuuucagauuucuucgcagcugcaguucucaccugaggaagugcucggcauggucuuaaacuacagccggagucuggcggaggauuuugcagaacaaccaaucaaggacgccgugauuacugugcccgucuucuuuaaucaggcugagcgccgagccguucuucaggcagcuagaauggccggguugaaagugcugcagcuaaucaacgauaauaccgcgacagcccucuccuauggaguauucaggcggaaggacauaaacaccacugcacaaaauaucauguuuuacgauaugggcucugguagcacaguguguaccauugucacguaucagauggugaaaacuaaggaggcugggaugcagccucaacugcagauccguggaguuggcuucgaccgcacccuuggcgggcuggaaauggaguugagacucagggaacggcuggccggauuauuuaacgagcagcgaaagggucagcgcgcuaaagaugugagagaaaauccaagggccauggcaaagcugcuccgggaggccaaccgccuuaaaacaguccuguccgcuaaugcggaccacauggcacaaauugagggcuugauggacgauguggacuucaaggccaaaguaacuagaguugaguucgaggaacuaugcgcugaucuguuugagagggugccggggcccguccagcaggcccuccagucagcagaaaugagucuggacgagaucgagcaagugauacuugucggaggcgccacccgugugccucggguucaggaagugcuguugaaggcuguagguaaagaggaacucgggaagaacauuaaugccgaugaggcagcggcuaugggagccgucuaccaggcagccgcucugagcaaggccuucaaagugaagccauuuguugugcgagacgcagucguguaucccaucuuaguagaguucacaagagagguggaggaagaaccuggcauucauucucugaaacacaacaagaggguucuauuuucccgcaugggcccauacccccagcggaaagucaucaccuucaacagauacucacacgauuuuaauuuccauaucaacuauggggaccucggauuucuggguccggaagaucuuaggguguucggcagccaaaauuugacgacugugaagcugaagggggucggagacaguuuuaaaaaguacccugauuaugagucuaaaggcauuaaggcucacuucaaccucgacgaguccgguguucugagccuugaccgcguggaaucgguguuugagacacugguagaagauucugccgaggaagaguccaccuugacuaaacucgggaauacaauaucaagucuguucggcggaggcaccacgcccgacgcgaaggagaacgggaccgauacaguccaggaagaggaagagagcccagccgaaggauccaaggacgagccuggugaacagguggaauuaaaagaggaagcugaggcacccguugaagauggcucucagccacccccuccagagccgaagggggacgccacucccgagggagaaaaagcuaccgagaaggaaaauggcgauaaaagcgaggcccaaaagccuucagagaaggcagaagcggguccagaggggguggcccccgcuccugaaggcgagaaaaagcagaaaccagcccgaaagcggcguauggucgaagagaucggaguggagcugguugugcuagaccuccccgaucugccggaagacaaacuugcacagaguguacaaaaguugcaggaucugacacucagagaccuggagaaacaggaaagggagaaggcugccaacuccuuagaagcauucauuuuugagacucaggauaagcuguaccaaccugaguaucaggaagucagcaccgaggaacagcgcgaggaaaucucuggcaaacuuucagccgcuaguacaugguuggaggacgagggggugggagcgaccacugugaugcucaaggaaaaacuggccgagcuacggaagcugugucagggucucuucuuuagagucgaagagaggaaaaaguggccagagcgacugagcgcacuugacaauuugcugaaccauuccucuauguucuuaaagggcgcucgccucauacccgaaauggaucaaauuuuuacggagguugaaaugacaacccuggagaaagugaucaaugaaacuugggccuggaagaacgccacccuugcugagcaggcaaaacugccugccacagagaagcccguauugcucucgaaagacaucgaagcgaagaugauggcucuggaucgggaggugcaguaccuacugaauaaggccaaauucaccaagccaagaccuaggcccaaagacaagaacgggacucgugcagaaccaccgcucaaugccagcgcuuccgaucagggagagaaagucauuccucccgcaggccaaacagaagacgccgagccaaucucagagcccgaaaagguggagacggguagugaaccuggggauaccgagccacuggaacuuggcggacccggcgcggagccugagcagaaggaacagucuacugggcaaaaacgcccguugaagaacgacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2938 - RNA, 2581 nt, Artificial Sequence
  mRNA product Design2 comprising derived and/or modified sequence from Homo sapiens__NP_005339.3 __HsHSP90AA1 (opt3)
ggggcgcugccuacggagguggcagccaucuccuucucggcaucaagcuuaccaugcccgaggaaacccagacacaagaccagccuauggaggaagaggaaguggagacuuucgccuuucaggcugagaucgcacagcugaugagccucauuauaaacacguucuacuccaauaaggaaaucuuucuuagagagcugauuucuaacucaagugaugccuuggacaaaaucagguaugagagcuuaaccgauccauccaagcuggacucuggcaaagagcuacacauuaaucucaucccgaacaagcaagaucggacacugacuauagucgacaccgggaucggaaugacaaaagcggaucuuauuaauaaccuggguaccaucgcuaagucgggcacuaaggccuucauggaggcauugcaggccggggcugacauuucaaugaucggacaguuuggcguugguuucuacagcgcauaucucguggccgaaaaaguaacagugauaaccaagcauaaugaugacgagcaguacgcuugggaaaguuccgccgggggaucuuuuacgguccgcacugauaccggcgagcccaugggccgagggacaaaagugauucugcaccugaaggaagaccaaacugaguaucucgaggaacguagaaucaaagagauuguuaagaagcauagccaguucaucggauacccuaucaccuuauuuguggaaaaagagagggauaaggaagucuccgacgacgaggcggaggaaaaagaggauaaggaagaggaaaaagagaaggaggaaaaagagucagaagacaagccagagauugaggauguggguagugacgaagaggaagagaagaaagauggcgacaagaaaaagaaaaagaagauaaaagaaaaguauaucgaucaggaggagcugaacaaaacaaagcccauuuggacccggaauccugacgauaucacgaacgaagaguacggggaguucuacaaaagccuuacuaaugacugggaagaucacuuggcaguaaagcauuuuucuguugaaggacagcuggaguuccgcgcccuacucuuugugccaagaagggcucccuucgaccuguucgagaaccggaagaaaaagaauaacauaaaacuuuauguccgccgaguguuuauuauggacaauugcgaagaacugaucccugaauacuugaacuucaucagaggcguggucgauuccgaggaccucccacugaacauuucaagggaaauguuacaacagagcaagauccugaaaguuauucggaagaaucucgugaagaaaugucuugagcuguuuacagaguuggccgaagauaaggagaacuauaaaaaguucuacgaacaguuuaguaaaaauauaaagcuagguauccacgaggacucucaaaaccguaaaaagcuguccgagcuccugcgcuauuacaccagcgcaucgggggaugaaaugguaucucuuaaggacuauugcacuagaaugaaagagaaucagaagcacauuuacuacaucacaggagaaaccaaagaucagguggcuaacuccgccuucgucgagaggcugcggaagcauggcuuggaagugaucuauaugauugagccgauagacgaguacuguguucagcaacucaaagaauuugagggcaagacgcuggugucagucaccaaggaaggguuagagcugcccgaagaugaggaggagaaaaagaaacaggaagaaaagaaaacaaaguucgagaaucuaugcaagaucaugaaagacauucucgaaaagaaaguggagaagguaguugugaguaaccgacuggucacuagcccuuguugcaucgugaccuccacauauggauggacugcgaauauggagcgcauuaugaaagcccaggcacuuagagauaacucuaccauggguuacauggcugccaagaagcacuuggaaaucaauccagaccauagcauaaucgagacacugaggcagaaagcugaagccgauaagaacgacaaaucagucaaggaccucgugauucugcuuuaugagaccgcacuguugaguuccggcuuuagccucgaggauccccaaacucacgccaaucggaucuaccgcaugauuaaacugggguuaggaaucgacgaagaugacccuacggcugaugacacaucugcggcaguuaccgaggaaaugccaccccuggagggcgaugacgauacuucaagaauggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2939 - RNA, 721 nt, Artificial Sequence
  mRNA product Design2 comprising derived and/or modified sequence from Homo sapiens__NG_005218__HsHSP90AA3P (opt3)
ggggcgcugccuacggagguggcagccaucuccuucucggcaucaagcuuaccauggacagcuccaagcuggauucuggcaaagggcuccacaucaaccuugugcccaauaagcagaaccaaacccugacaauugucgacacuagaauaggaaugacgaaaaccgauuugaucaauaacuuagguacaguuacuaagucaggcaccaaagccuucauggaggcucugcaggcagacgccgauauuaguaugaucgggcauuuuggagugggcuucuacagcgcguaucuaguagcuaagaaggugacagucauuuccaaacacaauaacgacgaacaguacaccugggagucuucggccggugggucauuuacugugaggacagaugaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2940 - RNA, 2557 nt, Artificial Sequence
  mRNA product Design2 comprising derived and/or modified sequence from Homo sapiens__NP_031381.2__HsHSP90AB1 (opt3)
ggggcgcugccuacggagguggcagccaucuccuucucggcaucaagcuuaccaugcccgaggaagugcaccauggcgaggaagaggucgaaaccuucgccuuucaggcugagaucgcacaacugaugagccucauuauaaacacauucuacuccaauaaggagaucuuucuuagagaacugauuucuaacgccucagacgcguuggauaaaaucagguaugagaguuuaacugacccuagcaagcuggauuccgggaaagaacuaaagauugacaucauaccaaauccgcaggagcggacgcucacccugguugauacaggaaucgguaugacuaaagcugaccuuauuaacaaucugggcaccaucgccaagucugggacaaaggcauucauggaggccuugcaggcuggagcagauauuucgaugaucggccaguuuggugugggguucuacucagccuaucucguagcugaaaaaguggucgugauaaccaagcacaacgacgaugagcaauacgccugggaaagcagugcgggaggcuccuuuacuguucgcgcagaccauggcgagcccauugggcgaggaacaaaagugauccugcaccugaaggaagaucagaccgaguaucucgaggaacguagagucaaagaggugguaaagaagcauucucaguucauugguuacccuaucacguuauaucuggaaaaagagagggaaaaggagaucagcgacgaugaggccgaagaggaaaaaggcgagaaggaagaggaggacaaagacgaugaagagaagccaaaaauugaagacguuggguccgaugaggaggacgauucaggaaaggacaagaaaaagaaaacuaagaaaauaaaggaaaaguacaucgaucaggaggaacuuaauaaaaccaagcccauuuggacacggaacccugacgauaucacucaagaggaauacggcgaguuuuauaaaaguuugaccaaugacugggaggaucaccuggcugugaagcacuucagcgucgaaggucagcuagaguuucgcgcccuccuguucauaccaagaagggcacccuuugaccuuuucgaaaacaaaaagaagaaaaauaacauuaagcuguacgugcggcgcguguucaucauggacucuugcgaugaguugaucccugaauaucucaauuuuauucgaggggucguugacuccgaggaucugccauuaaacaucucaagagagaugcugcagcagagcaaaauucucaaggugauaaggaaaaauaucguaaagaagugucuugaacuguucagugaguuggcugaagacaaagagaacuacaagaaauuuuaugaagccuucucuaagaaccuaaaacugggcauucaugaggauuccacaaaucggcgucgccucagcgagcugcuuagauaccacaccucgcaaucuggagacgaaaugacgucccugucagaguaugugaguaggaugaaggaaacucagaaaagcaucuacuacaucacaggcgaguccaaggagcaggucgcgaacucugccuuuguggaacggguucgaaagcgcggguucgagguggucuauaugaccgaaccgauugaugaguacugcgugcaacaguugaaagaauuugacggaaagagccucguaucaguuacuaaagagggucuggaguuacccgaagaugaggaagagaagaaaaagauggaagagaguaaggcaaaauucgagaaucuguguaagcuaaugaaagaaauacucgacaagaaaguggagaaggucacaaucuccaacagacuggugagcucuccuugcuguauugucaccucaacguauggcuggaccgcuaauauggaaaggaucaugaaggcccaggcccuucgggauaacaguacaaugggguacaugauggcuaaaaagcauuuggagauuaauccagaccaccccaucguggaaacucugcgccagaaagcagaggccgauaagaacgacaaagcuguuaaggaccucgugguacugcuuuuugagaccgcgcuguugagcuccggauucucucucgaagauccucaaacacacucgaauagaauauauaggaugaucaagcugggcuuagguauugacgaggaugaagucgcagccgaggagccaaacgcugccgugcccgacgaaaucccgccucuggagggggaugaagacgcaagccguauggaggaaguugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2941 - RNA, 2794 nt, Artificial Sequence
  mRNA product Design2 comprising derived and/or modified sequence from Homo sapiens__NP_003290.1__HsHSP90B1 (opt3)
ggggcgcugccuacggagguggcagccaucuccuucucggcaucaagcuuaccaugagagcccugugggugcucggccuuugcuguguccuguugaccuucgggagcguuagggcugacgaugagguggacguagauggaacaguggaagaggacuuagguaagucccgggaaggcucucgcacugaugacgaggucgugcagcgagaagaggaggcaauccaacuggaugggcuaaacgccucacagauucgugaacucagagagaaaagugaaaaguuugcguuccaggcugagguuaauaggaugaugaaacugauaaucaacagccuuuacaagaauaaagagauuuuucugcgggaauugaucuccaacgccucugacgcacucgauaagauucgccugaucucgcugacggacgagaaugcccucucaggaaacgaagaguuaaccgugaagauaaaaugcgauaaggagaaaaaucugcuucacgucacagacacuggcguggguaugaccagagaggaguugguaaagaaccuggggacaaucgcuaaaagcggaaccagugaguuccuaaauaagaugacugaagcacaggaagauggccaauccacaucugagcucauuggccaguuugggguuggauucuauagcgccuuucugguggcugacaaggucaucgugaccuccaaacauaacaaugacacgcagcacauuugggaaucagauaguaacgaguucagcgugaucgccgaccccagggguaauacucuuggccgggggaccacaauaacucuggucuugaaggaggaagcgucugauuaccucgagcuggacaccauuaaaaacuuaguuaagaaauauucccaguuuaucaauuucccuauuuacguguggucaagcaagacagaaaccguagaggaaccaauggaggaggaagaggcagccaaagaagagaaggaggaaagugaugacgaggcugccguggaagaggaagaggaggaaaagaaaccgaagacgaaaaaggucgagaaaacugugugggauugggaacugaugaacgacaucaagcccaucuggcaacgcccuucuaaggagguugaagaggaugaguauaaagcauuuuacaaguccuucagcaaagaaucggacgauccaauggcuuauauucauuuuacagccgagggagaagugaccuucaagucuauacucuucguccccacuuccgcgccucgaggccuuuuugacgaguacgguaguaaaaagucagacuacaucaagcuguaugugagaaggguauucauuacagaugacuuucacgauaugaugccaaaauacuugaacuucguuaaggggguggucgacagcgaugaccuaccccugaaugugucccgggaaacccuccagcagcauaaacugcuuaaggucauccguaaaaagcuggugcgcaagacguuggauaugauuaaaaagauagccgacgauaaauauaacgacaccuuuuggaaggaguucggaacaaauaucaaacucggcguuaucgaggaucacucuaacagaacuaggcuggcaaaguuacugcgguuucagagcucacaccauccuaccgacauuacaagucuagaucaauacguggaacgaaugaaagagaagcaggacaagaucuauuucauggcuggcuccagccgcaaagaagccgagucuucaccauuuguagagagacuccugaagaaaggguacgaagucauuuaucuuacugagccgguggacgaauacuguauacaggcuuugcccgaguucgauggaaagagguuucaaaauguugccaaagaaggugugaaguucgacgagagugagaagaccaaagaaagccgggaggcagucgaaaaggaguuugaaccucugcucaacuggaugaaagauaaggcccugaaagacaagaucgagaaggcugugguaucccagcgccuuacagagucuccaugcgcgcugguggcaucgcaguacggcuggagcgggaauauggaaagaauuaugaaagcccaggcuuaucaaaccggaaaggauaucuccacuaacuacuaugccucacagaaaaagacguucgagaucaaucccaggcacccuuugauucgugacaugcuccggcgaauaaaagaagaugaggacgauaagacaguucuggacuuagcagucgugcuguucgaaaccgccacucuaagaaguggcuaccuccugccagauaccaaggcuuauggugacaggaucgagcgcaugcuucgguugucucugaacauugaucccgacgccaaaguggaggaagaaccggaagaggagccugaagagacagcagaagacaccacugaggauacagaacaggacgaggaugaggaaauggacgucgggacggaugaggaagaggaaaccgcgaaggagagcacugcugagaaagacgaacucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2942 - RNA, 2497 nt, Artificial Sequence
  mRNA product Design2 comprising derived and/or modified sequence from Homo sapiens__NP_057376.2__HsTRAP1 (opt3)
ggggcgcugccuacggagguggcagccaucuccuucucggcaucaagcuuaccauggccagagagcugagggcucuccuucuguggggccggcgcuugcgacccuuacugcgugcuccugcccuagcggcugugccagggggaaagccgauccucugccccagaaggaccacagcccagcuggguccucggcgcaacccagcauggagccuucaagccggcagacuguucuccacucagacggcugaagacaaagaggaacccuugcacucuauuauaucaaguaccgagagcguccagggguccacaucuaagcaugaauuucaggcagagacuaaaaagcuccuggauaucguugccaggucgcuguacucagagaaagaaguguucauucgggagcucaucagcaaugcuagugacgccuuagaaaagcugcgccacaagcuaguauccgauggacaagcguugccugagauggagauucaucugcagaccaacgcagaaaaaggcacaaucaccauacaggacacugguaucgggaugacacaggaggaacuugugucuaaucucggaaccauugcccgaagcggcuccaaggcuuuucuggaugcccuucaaaaccaggcagaggcuucaaguaaaaucauuggccaguucggggucggauuuuauagcgccuucaugguggcggacagaguugaaguguacucuagguccgccgcaccagguucacugggcuaucagugguugagcgaugggaguggagucuuugagaucgcugaggccucuggcgugcggacggguacuaagauaauuauccaccucaaauccgacuguaaggaauuuagcucggaggcucguguacgcgauguugugaccaaguacucuaauuuugucuccuucccccuguauuuaaacgggagaaggaugaauacacugcaagccauuuggaugauggacccuaaagaugugcgggaauggcagcaugaggaauuuuaccgauauguggcacaggcccacgacaagccacgcuacacucuccacuacaaaaccgaugcuccgcuuaacaucagaucaaucuucuauguccccgacaugaagccuaguauguuugacguuagcagggagcugggauccucuguggcguuguacagccggaaaguacuaauucaaacaaaggcaaccgauauacugccaaaauggcuccgcuucaucagaggcguggucgacucagaggauauuccccugaaucuuaguagggaacuguugcaggaguccgcccucauccguaagcugcgggacguguuacagcagcgacugauaaaguucuuuauugaucaaagcaaaaaggacgcugaaaaauaugccaaguucuuugaggauuacggccuauucaugagagaagggaucguuacggcaacugagcaggaggugaaagaagacaucgccaagcuccugagguaugagucuucagcacuuccuaguggacaguugacaagccuguccgaauacgccucucgcaugcgggcagguaccagaaacauuuauuaccucugcgcgccaaauaggcaucuggcugagcacucgcccuacuaugaggccaugaagaaaaaggauacugaaguccuuuucuguuucgagcaguuugacgaacugacauugcuccaucugcgcgaguucgauaaaaagaaauuaaucagcguggaaaccgacauuguaguugaccacuacaaggaggagaaguuugaagaucgauccccggcagccgagugccugucagaaaaagagacggaagaacuaauggcuuggaugcggaacgugcucggcagucgugucaccaaugugaaggucacacugagacuugacacucacccugccauggugaccguuuuggagaugggggcagcuaggcauuuccugcgcaugcaacagcucgccaaaacacaggaggagcgggcgcagcuguuacaacccacucuggaaauaaacccaagacacgcccuuaucaagaaauugaaucagcucagggcuucugagccuggacuggcacagcuacugguggaucagauuuaugaaaacgccaugaucgcugccggccucguagacgauccccgagcaauggucggucgccugaacgagcuuuuggugaaggcgcuggagcggcauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2943 - RNA, 844 nt, Artificial Sequence
  mRNA product Design2 comprising derived and/or modified sequence from Homo sapiens__NP_000609.1__HsIGF1 (opt3)
ggggcgcugccuacggagguggcagccaucuccuucucggcaucaagcuuaccaugggcaagaucagcucccugcccacccaacucuucaaaugcuguuuuugcgacuuccuuaaggugaaaaugcacacaaugucuucaagucaucuguuuuacuuggccuuaugucugcuaacuuucacgagcuccgcuaccgcagggccugagacacucugcggagccgaacuggucgaugcgcuucaguuuguuuguggugacagaggcuucuauuuuaacaagccaacuggguacggaucuucgucaaggcgggcuccgcagaccggcauuguggaugagugcuguuuccgcagcugcgaccugcgacguuuggaaauguauugugcaccccucaaaccugccaagagugccagauccguaagggcucagcggcacacagauaugccaaagacccagaaagaggugcaucugaagaaugcaucucgcgguagcgccgggaacaaaaauuacagaaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2944 - RNA, 925 nt, Artificial Sequence
  mRNA product Design2 comprising derived and/or modified sequence from Homo sapiens__NP_000603.1__HsIGF2 (opt3)
ggggcgcugccuacggagguggcagccaucuccuucucggcaucaagcuuaccaugggcauccccaugggaaagagcaugcuggugcuccuuaccuuccuggccuuugcuuccugcuguauugcagccuacagaccuucugagacauugugcgggggugaauuagucgacacucugcaguucguuuguggcgauaggggguuuuauuucucacggccagcgagucgcgugagccgacguuccagaggaauaguagaggaaugcuguuuuaggucuugcgaccuagcucuccuggagacguacugugccaccccggcaaaaucggaacgggaugugucaacacccccuacuguccuuccagacaacuucccccgcuauccugugggcaaguuuuuccaauacgauaccuggaaacagagcacacagagacugaggcgggguuugccagcccuccugcgcgcucgaagagggcacguucuggcaaaggagcucgaggccuuuagggaagcuaaacggcaucgucccuuaaucgcccugccuacccaggacccagcgcacggaggcgcaccgcccgagauggccaguaaucgcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2945 - RNA, 1021 nt, Artificial Sequence
  mRNA product Design2 comprising derived and/or modified sequence from Homo sapiens__NP_000591.1__HsIL6 (opt3)
ggggcgcugccuacggagguggcagccaucuccuucucggcaucaagcuuaccaugaacagcuucuccaccucugccuuuggccccguggcuuucucacuggggcuccuucuggucuugccugcagccuuuccagcgccgguucccccuggagaggacaguaaggauguggcugccccacacagacagcccuuaacaagcuccgaaaggaucgacaaacaaauucgguacauacuggaugguaucucugcacuacgcaaggagacuugcaauaaaucgaacaugugugaaucaagcaaggaggcccucgcugaaaauaaccugaaucuuccuaaaauggcagagaaggacggcugcuuccagaguggguuuaacgaggaaacgugucugguaaagauuaucaccggauugcucgaguucgaaguguaucuggaguaccugcagaaucgauuugaguccucugaagaacaggcccgugcuguccaaaugagcacaaaagugcucauucaguucuuacagaagaaagccaagaaccuggaugcgaucacuaccccagaccccacaaccaaugcaucccuuuugacuaaacugcaggcccaaaaccaguggcuacaggauaugacaacccaucucauacugagaucauuuaaggaguuccuucagaguagccugagggcuuugcggcaaaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2946 - RNA, 1663 nt, Artificial Sequence
  mRNA product Design2 comprising derived and/or modified sequence from Homo sapiens__NP_002183.1__HsINHBA (opt3)
ggggcgcugccuacggagguggcagccaucuccuucucggcaucaagcuuaccaugccccugcucuggcuuagaggcuuccuguuggccagcugcuggaucauugugagguccucuccuaccccagggucagagggacacagugcugcaccggacugucccagcugcgccuuagcggcucugccuaaggaugucccaaacucccagcccgaaaugguugaggccgugaaaaagcauauacuaaauaugcuccaccugaaaaagcggccugacguaacacaaccagugcccaaagcagcccuucugaacgcuauccgcaaguugcaugucgguaaggugggcgaaaauggguacguugagauugaagaugacaucggacgacgugcagagaugaacgagcucauggaacagacuucugagauuaucacguuugccgaaucgggcaccgcuagaaaaacacugcacuucgagauaucaaaggaggguagcgaucugaguguggucgaaagggccgagguguggcucuuuuuaaaaguaccuaaggcgaaucggacucgcaccaaaguuacaaucagacuguuccagcagcaaaagcauccacaggggucccuugacaccggagaagaggcagaagaggugggcuugaagggcgagaggucugaacugcuacucagcgagaaagucguggaugcccggaaguccacuuggcacguguuuccggucucaaguagcauucagcgccugcuugaccaggggaaaucuucccuggauguucgaaucgcuugugaacaaugccaggagucaggagccagcuuggugcuccuggguaagaaaaagaaaaaggaagaggagggcgaagggaagaaaaagggaggcggugaagggggagcaggcgcugacgaggagaaagaacagagucacagacccuucuuaaugcugcaggccaggcaaucugaggaucauccucaccggcgucgcagaaggggccucgagugugacgggaagguaaacauuugcuguaaaaagcaguuuuucguguccuuuaaggauaucggauggaaugacuggauaauugcgccaagcgguuaucaugccaacuacugcgaaggcgagugucccucgcacaucgcagggacaucuggauccucacuuaguuuccacagcaccgucauuaaucauuaucggaugcgaggccacuccccuuuugcuaaccugaaaucuugcugugugccaacgaaguugcgccccaugagcaugcuauacuaugacgauggucagaauaucaucaaaaaggacauucaaaacaugauaguugaagagugcgggugcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2947 - RNA, 1606 nt, Artificial Sequence
  mRNA product Design2 comprising derived and/or modified sequence from Homo sapiens__NP_002184.2__HsINHBB (opt3)
ggggcgcugccuacggagguggcagccaucuccuucucggcaucaagcuuaccauggacggccugcccgggagagcccucggagcugcaugccuucuguuguuagccgcggguuggcugggcccugaggcuugggggagcccaaccccgcccccuacaccagccgcacccccuccacccccuccaccgggaucccccggcgguucucaggauacuuguacgucaugcgggggauucaggcggccugaggaacuaggccgcguggacggcgauuuucucgaagccgucaagcgacacauccugagucgucuucaaaugagagggaggccaaacauuacccaugcuguucccaaagcagccauggugacagcucugcggaaguugcacgccggaaaaguacgcgaggacgguagaguggaaauaccucaucucgauggccacgcgagcccaggggcagacggacaggagagggucuccgagaucauuucuuucgccgaaacugauggccuggcuucgucacgggugcgccuguacuuuuucaucagcaaugaggguaaccagaaucucuuuguugugcaggccaguuuauggcuguaucuuaaguugcugcccuacguccuagaaaaagggucccgaagaaaggugaggguaaagguuuauuuccaagagcagggacauggcgaccgguggaacaugguggagaaacgugucgaucucaagcgcucuggcuggcacaccuuuccgcugacagaagcaauucaggcucuuuucgagagaggggaaaggcggcugaauuuggacgugcagugugauagcugccaagagcucgccguggucccuguuuuuguggaccccggagaagagucccaccgaccauucguagugguccaggcgcgccugggugauucaagacauaggauccggaaacgcggcuuagagugugacgggagaaccaaccugugcuguaggcagcaguuuuucauagacuuucgucucaucggauggaaugauuggauuaucgccccuacuggcuacuaugguaacuacugcgaagggaguugucccgcauaucuugcuggcgugccaggaagcgccucuuccuuccacacagcuguugugaaucaauaccggaugcgaggccugaaccccgggaccgucaauucaugcuguauuccuacgaaguugagcacuaugaguaugcuauacuucgacgaugaguauaacaucgugaaaagagacguaccaaauaugauaguugaagagugcggaugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2948 - RNA, 3841 nt, Artificial Sequence
  mRNA product Design2 comprising derived and/or modified sequence from Homo sapiens__NP_000623.2__HsITGAM (opt3)
ggggcgcugccuacggagguggcagccaucuccuucucggcaucaagcuuaccauggcccugagagugcuccuucugaccgcuuugacauuaugccacggcuucaaccuggacacugagaaugcaaugacguuucaggaaaacgccaggggguucggacaaagcgucguucagcuacaggguucccgggugguagugggcgcgccccaggagaucgucgcugccaaucaacgcgggucucucuaccagugugauuauucaaccggaaguugcgaaccuauucgacugcaagugccaguugaggcagugaacaugagccuuggccuguccuuggccgcuacaacuucuccgccccagcuccuggcaugugguccuaccguccaucaaacaugcucggaaaauaccuacgugaaggggcuguguuuucucuucggaucaaacuuacgucagcagccacagaaauuucccgaggcccugagaggcugcccucaagaggacagcgauauagcuuuccuuaucgacggcaguggguccauuaucccacacgauuuuaggcggaugaaggaguucguaucuacuguuauggaacaguugaaaaagagcaaaacacuguuuucccuaaugcaguauucagaagaguuccgcauucauuuuaccuucaaggaguuucaaaauaaccccaauccuagaagucucgugaagccaaucacgcagcugcuuggaaggacucacaccgccacagguauacggaaagucgugcgcgaacuguucaacaucacuaauggcgcgcgaaagaacgcauucaaaauuuugguggucaucaccgacggggagaaguuuggagauccgcucggcuacgaagacguuauucccgaggccgauagagaaggugugaucagguauguaauaggggugggagacgcuuuccggagcgagaaaucucgucaggagcugaauacaauugccuccaagccuccacgcgaucaugucuuucaggugaacaauuucgaagcauuaaagaccauccaaaaccagcugagagagaaaauuuuugcuaucgaaggcacgcagacuggcucaagcaguucuuucgagcacgaaaugucccaggagggguuuagcgccgcgaucacaucgaacggaccccuccuuucuaccguugguuccuacgacugggccggcgggguguuccuguauacuucaaaggagaaaaguacauuuauuaauaugaccagggucgauagcgacaugaacgacgcauacuugggauacgcugccgcuauaauccuacggaaucgagugcaaucccugguacucggcgccccucgcuaucagcacauuggucugguugcaauguucagacagaacacggggaugugggaaucuaaugccaacgugaagggcacccagaucggagcuuacuuuggcgcgagccuuuguucagucgauguggacaguaauggguccacagaucuggucuugauaggagcaccacauuauuacgagcaaacuagggguggccaggugagcguuugcccccucccgcgggggcgcgccagauggcagugugacgcugugcuguauggagaacagggccaaccuugggguagguucggggccgcauuaaccguacugggcgaugucaacggagacaaacuaacagauguggccauuggcgcucccggggaggaagacaaucguggagccguuuaccucuuucacgguacuucuggcucagggaucaguccaagccauucccagcggaucgcaggaucuaagcugucgccucgacuucaguauuucggccagagcuuguccggugggcaggaucugaccauggacggccucguggaucugacagucggagcgcagggccacgugcuucuguugagaucacagcccguacucagggugaaagcuauuauggaguucaacccacgcgagguugcccggaaugucuuugaaugcaacgaccaaguggugaaggggaaggaggcaggagaagucagaguuugucugcacgugcagaaaaguaccagggaccgcuuacgagagggccagauccagucugugguaacuuacgaucuggcccuagacagcggucggccccauucccgugcugucuucaaugagacgaagaacucaacaagaaggcaaacccaggugcucgggcugacucagaccugcgaaacacuuaaauugcagcugccuaauugcauugaggauccaguuagcccgauagugcuccgccugaacuuuucuuuagucggaaccccucuguccgccuucggcaaccuucggccuguguuggcagaagacgcucaaagacucuuuacugcccuguucccauuugagaagaauugugguaacgauaauaucugccaggacgaucuaaguauuacauucagcuuuaugucucuggacugucucguugugggcgggcccagggaguucaacguaacggucaccgugcgaaaugauggagaagacuccuaccgcacucaggugacauuuuucuuuccucuggaucuuucauaucggaaagucaguaccuugcaaaaccagagaagccagaggucguggcgucuggcgugcgaguccgccucuagcacagaaguuucaggcgcuuuaaagaguacuuccuguucuaucaaucacccaaucuuccccgagaacagcgaagugaccuucaauauuacguuugacguagauuccaaggcaucacucgggaacaaacugcuucugaaggccaaugugaccagcgagaacaauaugccgcgcacaaacaaaacugaguuccaguuggaacucccugucaaguacgcuguguauaugguugugaccagucauggagucucuacaaaauaccugaauuuuacugccuccgagaacaccagccgggugaugcaacaccaguaucagguuucgaaccuaggccagagaucacugccaauaucucucguguuccugguccccguaaggcuuaaucaaacggugaucugggaccgaccucagguuacauuuagugaaaacuuguccucuaccugccauacuaaggagcggcugcccagccacagcgacuucuuagcagaacuccgcaaggcgccaguggucaauuguuccauugccgugugccagagaauccagugugauauucccuuuuucgguauccaagaggaauuuaacgcuacacugaaagggaaucuuucauucgacugguacauaaagaccagucacaaccaucugcuaaucguaagcacugccgagauucucuuuaaugauucuguguucacccuguugcccggacagggcgcauucgucaggucccagacagagacgaaaguugaaccauuugaggugccgaacccucugcccuuaaucguggguucaagugucggcgggcuccugcuucuggcuuugauuaccgccgcacucuauaagcugggauucuuuaaacggcaguacaaggacaugaugagcgaaggcgggccacccggagccgagccucaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2949 - RNA, 1786 nt, Artificial Sequence
  mRNA product Design2 comprising derived and/or modified sequence from Homo sapiens__NP_002415.1__HsMMP8 (opt3)
ggggcgcugccuacggagguggcagccaucuccuucucggcaucaagcuuaccauguucagccugaagacccuccccuuucuucuguuguuacacgugcagaucuccaaagccuucccugucucuucaaaggagaaaaacacaaagacuguucaagacuaccuggaaaaauuuuaucagcuaccaaguaaucaguaccagagcacgagaaagaacggcaccaaugugauuguagagaagcucaaagaaaugcaaagguucuuugggcugaacgugacaggaaagccgaaugaggaaacucuugauaugaugaaaaagccccggugcggugucccugacuccggcggguucaugcugaccccaggaaaccccaaaugggagcgcacaaauuugaccuaucgaauacguaacuacacuccucagcucucugaggcugaaguggagagagcaaucaaggaugccuuugaacuguggucgguugcgucaccacugauuuucacaaggaucagccagggcgaggcugacauuaauaucgccuuuuaucagcgggaucauggugacaacagucccuucgaugggccuaauggaauacucgcacacgccuuucaaccaggccagggcaucgggggagacgcucauuucgaugcagaggaaaccuggacgaacacuuccgccaauuacaacuuauuucugguggcugcccacgaguucggucauucucuuggcuuggcgcacagcuccgacccgggggcacugauguaucccaauuacgccuuccgcgaaaccucaaacuacagucuaccucaggaugacauugauggaauccaggcuauuuauggccucagcucuaacccaauccaacccacagguccuuccacuccaaagcccugugacccgucacugaccuuugacgccauaacaacccuuagaggggagauucuguucuuuaaagauagguacuucuggcggcgccacccucaguugcagcgagucgaaaugaauuuuaucagccucuucuggcccagucugccaacgggcauucaagcagcuuaugaggacuuugauagagacuuaaucuuccuguuuaagggaaaccaguacugggcccucucuggcuaugauauccuucagggguacccuaaagacauuuccaauuauggauuccccagcucggugcaggcgauagaugccgcaguauuuuacaggucuaagacuuacuucuuuguuaacgaccaauucuggcgguaugauaaucagcgucaguucauggagccagguuaccccaaauccaucucaggcgcuuuuccugggauugaaaguaagguggacgccgucuuccagcaagagcacuuuuuccauguguuuagcggaccacgcuauuacgcuuucgaucugaucgcccagagagugacaagggucgcacggggcaacaaaugguugaauugccgauaugguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2950 - RNA, 2506 nt, Artificial Sequence
  mRNA product Design2 comprising derived and/or modified sequence from Homo sapiens__NP_004985.2__HsMMP9 (opt3)
ggggcgcugccuacggagguggcagccaucuccuucucggcaucaagcuuaccaugagccuguggcagccccucgugcuuguccuguugguuuuaggcugcuguuucgccgcuccuagacaaaggcaguccacccuggugcuauuuccaggggaccuccggacaaaccugacugaucgccagcuugcagaggaauaccuguaucgauacggauauacgcguguagccgagaugagaggugaaucuaaaucauugggcccggcgcuccugcugcuccagaaacaauuaagucugcccgagaccggggaacuugacagcgcuacauugaaggccaugaggacuccucggugcggagugccagaucugggccgcuuccagaccuuugagggugaccuaaaauggcaccaucacaauaucacauacuggauucagaacuauuccgaggaucuccccagagcagucauagacgaugccuucgcuagggcauuugcccuguggucugcugugaccccucuuacuuucacacggguuuacucgcgcgacgccgauaucgugauucaguuuggggucgcggaacauggagacggcuauccauucgauggcaaggacgggcuguuggcacacgccuuucccccuggaccagguauccaaggcgaugcucauuucgacgacgaugagcucuggucacuggggaaaggagugguaguuccgacccgauuuggcaaugccgacggugcagcuugucacuuccccuuuauuuucgaagggagaagcuacagugccugcacgacugauggaagguccgacggcuuaccuugguguucuaccacagcgaacuacgauacugacgaucgguucggcuuuugcccaagcgagcgucuguauacccaggacgggaaugccgauggaaagcccugucaguucccuuuuaucuuccagggucaauccuacucagcaugcacaaccgacggccgcagugauggguauagauggugugcuacgacugccaacuacgacagggacaagcucuuuggauucugcccaacacgggcugauagcaccgugaugggcgguaauucugccggggagcuuugugucuuucccuucacuuuucugggcaaagaauauuccacaugcaccucagagggacgaggcgacgggcgcuuguggugcgcaacgaccagcaacuucgauagugacaagaaauggggauuuuguccggaucaggguuacucucuauuccugguggccgcucacgaauuuggccaugcgcucgggcuggaccacuccagcgugccugaggcacuuauguaucccauguacagauucacagaaggaccaccucugcauaaggaugacgucaauggcauaaggcacuuguacgguccccggccagagcccgagccucgcccaccgacuaccacaacuccccagccuaccgccccacccacaguuugcccuaccgggccacccacugugcacccgucggaaagaccuacggcuggcccaacaggacccccuucugccggccccaccgggccaccuacugcaggacccuccaccgccacaaccguaccacucucaccgguggaugacgcuuguaacgucaauaucuucgaugccauugcagagaucgguaaccaacuguauuuauuuaaagacggcaaguacuggagguucagugaagggcguggaagccggccucagggccccuuucugauugcggauaaguggccagcucuaccccgaaaacucgacuccguguucgaggaaagacugucuaagaaauuguuuuucuuuagcgguaggcagguuuggguguauacuggggccucaguccuuggcccucgccggcuggacaagcucggacugggcgcagauguggcccagguaacaggggcucuuagaaguggaaggggcaaaaugcuguuguucuccggucgccgacucuggcgguuugacguuaaggcccaaaugguggauccacguagcgcaucugaggucgacagaauguuccccggggugccucuggauacgcaugacgucuuucaguacagggagaaggcuuauuucugccaggaucgcuuuuacuggcgggugucaaguagaagcgaauuaaaucagguugaccaagugggauauguaaccuacgauauccugcaguguccggaggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2951 - RNA, 1798 nt, Artificial Sequence
  mRNA product Design2 comprising derived and/or modified sequence from Homo sapiens__NP_002418.1__HsMMP13 (opt3)
ggggcgcugccuacggagguggcagccaucuccuucucggcaucaagcuuaccaugcaccccggcgugcuggccgcuuuccucuuucuuagcuggacccauugcagagcacugccuuugccauccgggggagacgaggaugacuuaucugaagaggaucugcaguucgccgaaagguaccuacggucauauuaccacccgacaaaccucgcggguauccugaaggagaaugcugccaguagcaugacugaacgccuucgagagaugcaauccuuuuucggccuggaggucacggggaaauuggacgauaacacccucgacguuaugaagaaaccccguuguggagugccugauguaggcgaauauaauguguuuccaagaacacugaaguggucuaaaaugaaccugacuuacaggauugucaauuauacccccgacaugacacauucggagguggaaaaggcauucaagaaagccuuuaagguuuggucagaugugaccccucucaacuucacucgguuacacgacgguauagcugauaucaugauuagcuuugggaucaaagagcauggagacuucuacccauuugauggccccaguggccugcuugcacacgccuucccuccagggccgaauuauggaggugacgcucacuuugacgaugacgagacauggaccuccucuagcaagggcuacaacuuguuccuggucgccgcgcaugaguucgggcacucccuaggacucgaucauucaaaagaccccggcgcacugauguuuccuauuuacacguauacugguaagagucacuucaugcuuccagaugacgaugugcaggggauccagagccuguacggacccggcgacgaagauccuaauccaaagcaccccaaaaccccggacaagugcgauccuucuuugucccucgacgccauaacaucacugcgcggcgaaacuaugaucuuuaaagacagauucuuuuggagguuacauccccagcaaguagaugcugagcuguuccucaccaagagcuuuuggccagaacuuccuaaccggauugacgccgcauaugagcaccccagucaugaucugaucuucauuuuucgcgggcgaaaauucugggcuuugaauggauacgacauccuagaggguuauccaaagaaaauaucugaacugggccuccccaaggagguuaagaaaauuuccgccgcggugcacuuugaagauacagggaagacccugcuuuucagcggaaaccaggucuggagauacgacgauacgaaucauaucauggacaaagauuauccuaggcugauugaggaagacuuuccaggcaucggugauaagguggacgccguguacgagaaaaacggguacaucuauuucuucaauggcccgauucaguuugaguacucgauauggucuaaccggaucguccguguuaugcccgcaaacuccauuuugugguguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2952 - RNA, 1450 nt, Artificial Sequence
  mRNA product Design2 comprising derived and/or modified sequence from Homo sapiens__NP_001286.1__HsCCR1 (opt3)
ggggcgcugccuacggagguggcagccaucuccuucucggcaucaagcuuaccauggagacccccaacacaacugaagacuacgauacgaccacagaguucgacuauggcgaugccacuccuugccagaaggugaaugaaagagcuuuuggggcacaacugcucccaccgcuuuacagccuggucuucguuaucggauugguggguaacauuuuaguagugcugguccuagugcaguauaaaaggcucaagaauaugaccuccauauaccugcuuaaccuggccaucucugacuugcucuuucuguucacacugcccuuuuggauugauuauaaacucaaggacgauuggguuuucggcgacgcgauguguaaaaucuuaucaggguuuuacuauaccggacuguacagugagauuuucuuuaucauacuuuugacuaucgaucgguaccuggcuauugugcacgccgucuucgcacuacgcgcccgaacagugaccuuuggcguaaucacgagcauuaucauaugggcucucgcaauucuggccuccaugccuggucuuuauuucucuaagacucagugggaauuuacccaucacacaugcucgcugcauuucccacacgagucauugcgugaguggaaacucuuccaggcucugaaguuaaaucuguuugggcucguucuuccccuguuggugaugaucauuuguuacacuggaaucaucaagauucuacugagaaggccuaacgagaaaaagagcaaagccguccggcucauauucgugaucaugauuaucuuuuuccuguuuuggaccccauauaaucuuacaauacugauuaguguguuccaagacuuuuuguucacccaugaaugcgaacagucccgccaccucgaucuggcgguccagguuacggaggugaucgcauacacucacuguugcguaaaccccgugaucuaugccuuugucggcgagagauucaggaaguacuuacggcagcuguuucaucgccgaguggcuguucaccuagugaaguggcucccuuuccugucugucgacagacuugaaagggugagcuccacaucaccaaguaccggcgagcaugaauugagcgccggguuuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2953 - RNA, 1018 nt, Artificial Sequence
  mRNA product Design2 comprising derived and/or modified sequence from Homo sapiens__NP_002598.4__HsPDGFA (opt3)
ggggcgcugccuacggagguggcagccaucuccuucucggcaucaagcuuaccaugagaacccuggccugccuccuucuguugggauguggguacuuagcucacgugcuggcagaggaagccgagauccccagggaagucauugagcggcuagcgcgcagccagauacauuccauccgagaccuccaacgucugcuugaaauugauucuguuggaucagaggacagucuggauacuagcuugagagcucacggugugcaugccacaaagcacguaccugagaaaaggccacucccgauccggcgcaagagauccauugaagaggcagugcccgccgucugcaaaacgaggaccgugaucuaugaaauaccucggucucagguugacccaacaucggcuaacuuccugaucuggcccccuuguguggaggucaagcgcugcacuggcuguugcaauaccucaagcgugaaaugucagccaagucgaguacaucacagauccguuaagguggcaaaggucgaguacgugaggaaaaagcccaaacugaaggaagugcagguccggcucgaggaacacuuagagugcgccugugcuacaaccucucugaacccugauuaucgugaagaggacacugggcgcccaagagagagcggcaaaaagaggaagcggaaacgacuuaagccgacaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2954 - RNA, 1108 nt, Artificial Sequence
  mRNA product Design2 comprising derived and/or modified sequence from Homo sapiens__NP_002599.1__HsPDGFB (opt3)
ggggcgcugccuacggagguggcagccaucuccuucucggcaucaagcuuaccaugaacagaugcugggcccuguuccucagccuuuguugcuaccugagguugguguccgcugagggcgaccccaucccugaagaguuauaugaaaugcugucugaucacucaauucggaguuuugacgaucuacagcgccuccugcauggggacccaggagaggaagauggugcagagcuugaccugaauaugacccgaagccacuccggcggggaguuggaaucucucgcccguggaagaaggucgcugggcucacugacaauagcggagccggcuaugaucgccgaauguaagacucggacggaggucuucgagauuagccgcagacucaucgauaggaccaacgcaaacuuuuuaguuuggcccccuugcguggaaguacaacgguguagugguugcuguaauaaucgcaacgugcagugccgaccaacacagguccagcugagacccgugcaaguuaggaaaauugagaucgugcggaagaaaccuauauucaagaaagccacugucacccuugaagaccauuuggcuuguaagugcgagacaguggcagccgcucguccaguaacccgcucccccgggggaucucaggaacagagagccaagacuccucagacaaggguuaccauccggacggugcgaguccgcagaccaccgaaaggcaagcacaggaaauuuaagcauacucacgauaaaaccgcgcugaaggagacacuaggcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2955 - RNA, 1420 nt, Artificial Sequence
  mRNA product Design2 comprising derived and/or modified sequence from Homo sapiens__NP_057289.1__HsPDGFC (opt3)
ggggcgcugccuacggagguggcagccaucuccuucucggcaucaagcuuaccaugagccuguucggccuccuucuguugaccuccgccuuagcugggcagagacaaggaacacaggcagagucuaaccugucaaguaaguuucaguucagcuccaauaaagaacagaacggugugcaagacccccagcacgagaggaucauuacugucucuacgaauggcucgauacauucaccucgguuuccacacaccuacccgcgcaacacaguucuaguguggcgacucguagccguggaagagaaugucuggauccagcugacuuucgaugaacguuuugggcuugaggaccccgaggaugacauuugcaaguaugauuucguggaaguugaggaaccuagcgacggaaccauccugggcagauggugugguagugggacagugccaggaaaacagauuuccaagggcaaccaaaucaggauacgguuugucucugaugaguacuuccccagcgagccuggcuuuugcauccauuauaauauugugaugccacaguucaccgaagcgguaucccccucaguuuugccuccaagugcucucccgcuggaccugcucaacaaugccaucacugcauuuagcacauuagaggaucugauucgcuaccuugaacccgagagauggcaguuggaccuggaagaucuauauaggccuaccuggcagcuccuggggaaagccuucguguuuggacggaagucucgcgucguggaccuuaaccuguugacggaggaggugcgacucuacuccuguacuccaagaaauuucucagucagcaucagggaggaacugaagcggaccgauacaauauucuggcccgguugcuuacugguuaaacguuguggcgggaacugcgcuuguugccuccacaauuguaacgaaugccaaugugugccuaguaagguaacuaaaaaguaucaugaggugcuucagcugcgcccaaaaaccggagucagaggcuugcacaagucucuaacagacguggcacuggaacaccaugaggagugcgacugcguuuguagggguuccaccgggggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2956 - RNA, 1477 nt, Artificial Sequence
  mRNA product Design2 comprising derived and/or modified sequence from Homo sapiens__NP_149126.1__HsPDGFD (opt3)
ggggcgcugccuacggagguggcagccaucuccuucucggcaucaagcuuaccaugcacagacugaucuucguguacacccucauuugcgccaacuuuuguagcugcagggacacauccgcuacuccccagucugcaucaauaaaggcccuucggaaugcgaaccugcgccgagaugacuuguaucguagagaugagacgauccaagucaaaggaaauggguacguucagaguccuagguucccaaacagcuauccgcggaauuuacugcuaaccuggcgccuccauucccaggaaaacacaaggauucagcugguguuugacaaucaauucggacuugaggaagcugagaacgauaucuguagauacgacuuuguagaaguggaggauauuucugagacuucgaccaucauacggggucgcuggugcggccacaaggaagugcccccucgaaucaaaucaagaacaaaucagauuaagaucaccuucaaaagcgacgauuauuuugucgccaagccaggguucaagauuuacuauagucuguuggaggacuuucagcccgcagccgcuuccgaaacuaacugggagucuguuacaagcuccaucucaggagugaguuacaauagcccuucugucaccgauccaacgcucauagcagacgcccuggauaaaaagauugcugaguucgacacuguggaagaccugcucaaauacuuuaaccccgaguccuggcaggaagauuuagagaauauguaucuggacaccccuagguaccggggccguucauaucaugaucgcaagagcaaaguagaccuugauagauugaacgacgaugccaagagguacaguuguacaccacggaauuauucuguuaacauccgagaggaacugaagcuagcgaacguggucuucuuuccgcgcugccuccuggugcaaagauguggugggaauugcggauguggcacugugaacuggagguccugcaccuguaauagcggcaaaacagucaagaaauaccacgagguucuucaguucgaacccgggcauauuaagcggcgcggcagagcaaaaaccauggcccugguggacauccaguuggaucaccacgagaggugcgacugcaucuguucgucucguccuccacggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2957 - RNA, 1060 nt, Artificial Sequence
  mRNA product Design2 comprising derived and/or modified sequence from Homo sapiens__NP_003946.3__HsSOCS3 (opt3)
ggggcgcugccuacggagguggcagccaucuccuucucggcaucaagcuuaccauggugacccacagcaaguuccccgccgcuggcauguccagaccucuggacacaucucucaggcuuaaaacuuuuucaaguaagagcgaguaccagcuggucguuaacgcagugcggaaauugcaagaauccggguucuauuggucugccguaacgggaggugaggcgaauuuacugcuaucggcugaaccagccggcaccuuucucauccgcgauucaagcgaccagcgacauuucuuuacacugagugugaagacucaguccgggaccaaaaaccuucguauucagugcgagggaggcucuuucagccugcaauccgauccgagaucaacacagcccgucccuagguuugacuguguguugaagcucguucaccauuacaugccacccccuggugcaccaaguuuccccagcccuccaaccgaaccgucuuccgaggugcccgagcagccuucagcccagccacugcccgggagcccuccacggcgcgcuuauuacauauauaguggaggcgaaaagaucccccugguccucucuagaccguuauccagcaauguggcaacucugcaacaccuuugcaggaaaacaguaaacggccauuuggauucguacgagaagguuacccagcugccugggcccauucgggaauuucuagaccaguaugaugccccacucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2958 - RNA, 865 nt, Artificial Sequence
  mRNA product Design2 comprising derived and/or modified sequence from Homo sapiens__NP_003227.1__HsTGFA (opt3)
ggggcgcugccuacggagguggcagccaucuccuucucggcaucaagcuuaccauggugcccagcgccggccagcuggcucucuucgcacuugggaucguccuggccgcgugccaggcuuuggagaacuccaccucuccuuuaucagccgacccaccgguugcagccgcugugguaagucacuuuaaugauugucccgacagccauacacaauucugcuuucacggaacuuguagauuccuggugcaggaagauaagccugcaugcgucugucauuccgguuacgugggcgccaggugcgagcacgcugaccuacucgccguuguggcggcaucucagaaaaagcaagccauuacggcucuggucgugguaucgauaguugcccuugcagugcugaucauuaccugugucuugauccauugcugucaggugcggaaacacugcgaauggugucgcgcucucauuugccgacacgagaagccaucagcccugcugaaagggcguacagcgugcugucauagcgaaacuguggucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2959 - RNA, 1555 nt, Artificial Sequence
  mRNA product Design2 comprising derived and/or modified sequence from Homo sapiens__NP_000651.3__HsTGFB1 (opt3)
ggggcgcugccuacggagguggcagccaucuccuucucggcaucaagcuuaccaugcccccuagcggccugagacuccuuccacuguuguuaccgcugcuauggcuccuggugcuuacccccgggaggccugccgcuggacuguccacaugcaagacuaucgacauggaguuggucaaacggaagcgcauugaagcaauacgaggucagauccucucuaaacugcgucuggccucaccacccagucaaggcgagguuccuccagggccccucccugaagcgguguuagcucuguacaacagcacgagagauaggguagccggagaguccgcagaaccagagccggagcccgaagccgacuauuacgcuaaggaggugacccggguccuuaugguggaaacacacaaugagauuuaugauaaauucaagcagucuacucauucgaucuacauguuuuucaacaccucagaguugcgcgaagcaguuccugagccagugcugcuaagcagagccgaacucaggcugcuucggcugaaguugaaagucgagcagcacguggaacucuaucagaaguacaguaauaacuccuggcgcuaucugucuaaucgauuacuggcucccagcgacuccccugaguggcucucauuugauguaacaggcguugugagacaauggcuuaguagggguggggagauugaaggauuccggcugagcgcccauuguucuugcgacucccgugauaacaccuugcaggucgacaucaauggcuuuacuacaggccgcagaggggaucuagcgaccauacacggaaugaacaggccauuccugcuccugauggcaacgccccuugagcgggcccagcaucugcagucaagccgacaccgcagagcuuuggacacuaauuacuguuuuaguucuaccgagaaaaacugcugugugaggcaacucuacaucgauuuccggaaggaccuggguuggaaauggauucacgaaccgaagggcuaucaugccaauuuuugcuuagggccuugucccuacaucuggucccuggauacacaguauagcaaggugcuagcacucuacaaccagcacaauccaggagcuucggccgcgccuugcugugucccccaggcccuggaaccacuucccauuguuuauuacgugggccgcaaaccuaagguagagcaauugucuaacaugaucgugagauccugcaaauguucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2960 - RNA, 1627 nt, Artificial Sequence
  mRNA product Design2 comprising derived and/or modified sequence from Homo sapiens__NP_003229.1__HsTGFB2 (opt3)
ggggcgcugccuacggagguggcagccaucuccuucucggcaucaagcuuaccaugcacuacugcgugcugagcgccuuccucauccuucaucuggucaccguugcuuuguccuuaucuacauguucaacucuggacauggaucaguuuaugagaaagaggauugaggcaauacggggccaaauccuaaguaaacucaagcugacgagcccucccgaagacuauccagagccggaagaggugcccccugaaguaauuuccaucuacaacucuacccgcgaucuucugcaggagaaagccucgcgacgugcggcugccugcgagagagaaaggucagacgaggaauauuacgcaaaggagguguauaaaauugauaugccacccuucuuuccuagcgagaaugccaucccacccacauucuaccggccuuauuuucgcauagucagauucgacgugagugcuauggaaaagaacgcauccaauuugguuaaggccgaguuuaggguguuccggcuccagaacccaaaagcucgcgucccggaacagcgaaucgagcuguaccaaauucugaagucuaaagaucucacuagccccacccagagauacaucgacuccaaggugguaaaaacaagggccgaaggggagugguuaucauuugauguuaccgacgcggugcacgaguggcugcaucacaaggaucggaaucuuggauucaagauuaguuugcauuguccuugcuguacuuuugucccaagcaacaauuauaucauacccaacaaaucugaggaacuggaagcacguuucgccgguauugacggcacauccaccuacacgucaggggaucagaagacuaucaaaagcacccgcaagaaaaauaguggaaagacaccucaccuacuccugaugcuucugccaucuuauagauuggagucccagcaaacuaacaggcggaaaaagcgagcucucgacgccgcauacugcuuucgcaaugugcaggacaacuguugccugagacccuuauauauugauuucaagagggaccugggcuggaaauggauccacgaaccgaaggguuacaaugcuaacuucugugccggggcgugcccuuaucucuggagcucggauacccagcauucucgggugcuuucccuguacaauacaaucaaccccgaggccucagcaaguccauguugcgucagccaggacuuggagccucuaaccauucuguacuauauaggaaaaacgcccaagaucgaacaacucuccaacaugauuguuaaaucuugcaaguguagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2961 - RNA, 1621 nt, Artificial Sequence
  mRNA product Design2 comprising derived and/or modified sequence from Homo sapiens__NP_003230.1__HsTGFB3 (opt3)
ggggcgcugccuacggagguggcagccaucuccuucucggcaucaagcuuaccaugaagaugcaucugcagagagcccucgugguccuugcucuguugaacuucgcaaccguuagcuuaucccugucuacaugcacuacgcuagacuuuggccacaucaaaaagaaaaggguggaggccauucgggggcaaauacucucaaagcugcgccuuaccagucccccugaaccaacaguaaugacucacgugccguaccagguccuggcguuguauaauagcacccgagagcuccuggaagagaugcauggagaacgugaggaggguuguacacaggaaaacaccgaguccgaauacuaugcuaaagagauccacaaguucgauaugauucagggccuggccgagcauaaugaacucgcagugugccccaaggggaucacuucuaaaguuuuuagauucaacgugucgucagucgagaagaauaggacaaacuuauuucgggccgaguuccgcgugcugagaguaccuaauccaagcaguaaaaggaacgaacaacggauugaacuuuuucagaucuugcgccccgacgagcacauagcuaagcagcgauacaucggaggcaaaaaucugccuaccagagguacggcagaguggcuauccuucgauguuacugacaccgugagggaauggcuccugcggcgugagucuaaccuugggcuggaaauuagcauccacuguccaugccauacauuucagcccaauggagauauuuuggagaacauccacgaagucauggagauaaaguucaagggcguggacaaugaggaugaccauggccgcggggaucucggaagacugaaaaagcaaaaagaccaccacaacccucauuuaauucugaugaugaucccaccgcacaggcucgauaaucccggucagggcgggcagcggaagaaacgagcccuugacacuaacuauuguuuucgcaaccuggaagagaauugcugugugagaccuuuguacauugauuucaggcaggaccuaggauggaaguggguccaugaaccaaaaggcuauuacgcuaacuuuugcuccggucccuguccuuaccugcggucagccgacaccacacacaguaccguucucgggcuguauaauacgcuuaacccagaggcgagcgcaucucccugcugugugccgcaagaucuggaaccuuugacuauccucuacuauguaggacgcacacccaagguggagcagcuguccaauauggucgugaagucaugcaaaugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2962 - RNA, 1768 nt, Artificial Sequence
  mRNA product Design2 comprising derived and/or modified sequence from Homo sapiens__NP_001057.1__HsTNFRSF1B (opt3)
ggggcgcugccuacggagguggcagccaucuccuucucggcaucaagcuuaccauggcccccguggcugucugggcagcccuggcgguuggccucgagcuuugggcugccgcacacgcccugccugcucagguggcauucaccccauacgccccggaacccgggagcacaugcagauugagggaguauuacgaccaaacugcucagauguguugcuccaaguguucuccuggacagcaugccaaaguauuuugcacgaagaccucagauacagugugugacaguugcgaagauagcacuuauacccaguuauggaacugggucccagagugucuguccugcgguucucgguguucgucagaccaaguggaaacacaggcgugcacccgcgagcagaaucgaaucuguacuugccgucccggcugguacugcgcacuaagcaaacaggagggguguagacucugcgccccucugaggaagugucggccaggauucggcguugcucgccccgguacagaaaccagugauguggucugcaaaccuugugccccagggacguuuuccaacacuaccucuagcacagacauuugcagaccgcaccaaauauguaaugugguagcaauccccggaaacgcuuccauggaugccguuugcacuucaaccaguccuacaaggagcauggcgccaggcgccgugcaucuuccccagccugucucuacccggucccagcacacgcagccaacucccgagccgucaacagcaccuagcaccaguuuccuguugcccaugggcccaucuccucccgcugaaggguccacuggagacuuugcccucccagugggucugauugugggcgucacagcucuggggcucuuaaucauuggaguugugaauuguguaaucaugacccaagugaagaagaaaccccugugccuucagcgcgaggccaaggucccucauuugccagcagauaaagcccgaggcacgcaggguccggagcaacagcaucugcuaauaaccgcucccagcucgucuuccucaagucucgaaagcuccgcgucugcacuggacagaagggccccuacacggaaccagccacaggcucccgggguggaggccagcggagcaggcgaagcccgugcuucaacuggcaguuccgauagcucuccugggggacacgguacccaaguuaaugugacauguaucgucaacgugugcucaaguagcgaccacuccucucagugcucgagccaggccuccucaacuaugggcgauaccgacaguucuccaagcgagucccccaaggacgaacagguaccguucucaaaagaggagugugcauuucgcagccaacuugaaacaccugagacccuguuggggucuacugaagagaagccacucccccugggaguuccugaugcgggcaugaagcccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2963 - RNA, 895 nt, Artificial Sequence
  mRNA product Design2 comprising derived and/or modified sequence from Homo sapiens__NP_002623.2__HsPGF (opt3)
ggggcgcugccuacggagguggcagccaucuccuucucggcaucaagcuuaccaugcccgugaugagacuguucccuugcuuucuccagcuucuggccggcuuggcuuuaccagcagucccgccccaacagugggcccugagcgcggggaacggauccucugagguugaagugguaccuuuccaggaggugugggguaggucauacugucgggcucuagaacgccucgucgacgugguuagugaguauccaagcgaaguggagcacauguuuucccccucuugcgucucgcugcuucgauguaccggcugcuguggggaugagaaucugcauugcgugccuguagaaacagccaacguuacuaugcaguugcucaagauccguucaggagacagaccaagcuacguggagcugacguucagucaacacgucaggugugaaugccggccccugcgcgagaaaaugaagccugagagaaggcggccaaaaggccgcgguaagcgaagaagggaaaaacagcggccgaccgauugucaucucugcggggacgcagugccccgucgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2964 - RNA, 1621 nt, Artificial Sequence
  mRNA product Design2 comprising derived and/or modified sequence from Homo sapiens__NP_001020537.2__HsVEGFA (opt3)
ggggcgcugccuacggagguggcagccaucuccuucucggcaucaagcuuaccaugaccgacagacagacagauacugcccccagcccuuccuaccaucugcucccaggcaggcggcgcacgguggacgcugcagccucucgagggcaaggaccggagcccgcgccugguggcggggucgaaggaguuggcgcucgugguguggcccuuaagcuguucguacaguuguuagggugcucaagauuuggaggcgcaguggucagggccggcgaggcugaaccaaguggggcagcccggagcgcuuccucuggacgcgaggaaccccagccugaggagggugaagaggaagaggagaaagaagaggaaagaggcccacaguggaggcugggggcccggaagcccggaucguggaccggcgaggcggcagugugugccgauucagcuccugccgcacgcgcuccacaagcccuagcgcgagccagcgguagagggggaaggguugcacggcguggcgcugaagagaguggcccgccccacuccccuucucgcagagggagcgccuccagggcuggaccaggucgggccucagagacaaugaacuuccuccugaguugggugcacuggagccuugcacuguugcucuaucugcaucacgccaaauggucucaggcugcgcccauggcagaaggcgggggacagaaucaucacgaggucgugaaguuuauggacguauaccagcgauccuauugccacccuaucgaaacucugguugauauuuuccaagaguacccagacgaaauagaguauaucuuuaaacccucaugugugccgcucaugcgcugcggcgguuguugcaacgaugagggguuagaaugugucccuaccgaggaaagcaauauuacaaugcagaucaugagaauuaagccccaucagggccagcacaucggagagaugaguuuccugcaacauaacaagugcgaauguaggccuaaaaaggaccgggcccgccaggagaaaaagucugugagaggcaaagggaagggacagaagaggaaacguaagaaaucccgguacaagagcuggucgguguaugucggugcucgaugcugucuuaugccauggucuuugcccggcccacaccccugcgggccuugcuccgagagaaggaaacaccuguuuguucaagauccacagaccuguaagugcucauguaaaaauacugacagucgcugcaaggcccggcagcuagaacucaacgagagaacauguaggugcgauaagccgcgccgaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2965 - RNA, 1081 nt, Artificial Sequence
  mRNA product Design2 comprising derived and/or modified sequence from Homo sapiens__NP_001165094.1__HsVEGFA (opt3)
ggggcgcugccuacggagguggcagccaucuccuucucggcaucaagcuuaccaugaacuuccugcucagcugggugcacuggucccuugcccuguuguuauaccugcaucacgcuaaguggucucaggcagcccccauggcggagggcgggggacaaaaucaucacgaagucguuaaauuuauggacguguaucagagaucauacugccauccuaucgagacccuaguagauauuuuccaggaauauccagacgagauagaauacaucuuuaagccgaguugugugccccucaugaggugcgguggcuguugcaacgaugaggggcuggagugugucccuacagaagagagcaauauuacuaugcagaucaugcggauuaaaccacaccaaggacagcacaucggcgaaauguccuuccuucagcauaacaagugcgagugucgccccaaaaaggaccgagcucgucaggagaagaaaucugugagagguaaggggaaaggacaaaagaggaaacggaagaagucgcgcuauaaaucauggagcguuuacgugggcgccagaugcugucugaugccuuggaguuugccaggcccccacccuugcgggccauguuccgaaaggcggaagcaucucuuuguccaggauccgcagacgugcaaaugcucuuguaagaauaccgacagccgcugcaaagcacgacagcuggagcugaacgaaagaacauguaggugcgauaagccccggcguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2966 - RNA, 1006 nt, Artificial Sequence
  mRNA product Design2 comprising derived and/or modified sequence from Homo sapiens__NP_003368.1__HsVEGFB (opt3)
ggggcgcugccuacggagguggcagccaucuccuucucggcaucaagcuuaccaugagcccccugcucagaaggcuucuguuggccgcuuuacugcagcuagccccugcacaagcgccagugucccagccggacgcucccggccaccagcggaaggucguuucuuggaucgauguguacacccgcgccacaugccagccucgagagguaguggucccacucacuguggaacugauggggacgguugcaaaacaacuugugcccucaugugucaccgugcagcguugcggagguuguugcccugacgauggccuggaguguguaccaacagggcagcaucagguuagaaugcaaauuuugaugauaagguaucccaguagccagcucggagaaaugucccuggaggaacacucucagugcgagugucggccuaagaaaaaggacucggccgugaaaccagaucgcgcugcaacuccgcaucacagaccccagccuaggucagucccaggcugggacagcgcccccggugcuccuaguccagccgauaucacccaucccacaccggcgccugggcccuccgcacacgccgcuccaucuaccacuagcgcccugacaccuggacccgcagcugccgcggccgacgcagcugccuccucaguggcuaagggcggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2967 - RNA, 1642 nt, Artificial Sequence
  mRNA product Design2 comprising derived and/or modified sequence from Homo sapiens__NP_005420.1__HsVEGFC (opt3)
ggggcgcugccuacggagguggcagccaucuccuucucggcaucaagcuuaccaugcaccuucucggcuucuuuagcguggccugcucccuucuggcugcagccuuguuacccgggccuagagaggcgccagcugccgcagccgcuuucgaaucuggacuggaccuaucagaugcagagccggacgccggugaagcuaccgccuacgcgaguaaggaucucgaggaacagcugaggagcgucuccucuguugacgagcuuaugacagugcuguaucccgaguacuggaaaauguauaagugucaauugcggaaaggcggguggcagcauaaccgcgaacaggcaaaucucaacucgcgaacugaggaaacgaucaaguuugccgcugcccacuacaauaccgagauucugaaaucaauagauaacgaguggcguaagacacagugcaugccuagagaaguauguaucgacgugggaaaggaguucggcgucgcaacuaauaccuuuuucaaaccacccugcgugagcguuuauagguguggugggugcuguaacagugaaggacugcaaugcaugaauacauccaccucuuaccucagcaagacuuuauuugagauuacagugccucugucccagggcccaaaacccgucaccaucucauucgcuaaccauacgaguugucggugcaugagcaagcuggauguguaucgccagguacacucuauuaucagaagguccuugccugccacucugccacagugucaagcggccaauaaaaccugcccgacaaacuacauguggaauaaccauauaugccggugucuagcacaggaagacuuuauguucucaagcgaugcuggcgacgauaguacugacggguuucacgauaucugcggacccaauaaggagcucgacgaggaaaccugucagugcguuugucgcgccggucugcgaccugcuucuugcggcccacacaaggagcuugacagaaacuccugucagugcguguguaaaaauaagcuguuccccagccaaugcggggccaacagggaauuugaugagaacacaugucagugcgucugcaaacggaccuguccucguaaucagccauugaaccccggaaagugcgcaugugaaugcacggagucgccgcaaaaaugucuccugaagggcaaaaaguuccaucaccagacuugcucuuguuaccgcagaccuugcacaaauaggcagaaggccugugagcccgguuucuccuauucagaagaggugugccggugugugccaaguuacuggaaacgaccucagaugagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2968 - RNA, 1447 nt, Artificial Sequence
  mRNA product Design2 comprising derived and/or modified sequence from Homo sapiens__NP_004460.1__HsVEGFD (opt3)
ggggcgcugccuacggagguggcagccaucuccuucucggcaucaagcuuaccauguacagagaguggguggucguuaacguguucaugaugcuguauguacagcucgugcaaggcagcuccaaugaacacgggcccgucaagaggucuucacagaguacccuugagcggagcgaacagcagauccgcgccgcuuccucucuggaggaauuguuacgaauuacacauucggaggacuggaaacuguggcguugcagacuaaggcucaagucauuuacuagcauggauagucgguccgcaucucaccgcagcacgagauucgccgcgaccuuuuacgacauagagacacugaaagugaucgaugaagaguggcaaaggacucaguguuccccucgggaaaccugcguugagguggcuucagagcuuggaaagaguacaaacaccuucuuuaaaccaccgugugucaauguguuccgcugcgguggcuguugcaacgaagagagccugauuuguaugaauacuucuacauccuauaucucaaagcaguuguuugaaauuagcguaccccucaccaguguuccugagcuggugccagucaagguggccaaccauacggggugcaaaugucugcccacugcaccucgacacccauacucuaucauaagaagguccauccagauucccgaagaggaccggugcagccauucgaagaaacucuguccuaucgauauguuaugggacucuaauaagugcaaaugcgugcugcaagaggaaaacccacuugccggaaccgaggaucacucccacuugcaggaaccggcucuguguggcccccauaugauguucgacgaggaucguugcgaaugugucugcaagacaccuuguccaaaggaccuaauucagcaccccaaaaauugcucauguuuugagugcaaggagagucucgaaacuuguugccagaaacauaagcuguuccacccugauaccuguagcugcgaggaccgcugcccauuucacacaagacccugugcauccgguaaaaccgccugcgcuaagcauuguagguucccgaaagaaaagcgggccgcgcaagggccucacucucgaaagaaccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2969 - RNA, 1012 nt, Artificial Sequence
  mRNA product Design2 comprising derived and/or modified sequence from Homo sapiens__NP_061986.1__HsFGF21 (opt4)
ggggcgcugccuacggagguggcagccaucuccuucucggcaucaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagcugcugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggccccagccagggcagaagccccagcuacgccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2970 - RNA, 1792 nt, Artificial Sequence
  mRNA product Design2 comprising derived and/or modified sequence from Homo sapiens__NP_002412.1__HsMMP1 (opt4)
ggggcgcugccuacggagguggcagccaucuccuucucggcaucaagcuuaccaugcacagcuuccccccccugcugcugcugcuguucuggggcguggugagccacagcuuccccgccacccuggagacccaggagcaggacguggaccuggugcagaaguaccuggagaaguacuacaaccugaagaacgacggcagacagguggagaagagaagaaacagcggccccgugguggagaagcugaagcagaugcaggaguucuucggccugaaggugaccggcaagcccgacgccgagacccugaaggugaugaagcagcccagaugcggcgugcccgacguggcccaguucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2971 - RNA, 1552 nt, Artificial Sequence
  mRNA product Design2 comprising derived and/or modified sequence from Homo sapiens__NP_002412.1__HsMMP1(1-19,100-469) (opt4)
ggggcgcugccuacggagguggcagccaucuccuucucggcaucaagcuuaccaugcacagcuuccccccccugcugcugcugcuguucuggggcguggugagccacagcuucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2972 - RNA, 3739 nt, Artificial Sequence
  mRNA product Design2 comprising derived and/or modified sequence from Clostridium histolyticum__BAA77453.1__ColG (opt4)
ggggcgcugccuacggagguggcagccaucuccuucucggcaucaagcuuaccaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2973 - RNA, 3463 nt, Artificial Sequence
  mRNA product Design2 comprising derived and/or modified sequence from Clostridium histolyticum__BAA77453.1__HsALB(1-18)_ColG(111-1118) (opt4)
ggggcgcugccuacggagguggcagccaucuccuucucggcaucaagcuuaccaugaagugggugaccuucaucagccugcuguuccuguucagcagcgccuacagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2974 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt4)
ggggcgcugccuacggagguggcagccaucuccuucucggcaucaagcuuaccaugaagugggugaccuucaucagccugcuguuccuguucagcagcgccuacagcaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcagaagaagaagaaagagaaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2975 - RNA, 3487 nt, Artificial Sequence
  mRNA product Design2 comprising derived and/or modified sequence from Clostridium histolyticum__BAA34542.1__ColH (opt4)
ggggcgcugccuacggagguggcagccaucuccuucucggcaucaagcuuaccaugaacuuccugaagaucauccugaacagaggcaagaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2976 - RNA, 3448 nt, Artificial Sequence
  mRNA product Design2 comprising derived and/or modified sequence from Clostridium histolyticum__BAA34542.1__ColH (opt4)
ggggcgcugccuacggagguggcagccaucuccuucucggcaucaagcuuaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2977 - RNA, 3382 nt, Artificial Sequence
  mRNA product Design2 comprising derived and/or modified sequence from Clostridium histolyticum__BAA34542.1__HsALB(1-18)_ColH(41-1021) (opt4)
ggggcgcugccuacggagguggcagccaucuccuucucggcaucaagcuuaccaugaagugggugaccuucaucagccugcuguuccuguucagcagcgccuacagcgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2978 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt4)
ggggcgcugccuacggagguggcagccaucuccuucucggcaucaagcuuaccaugaagugggugaccuucaucagccugcuguuccuguucagcagcgccuacagcaugaagagaaagugccugagcaagagacugaugcuggccaucaccauggccaccaucuucaccgugaacagcacccugcccaucuacgccgccguggacaagaacaacgccaccgccgccagaagaagaagaaagagagugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2979 - RNA, 958 nt, Artificial Sequence
  mRNA product Design2 comprising derived and/or modified sequence from Homo sapiens__NP_001133.1__HsAMELX (opt4)
ggggcgcugccuacggagguggcagccaucuccuucucggcaucaagcuuaccaugggcaccuggauccuguucgccugccugcugggcgccgccuucgccaugccccugcccccccaccccggccaccccggcuacaucaacuucagcuacgaggugcugaccccccugaagugguaccagagcaucagaccccccuaccccagcuacggcuacgagcccaugggcggcuggcugcaccaccagaucauccccgugcugagccagcagcacccccccacccacacccugcagccccaccaccacauccccguggugcccgcccagcagcccgugaucccccagcagcccaugaugcccgugcccggccagcacagcaugacccccauccagcaccaccagcccaaccugcccccccccgcccagcagcccuaccagccccagcccgugcagccccagccccaccagcccaugcagccccagccccccgugcaccccaugcagccccugcccccccagcccccccugccccccauguuccccaugcagccccugccccccaugcugcccgaccugacccuggaggccuggcccagcaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2980 - RNA, 517 nt, Artificial Sequence
  mRNA product Design2 comprising derived and/or modified sequence from Homo sapiens__NP_001133.1__HsAMELX-TRAP (opt4)
ggggcgcugccuacggagguggcagccaucuccuucucggcaucaagcuuaccaugccccugcccccccaccccggccaccccggcuacaucaacuucagcuacgaggugcugaccccccugaagugguaccagagcaucagaccccccuaccccagcuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2981 - RNA, 550 nt, Artificial Sequence
  mRNA product Design2 comprising derived and/or modified sequence from Homo sapiens__NP_001133.1__HsAMELX-LRAP (opt4)
ggggcgcugccuacggagguggcagccaucuccuucucggcaucaagcuuaccaugccccugcccccccaccccggccaccccggcuacaucaacuucagcuacgaggugcugaccccccugaagugguaccagagcaucagacccccccccaugcugcccgaccugacccuggaggccuggcccagcaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2982 - RNA, 589 nt, Artificial Sequence
  mRNA product Design2 comprising derived and/or modified sequence from Homo sapiens__NP_001133.1__HLA-A2-SP_HsAMELX(17-60) (opt4)
ggggcgcugccuacggagguggcagccaucuccuucucggcaucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaucagaccccccuaccccagcuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2983 - RNA, 622 nt, Artificial Sequence
  mRNA product Design2 comprising derived and/or modified sequence from Homo sapiens__NP_001133.1__HLA-A2-SP_HsAMELX(17-47,168-191) (opt4)
ggggcgcugccuacggagguggcagccaucuccuucucggcaucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaucagacccccccccaugcugcccgaccugacccuggaggccuggcccagcaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2984 - RNA, 961 nt, Artificial Sequence
  mRNA product Design2 comprising derived and/or modified sequence from Homo sapiens__NP_001134.1__HsAMELY (opt4)
ggggcgcugccuacggagguggcagccaucuccuucucggcaucaagcuuaccaugggcaccuggauccuguucgccugccuggugggcgccgccuucgccaugccccugcccccccaccccggccaccccggcuacaucaacuucagcuacgaggugcugaccccccugaagugguaccagagcaugaucagaccccccuacagcagcuacggcuacgagcccaugggcggcuggcugcaccaccagaucauccccguggugagccagcagcacccccugacccacacccugcagagccaccaccacauccccguggugcccgcccagcagcccagagugagacagcaggcccugaugcccgugcccggccagcagagcaugacccccacccagcaccaccagcccaaccugccccugcccgcccagcagcccuuccagccccagcccgugcagccccagccccaccagcccaugcagccccagccccccgugcagcccaugcagccccugcugccccagcccccccugccccccauguucccccugagaccccugccccccauccugcccgaccugcaccuggaggccuggcccgccaccgacaagaccaagcaggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2985 - RNA, 520 nt, Artificial Sequence
  mRNA product Design2 comprising derived and/or modified sequence from Homo sapiens__NP_001134.1__HsAMELY-TRAP (opt4)
ggggcgcugccuacggagguggcagccaucuccuucucggcaucaagcuuaccaugccccugcccccccaccccggccaccccggcuacaucaacuucagcuacgaggugcugaccccccugaagugguaccagagcaugaucagaccccccuacagcagcuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2986 - RNA, 553 nt, Artificial Sequence
  mRNA product Design2 comprising derived and/or modified sequence from Homo sapiens__NP_001134.1__HsAMELY-LRAP (opt4)
ggggcgcugccuacggagguggcagccaucuccuucucggcaucaagcuuaccaugccccugcccccccaccccggccaccccggcuacaucaacuucagcuacgaggugcugaccccccugaagugguaccagagcaugaucagacccccccccauccugcccgaccugcaccuggaggccuggcccgccaccgacaagaccaagcaggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2987 - RNA, 592 nt, Artificial Sequence
  mRNA product Design2 comprising derived and/or modified sequence from Homo sapiens__NP_001134.1__HLA-A2-SP_HsAMELY(17-61) (opt4)
ggggcgcugccuacggagguggcagccaucuccuucucggcaucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaugaucagaccccccuacagcagcuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2988 - RNA, 625 nt, Artificial Sequence
  mRNA product Design2 comprising derived and/or modified sequence from Homo sapiens__NP_001134.1__HLA-A2-SP_HsAMELY(17-48,169-192) (opt4)
ggggcgcugccuacggagguggcagccaucuccuucucggcaucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaugaucagacccccccccauccugcccgaccugcaccuggaggccuggcccgccaccgacaagaccaagcaggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2989 - RNA, 952 nt, Artificial Sequence
  mRNA product Design2 comprising derived and/or modified sequence from Sus scrofa__NP_999071.1__SsAMELX-001-1 (opt4)
ggggcgcugccuacggagguggcagccaucuccuucucggcaucaagcuuaccaugggcaccuggauccuguucgccugccugcugggcgccgccuucagcaugccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2990 - RNA, 520 nt, Artificial Sequence
  mRNA product Design2 comprising derived and/or modified sequence from Sus scrofa__NP_999071.1__SsAMELX-TRAP (opt4)
ggggcgcugccuacggagguggcagccaucuccuucucggcaucaagcuuaccaugccccugcccccccaccccggccaccccggcuacaucaacuucagcuacgaggugcugaccccccugaagugguaccagaacaugaucagacaccccuacaccagcuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2991 - RNA, 553 nt, Artificial Sequence
  mRNA product Design2 comprising derived and/or modified sequence from Sus scrofa__NP_999071.1__SsAMELX-LRAP (opt4)
ggggcgcugccuacggagguggcagccaucuccuucucggcaucaagcuuaccaugccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2992 - RNA, 592 nt, Artificial Sequence
  mRNA product Design2 comprising derived and/or modified sequence from Sus scrofa__NP_999071.1__HLA-A2-SP_SsAMEL(17-61) (opt4)
ggggcgcugccuacggagguggcagccaucuccuucucggcaucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagaacaugaucagacaccccuacaccagcuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2993 - RNA, 625 nt, Artificial Sequence
  mRNA product Design2 comprising derived and/or modified sequence from Sus scrofa__NP_999071.1__HLA-A2-SP_SsAMEL(17-49,167-189) (opt4)
ggggcgcugccuacggagguggcagccaucuccuucucggcaucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2994 - RNA, 916 nt, Artificial Sequence
  mRNA product Design2 comprising derived and/or modified sequence from Sus scrofa__P45561-2__SsAMELX-001-2 (opt4)
ggggcgcugccuacggagguggcagccaucuccuucucggcaucaagcuuaccaugggcaccuggauccuguucgccugccugcugggcgccgccuucagcaugccccugcccccccaccccggccaccccggcuacaucaacuucagcuacaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2995 - RNA, 952 nt, Artificial Sequence
  mRNA product Design2 comprising derived and/or modified sequence from Sus scrofa__NP_998965.1__SsAMELX-001-3 (opt4)
ggggcgcugccuacggagguggcagccaucuccuucucggcaucaagcuuaccaugggcaccuggaucuucuucgccugccugcugggcgccagccuggccaugccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2996 - RNA, 601 nt, Artificial Sequence
  mRNA product Design2 comprising derived and/or modified sequence from Sus scrofa__K7GPB2__SsAMELX-002 (opt4)
ggggcgcugccuacggagguggcagccaucuccuucucggcaucaagcuuaccaugggcaccuggauccuguucgccugccugcugggcgccgccuucagcaugccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2997 - RNA, 994 nt, Artificial Sequence
  mRNA product Design2 comprising derived and/or modified sequence from Sus scrofa__K7GLD0__SsAMELX-003 (opt4)
ggggcgcugccuacggagguggcagccaucuccuucucggcaucaagcuuaccaugggcaccuggauccuguucgccugccugcugggcgccgccuucagcaugccccugcccccccaccccggccaccccggcuacaucaacuucagcuacgaggaccuguaccuggaggccaucagaaucgacagaaccgccuucgugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2998 - RNA, 880 nt, Artificial Sequence
  mRNA product Design2 comprising derived and/or modified sequence from Sus scrofa__K7GPE9__SsAMELX-004 (opt4)
ggggcgcugccuacggagguggcagccaucuccuucucggcaucaagcuuaccaugggcaccuggauccuguucgccugccugcugggcgccgccuucagcaugccccugcccccccaccccggccaccccggcuacaucaacuucagcuacgaggugcugaccccccugaagugguaccagaacaugaucagacaccccaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 2999 - RNA, 904 nt, Artificial Sequence
  mRNA product Design2 comprising derived and/or modified sequence from Sus scrofa__J9JIM4__SsAMELX-201 (opt4)
ggggcgcugccuacggagguggcagccaucuccuucucggcaucaagcuuaccaugccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3000 - RNA, 3343 nt, Artificial Sequence
  mRNA product Design2 comprising derived and/or modified sequence from Homo sapiens__NP_006120.1__HsBMP1 (opt4)
ggggcgcugccuacggagguggcagccaucuccuucucggcaucaagcuuaccaugcccggcguggccagacugccccugcugcugggccugcugcugcugcccagacccggcagaccccuggaccuggccgacuacaccuacgaccuggccgaggaggacgacagcgagccccugaacuacaaggaccccugcaaggccgccgccuuccugggcgacaucgcccuggacgaggaggaccugagagccuuccaggugcagcaggccguggaccugagaagacacaccgccagaaagagcagcaucaaggccgccgugcccggcaacaccagcacccccagcugccagagcaccaacggccagccccagagaggcgccugcggcagauggagaggcagaagcagaagcagaagagccgccaccagcagacccgagagaguguggcccgacggcgugauccccuucgugaucggcggcaacuucaccggcagccagagagccguguucagacaggccaugagacacugggagaagcacaccugcgugaccuuccuggagagaaccgacgaggacagcuacaucguguucaccuacagacccugcggcugcugcagcuacgugggcagaagaggcggcggcccccaggccaucagcaucggcaagaacugcgacaaguucggcaucguggugcacgagcugggccacguggugggcuucuggcacgagcacaccagacccgacagagacagacacgugagcaucgugagagagaacauccagcccggccaggaguacaacuuccugaagauggagccccaggagguggagagccugggcgagaccuacgacuucgacagcaucaugcacuacgccagaaacaccuucagcagaggcaucuuccuggacaccaucgugcccaaguacgaggugaacggcgugaagccccccaucggccagagaaccagacugagcaagggcgacaucgcccaggccagaaagcuguacaagugccccgccugcggcgagacccugcaggacagcaccggcaacuucagcagccccgaguaccccaacggcuacagcgcccacaugcacugcguguggagaaucagcgugacccccggcgagaagaucauccugaacuucaccagccuggaccuguacagaagcagacugugcugguacgacuacguggaggugagagacggcuucuggagaaaggccccccugagaggcagauucugcggcagcaagcugcccgagcccaucgugagcaccgacagcagacuguggguggaguucagaagcagcagcaacugggugggcaagggcuucuucgccguguacgaggccaucugcggcggcgacgugaagaaggacuacggccacauccagagccccaacuaccccgacgacuacagacccagcaaggugugcaucuggagaauccaggugagcgagggcuuccacgugggccugaccuuccagagcuucgagaucgagagacacgacagcugcgccuacgacuaccuggaggugagagacggccacagcgagagcagcacccugaucggcagauacugcggcuacgagaagcccgacgacaucaagagcaccagcagcagacuguggcugaaguucgugagcgacggcagcaucaacaaggccggcuucgccgugaacuucuucaaggagguggacgagugcagcagacccaacagaggcggcugcgagcagagaugccugaacacccugggcagcuacaagugcagcugcgaccccggcuacgagcuggcccccgacaagagaagaugcgaggccgccugcggcggcuuccugaccaagcugaacggcagcaucaccagccccggcuggcccaaggaguacccccccaacaagaacugcaucuggcagcugguggcccccacccaguacagaaucagccugcaguucgacuucuucgagaccgagggcaacgacgugugcaaguacgacuucguggaggugagaagcggccugaccgccgacagcaagcugcacggcaaguucugcggcagcgagaagcccgaggugaucaccagccaguacaacaacaugagaguggaguucaagagcgacaacaccgugagcaagaagggcuucaaggcccacuucuucagcgacaaggacgagugcagcaaggacaacggcggcugccagcaggacugcgugaacaccuucggcagcuacgagugccagugcagaagcggcuucgugcugcacgacaacaagcacgacugcaaggaggccggcugcgaccacaaggugaccagcaccagcggcaccaucaccagccccaacuggcccgacaaguaccccagcaagaaggagugcaccugggccaucagcagcacccccggccacagagugaagcugaccuucauggagauggacaucgagagccagcccgagugcgccuacgaccaccuggagguguucgacggcagagacgccaaggcccccgugcugggcagauucugcggcagcaagaagcccgagcccgugcuggccaccggcagcagaauguuccugagauucuacagcgacaacagcgugcagagaaagggcuuccaggccagccacgccaccgagugcggcggccaggugagagccgacgugaagaccaaggaccuguacagccacgcccaguucggcgacaacaacuaccccggcggcguggacugcgagugggugaucguggccgaggagggcuacggcguggagcugguguuccagaccuucgagguggaggaggagaccgacugcggcuacgacuacauggagcuguucgacggcuacgacagcaccgcccccagacugggcagauacugcggcagcggcccccccgaggagguguacagcgccggcgacagcgugcuggugaaguuccacagcgacgacaccaucaccaagaagggcuuccaccugagauacaccagcaccaaguuccaggacacccugcacagcagaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3001 - RNA, 1573 nt, Artificial Sequence
  mRNA product Design2 comprising derived and/or modified sequence from Homo sapiens__NP_001191.1__HsBMP2 (opt4)
ggggcgcugccuacggagguggcagccaucuccuucucggcaucaagcuuaccaugguggccggcaccagaugccugcuggcccugcugcugccccaggugcugcugggcggcgccgccggccuggugcccgagcugggcagaagaaaguucgccgccgccagcagcggcagacccagcagccagcccagcgacgaggugcugagcgaguucgagcugagacugcugagcauguucggccugaagcagagacccacccccagcagagacgccguggugccccccuacaugcuggaccuguacagaagacacagcggccagcccggcagccccgcccccgaccacagacuggagagagccgccagcagagccaacaccgugagaagcuuccaccacgaggagagccuggaggagcugcccgagaccagcggcaagaccaccagaagauucuucuucaaccugagcagcauccccaccgaggaguucaucaccagcgccgagcugcagguguucagagagcagaugcaggacgcccugggcaacaacagcagcuuccaccacagaaucaacaucuacgagaucaucaagcccgccaccgccaacagcaaguuccccgugaccagacugcuggacaccagacuggugaaccagaacgccagcagaugggagagcuucgacgugacccccgccgugaugagauggaccgcccagggccacgccaaccacggcuucgugguggagguggcccaccuggaggagaagcagggcgugagcaagagacacgugagaaucagcagaagccugcaccaggacgagcacagcuggagccagaucagaccccugcuggugaccuucggccacgacggcaagggccacccccugcacaagagagagaagagacaggccaagcacaagcagagaaagagacugaagagcagcugcaagagacacccccuguacguggacuucagcgacgugggcuggaacgacuggaucguggccccccccggcuaccacgccuucuacugccacggcgagugccccuucccccuggccgaccaccugaacagcaccaaccacgccaucgugcagacccuggugaacagcgugaacagcaagauccccaaggccugcugcgugcccaccgagcugagcgccaucagcaugcuguaccuggacgagaacgagaagguggugcugaagaacuaccaggacauggugguggagggcugcggcugcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3002 - RNA, 1609 nt, Artificial Sequence
  mRNA product Design2 comprising derived and/or modified sequence from Homo sapiens__NP_001193.2__HsBMP4 (opt4)
ggggcgcugccuacggagguggcagccaucuccuucucggcaucaagcuuaccaugauccccggcaacagaaugcugaugguggugcugcugugccaggugcugcugggcggcgccagccacgccagccugauccccgagaccggcaagaagaagguggccgagauccagggccacgccggcggcagaagaagcggccagagccacgagcugcugagagacuucgaggccacccugcugcagauguucggccugagaagaagaccccagcccagcaagagcgccgugauccccgacuacaugagagaccuguacagacugcagagcggcgaggaggaggaggagcagauccacagcaccggccuggaguaccccgagagacccgccagcagagccaacaccgugagaagcuuccaccacgaggagcaccuggagaacauccccggcaccagcgagaacagcgccuucagauuccuguucaaccugagcagcauccccgagaacgaggugaucagcagcgccgagcugagacuguucagagagcagguggaccagggccccgacugggagagaggcuuccacagaaucaacaucuacgaggugaugaagccccccgccgagguggugcccggccaccugaucaccagacugcuggacaccagacuggugcaccacaacgugaccagaugggagaccuucgacgugagccccgccgugcugagauggaccagagagaagcagcccaacuacggccuggccaucgaggugacccaccugcaccagaccagaacccaccagggccagcacgugagaaucagcagaagccugccccagggcagcggcaacugggcccagcugagaccccugcuggugaccuucggccacgacggcagaggccacgcccugaccagaagaagaagagccaagagaagccccaagcaccacagccagagagccagaaagaagaacaagaacugcagaagacacagccuguacguggacuucagcgacgugggcuggaacgacuggaucguggccccccccggcuaccaggccuucuacugccacggcgacugccccuucccccuggccgaccaccugaacagcaccaaccacgccaucgugcagacccuggugaacagcgugaacagcagcauccccaaggccugcugcgugcccaccgagcugagcgccaucagcaugcuguaccuggacgaguacgacaagguggugcugaagaacuaccaggagauggugguggagggcugcggcugcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3003 - RNA, 1924 nt, Artificial Sequence
  mRNA product Design2 comprising derived and/or modified sequence from Homo sapiens__NP_001709.1__HsBMP6 (opt4)
ggggcgcugccuacggagguggcagccaucuccuucucggcaucaagcuuaccaugcccggccugggcagaagagcccaguggcugugcuggugguggggccugcugugcagcugcugcggcccccccccccugagacccccccugcccgccgccgccgccgccgccgccggcggccagcugcugggcgacggcggcagccccggcagaaccgagcagcccccccccagcccccagagcagcagcggcuuccuguacagaagacugaagacccaggagaagagagagaugcagaaggagauccugagcgugcugggccugccccacagacccagaccccugcacggccugcagcagccccagccccccgcccugagacagcaggaggagcagcagcagcagcagcagcugcccagaggcgagcccccccccggcagacugaagagcgccccccuguucaugcuggaccuguacaacgcccugagcgccgacaacgacgaggacggcgccagcgagggcgagagacagcagagcuggccccacgaggccgccagcagcagccagagaagacagcccccccccggcgccgcccacccccugaacagaaagagccugcuggcccccggcagcggcagcggcggcgccagcccccugaccagcgcccaggacagcgccuuccugaacgacgccgacauggugaugagcuucgugaaccugguggaguacgacaaggaguucagccccagacagagacaccacaaggaguucaaguucaaccugagccagauccccgagggcgagguggugaccgccgccgaguucagaaucuacaaggacugcgugaugggcagcuucaagaaccagaccuuccugaucagcaucuaccaggugcugcaggagcaccagcacagagacagcgaccuguuccugcuggacaccagaguggugugggccagcgaggagggcuggcuggaguucgacaucaccgccaccagcaaccuguggguggugaccccccagcacaacaugggccugcagcugagcguggugaccagagacggcgugcacgugcaccccagagccgccggccuggugggcagagacggccccuacgacaagcagcccuucaugguggccuucuucaaggugagcgaggugcacgugagaaccaccagaagcgccagcagcagaagaagacagcagagcagaaacagaagcacccagagccaggacguggccagagugagcagcgccagcgacuacaacagcagcgagcugaagaccgccugcagaaagcacgagcuguacgugagcuuccaggaccugggcuggcaggacuggaucaucgcccccaagggcuacgccgccaacuacugcgacggcgagugcagcuucccccugaacgcccacaugaacgccaccaaccacgccaucgugcagacccuggugcaccugaugaaccccgaguacgugcccaagcccugcugcgcccccaccaagcugaacgccaucagcgugcuguacuucgacgacaacagcaacgugauccugaagaaguacagaaacaugguggugagagccugcggcugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3004 - RNA, 1678 nt, Artificial Sequence
  mRNA product Design2 comprising derived and/or modified sequence from Homo sapiens__NP_001710.1__HsBMP7 (opt4)
ggggcgcugccuacggagguggcagccaucuccuucucggcaucaagcuuaccaugcacgugagaagccugagagccgccgccccccacagcuucguggcccugugggccccccuguuccugcugagaagcgcccuggccgacuucagccuggacaacgaggugcacagcagcuucauccacagaagacugagaagccaggagagaagagagaugcagagagagauccugagcauccugggccugccccacagacccagaccccaccugcagggcaagcacaacagcgcccccauguucaugcuggaccuguacaacgccauggccguggaggagggcggcggccccggcggccagggcuucagcuaccccuacaaggccguguucagcacccagggccccccccuggccagccugcaggacagccacuuccugaccgacgccgacauggugaugagcuucgugaaccugguggagcacgacaaggaguucuuccaccccagauaccaccacagagaguucagauucgaccugagcaagauccccgagggcgaggccgugaccgccgccgaguucagaaucuacaaggacuacaucagagagagauucgacaacgagaccuucagaaucagcguguaccaggugcugcaggagcaccugggcagagagagcgaccuguuccugcuggacagcagaacccugugggccagcgaggagggcuggcugguguucgacaucaccgccaccagcaaccacuggguggugaaccccagacacaaccugggccugcagcugagcguggagacccuggacggccagagcaucaaccccaagcuggccggccugaucggcagacacggcccccagaacaagcagcccuucaugguggccuucuucaaggccaccgaggugcacuucagaagcaucagaagcaccggcagcaagcagagaagccagaacagaagcaagacccccaagaaccaggaggcccugagaauggccaacguggccgagaacagcagcagcgaccagagacaggccugcaagaagcacgagcuguacgugagcuucagagaccugggcuggcaggacuggaucaucgcccccgagggcuacgccgccuacuacugcgagggcgagugcgccuucccccugaacagcuacaugaacgccaccaaccacgccaucgugcagacccuggugcacuucaucaaccccgagaccgugcccaagcccugcugcgcccccacccagcugaacgccaucagcgugcuguacuucgacgacagcagcaacgugauccugaagaaguacagaaacaugguggugagagccugcggcugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3005 - RNA, 682 nt, Artificial Sequence
  mRNA product Design2 comprising derived and/or modified sequence from Homo sapiens__NP_006264.2__HsCCL7 (opt4)
ggggcgcugccuacggagguggcagccaucuccuucucggcaucaagcuuaccaugaaggccagcgccgcccugcugugccugcugcugaccgccgccgccuucagcccccagggccuggcccagcccgugggcaucaacaccagcaccaccugcugcuacagauucaucaacaagaagauccccaagcagagacuggagagcuacagaagaaccaccagcagccacugccccagagaggccgugaucuucaagaccaagcuggacaaggagaucugcgccgaccccacccagaagugggugcaggacuucaugaagcaccuggacaagaagacccagacccccaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3006 - RNA, 4006 nt, Artificial Sequence
  mRNA product Design2 comprising derived and/or modified sequence from Homo sapiens__NP_001954.2__HsEGF (opt4)
ggggcgcugccuacggagguggcagccaucuccuucucggcaucaagcuuaccaugcugcugacccugaucauccugcugcccguggugagcaaguucagcuucgugagccugagcgccccccagcacuggagcugccccgagggcacccuggccggcaacggcaacagcaccugcgugggccccgcccccuuccugaucuucagccacggcaacagcaucuucagaaucgacaccgagggcaccaacuacgagcagcuggugguggacgccggcgugagcgugaucauggacuuccacuacaacgagaagagaaucuacuggguggaccuggagagacagcugcugcagagaguguuccugaacggcagcagacaggagagagugugcaacaucgagaagaacgugagcggcauggccaucaacuggaucaacgaggaggugaucuggagcaaccagcaggagggcaucaucaccgugaccgacaugaagggcaacaacagccacauccugcugagcgcccugaaguaccccgccaacguggccguggaccccguggagagauucaucuucuggagcagcgagguggccggcagccuguacagagccgaccuggacggcgugggcgugaaggcccugcuggagaccagcgagaagaucaccgccgugagccuggacgugcuggacaagagacuguucuggauccaguacaacagagagggcagcaacagccugaucugcagcugcgacuacgacggcggcagcgugcacaucagcaagcaccccacccagcacaaccuguucgccaugagccuguucggcgacagaaucuucuacagcaccuggaagaugaagaccaucuggaucgccaacaagcacaccggcaaggacauggugagaaucaaccugcacagcagcuucgugccccugggcgagcugaagguggugcacccccuggcccagcccaaggccgaggacgacaccugggagcccgagcagaagcugugcaagcugagaaagggcaacugcagcagcaccgugugcggccaggaccugcagagccaccugugcaugugcgccgagggcuacgcccugagcagagacagaaaguacugcgaggacgugaacgagugcgccuucuggaaccacggcugcacccugggcugcaagaacacccccggcagcuacuacugcaccugccccgugggcuucgugcugcugcccgacggcaagagaugccaccagcuggugagcugccccagaaacgugagcgagugcagccacgacugcgugcugaccagcgagggcccccugugcuucugccccgagggcagcgugcuggagagagacggcaagaccugcagcggcugcagcagccccgacaacggcggcugcagccagcugugcgugccccugagccccgugagcugggagugcgacugcuuccccggcuacgaccugcagcuggacgagaagagcugcgccgccagcggcccccagcccuuccugcuguucgccaacagccaggacaucagacacaugcacuucgacggcaccgacuacggcacccugcugagccagcagaugggcaugguguacgcccuggaccacgaccccguggagaacaagaucuacuucgcccacaccgcccugaaguggaucgagagagccaacauggacggcagccagagagagagacugaucgaggagggcguggacgugcccgagggccuggccguggacuggaucggcagaagauucuacuggaccgacagaggcaagagccugaucggcagaagcgaccugaacggcaagagaagcaagaucaucaccaaggagaacaucagccagcccagaggcaucgccgugcaccccauggccaagagacuguucuggaccgacaccggcaucaaccccagaaucgagagcagcagccugcagggccugggcagacuggugaucgccagcagcgaccugaucuggcccagcggcaucaccaucgacuuccugaccgacaagcuguacuggugcgacgccaagcagagcgugaucgagauggccaaccuggacggcagcaagagaagaagacugacccagaacgacgugggccaccccuucgccguggccguguucgaggacuacgugugguucagcgacugggccaugcccagcgugaugagagugaacaagagaaccggcaaggacagagugagacugcagggcagcaugcugaagcccagcagccuggugguggugcacccccuggccaagcccggcgccgaccccugccuguaccagaacggcggcugcgagcacaucugcaagaagagacugggcaccgccuggugcagcugcagagagggcuucaugaaggccagcgacggcaagaccugccuggcccuggacggccaccagcugcuggccggcggcgagguggaccugaagaaccaggugaccccccuggacauccugagcaagaccagagugagcgaggacaacaucaccgagagccagcacaugcugguggccgagaucauggugagcgaccaggacgacugcgcccccgugggcugcagcauguacgccagaugcaucagcgagggcgaggacgccaccugccagugccugaagggcuucgccggcgacggcaagcugugcagcgacaucgacgagugcgagaugggcgugcccgugugcccccccgccagcagcaagugcaucaacaccgagggcggcuacgugugcagaugcagcgagggcuaccagggcgacggcauccacugccuggacaucgacgagugccagcugggcgagcacagcugcggcgagaacgccagcugcaccaacaccgagggcggcuacaccugcaugugcgccggcagacugagcgagcccggccugaucugccccgacagcaccccccccccccaccugagagaggacgaccaccacuacagcgugagaaacagcgacagcgagugcccccugagccacgacggcuacugccugcacgacggcgugugcauguacaucgaggcccuggacaaguacgccugcaacugcguggugggcuacaucggcgagagaugccaguacagagaccugaaguggugggagcugagacacgccggccacggccagcagcagaaggugaucgugguggccgugugcgugguggugcuggugaugcugcugcugcugagccuguggggcgcccacuacuacagaacccagaagcugcugagcaagaaccccaagaaccccuacgaggagagcagcagagacgugagaagcagaagacccgccgacaccgaggacggcaugagcagcugcccccagcccugguucguggugaucaaggagcaccaggaccugaagaacggcggccagcccguggccggcgaggacggccaggccgccgacggcagcaugcagcccaccagcuggagacaggagccccagcugugcggcaugggcaccgagcagggcugcuggauccccgugagcagcgacaagggcagcugcccccaggugauggagagaagcuuccacaugcccagcuacggcacccagacccuggagggcggcguggagaagccccacagccugcugagcgccaacccccuguggcagcagagagcccuggaccccccccaccagauggagcugacccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3007 - RNA, 892 nt, Artificial Sequence
  mRNA product Design2 comprising derived and/or modified sequence from Homo sapiens__NP_001423.1__HsEREG (opt4)
ggggcgcugccuacggagguggcagccaucuccuucucggcaucaagcuuaccaugaccgccggcagaagaauggagaugcugugcgccggcagagugcccgcccugcugcugugccugggcuuccaccugcugcaggccgugcugagcaccaccgugauccccagcugcauccccggcgagagcagcgacaacugcaccgcccuggugcagaccgaggacaaccccagaguggcccaggugagcaucaccaagugcagcagcgacaugaacggcuacugccugcacggccagugcaucuaccugguggacaugagccagaacuacugcagaugcgaggugggcuacaccggcgugagaugcgagcacuucuuccugaccgugcaccagccccugagcaaggaguacguggcccugaccgugauccugaucauccuguuccugaucaccguggugggcagcaccuacuacuucugcagaugguacagaaacagaaagagcaaggagcccaagaaggaguacgagagagugaccagcggcgaccccgagcugccccaggugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3008 - RNA, 850 nt, Artificial Sequence
  mRNA product Design2 comprising derived and/or modified sequence from Homo sapiens__NP_000791.1__HsFGF1 (opt4)
ggggcgcugccuacggagguggcagccaucuccuucucggcaucaagcuuaccauggccgagggcgagaucaccaccuucaccgcccugaccgagaaguucaaccugccccccggcaacuacaagaagcccaagcugcuguacugcagcaacggcggccacuuccugagaauccugcccgacggcaccguggacggcaccagagacagaagcgaccagcacauccagcugcagcugagcgccgagagcgugggcgagguguacaucaagagcaccgagaccggccaguaccuggccauggacaccgacggccugcuguacggcagccagacccccaacgaggagugccuguuccuggagagacuggaggagaaccacuacaacaccuacaucagcaagaagcacgccgagaagaacugguucgugggccugaagaagaacggcagcugcaagagaggccccagaacccacuacggccagaaggccauccuguuccugccccugcccgugagcagcgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3009 - RNA, 1249 nt, Artificial Sequence
  mRNA product Design2 comprising derived and/or modified sequence from Homo sapiens__NP_001997.5__HsFGF2 (opt4)
ggggcgcugccuacggagguggcagccaucuccuucucggcaucaagcuuaccauggugggcgugggcggcggcgacguggaggacgugacccccagacccggcggcugccagaucagcggcagaggcgccagaggcugcaacggcauccccggcgccgccgccugggaggccgcccugcccagaagaagacccagaagacaccccagcgugaaccccagaagcagagccgccggcagccccagaaccagaggcagaagaaccgaggagagacccagcggcagcagacugggcgacagaggcagaggcagagcccugcccggcggcagacugggcggcagaggcagaggcagagcccccgagagagugggcggcagaggcagaggcagaggcaccgccgcccccagagccgcccccgccgccagaggcagcagacccggccccgccggcaccauggccgccggcagcaucaccacccugcccgcccugcccgaggacggcggcagcggcgccuucccccccggccacuucaaggaccccaagagacuguacugcaagaacggcggcuucuuccugagaauccaccccgacggcagaguggacggcgugagagagaagagcgacccccacaucaagcugcagcugcaggccgaggagagaggcguggugagcaucaagggcgugugcgccaacagauaccuggccaugaaggaggacggcagacugcuggccagcaagugcgugaccgacgagugcuucuucuucgagagacuggagagcaacaacuacaacaccuacagaagcagaaaguacaccagcugguacguggcccugaagagaaccggccaguacaagcugggcagcaagaccggccccggccagaaggccauccuguuccugcccaugagcgccaagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3010 - RNA, 967 nt, Artificial Sequence
  mRNA product Design2 comprising derived and/or modified sequence from Homo sapiens__NP_002000.1__HsFGF7 (opt4)
ggggcgcugccuacggagguggcagccaucuccuucucggcaucaagcuuaccaugcacaaguggauccugaccuggauccugcccacccugcuguacagaagcugcuuccacaucaucugccuggugggcaccaucagccuggccugcaacgacaugacccccgagcagauggccaccaacgugaacugcagcagccccgagagacacaccagaagcuacgacuacauggagggcggcgacaucagagugagaagacuguucugcagaacccagugguaccugagaaucgacaagagaggcaaggugaagggcacccaggagaugaagaacaacuacaacaucauggagaucagaaccguggccgugggcaucguggccaucaagggcguggagagcgaguucuaccuggccaugaacaaggagggcaagcuguacgccaagaaggagugcaacgaggacugcaacuucaaggagcugauccuggagaaccacuacaacaccuacgccagcgccaaguggacccacaacggcggcgagauguucguggcccugaaccagaagggcauccccgugagaggcaagaagaccaagaaggagcagaagaccgcccacuuccugcccauggccaucaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3011 - RNA, 1009 nt, Artificial Sequence
  mRNA product Design2 comprising derived and/or modified sequence from Homo sapiens__NP_001936.1__HsHBEGF (opt4)
ggggcgcugccuacggagguggcagccaucuccuucucggcaucaagcuuaccaugaagcugcugcccagcguggugcugaagcuguuccuggccgccgugcugagcgcccuggugaccggcgagagccuggagagacugagaagaggccuggccgccggcaccagcaaccccgacccccccaccgugagcaccgaccagcugcugccccugggcggcggcagagacagaaaggugagagaccugcaggaggccgaccuggaccugcugagagugacccugagcagcaagccccaggcccuggccacccccaacaaggaggagcacggcaagagaaagaagaagggcaagggccugggcaagaagagagaccccugccugagaaaguacaaggacuucugcauccacggcgagugcaaguacgugaaggagcugagagcccccagcugcaucugccaccccggcuaccacggcgagagaugccacggccugagccugcccguggagaacagacuguacaccuacgaccacaccaccauccuggccgugguggccguggugcugagcagcgugugccugcuggugaucgugggccugcugauguucagauaccacagaagaggcggcuacgacguggagaacgaggagaaggugaagcugggcaugaccaacagccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3012 - RNA, 2569 nt, Artificial Sequence
  mRNA product Design2 comprising derived and/or modified sequence from Homo sapiens__NP_000592.3__HsHGF (opt4)
ggggcgcugccuacggagguggcagccaucuccuucucggcaucaagcuuaccaugugggugaccaagcugcugcccgcccugcugcugcagcacgugcugcugcaccugcugcugcugcccaucgccauccccuacgccgagggccagagaaagagaagaaacaccauccacgaguucaagaagagcgccaagaccacccugaucaagaucgaccccgcccugaagaucaagaccaagaaggugaacaccgccgaccagugcgccaacagaugcaccagaaacaagggccugcccuucaccugcaaggccuucguguucgacaaggccagaaagcagugccugugguuccccuucaacagcaugagcagcggcgugaagaaggaguucggccacgaguucgaccuguacgagaacaaggacuacaucagaaacugcaucaucggcaagggcagaagcuacaagggcaccgugagcaucaccaagagcggcaucaagugccagcccuggagcagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccugauggaccacaccgagagcggcaagaucugccagagaugggaccaccagaccccccacagacacaaguuccugcccgagagauaccccgacaagggcuucgacgacaacuacugcagaaaccccgacggccagcccagacccuggugcuacacccuggacccccacaccagaugggaguacugcgccaucaagaccugcgccgacaacaccaugaacgacaccgacgugccccuggagaccaccgagugcauccagggccagggcgagggcuacagaggcaccgugaacaccaucuggaacggcauccccugccagagaugggacagccaguacccccacgagcacgacaugacccccgagaacuucaagugcaaggaccugagagagaacuacugcagaaaccccgacggcagcgagagccccuggugcuucaccaccgaccccaacaucagagugggcuacugcagccagauccccaacugcgacaugagccacggccaggacugcuacagaggcaacggcaagaacuacaugggcaaccugagccagaccagaagcggccugaccugcagcaugugggacaagaacauggaggaccugcacagacacaucuucugggagcccgacgccagcaagcugaacgagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccaccagaaccaacaucggcuggauggugagccugagauacagaaacaagcacaucugcggcggcagccugaucaaggagagcugggugcugaccgccagacagugcuuccccagcagagaccugaaggacuacgaggccuggcugggcauccacgacgugcacggcagaggcgacgagaagugcaagcaggugcugaacgugagccagcugguguacggccccgagggcagcgaccuggugcugaugaagcuggccagacccgccgugcuggacgacuucgugagcaccaucgaccugcccaacuacggcugcaccauccccgagaagaccagcugcagcguguacggcuggggcuacaccggccugaucaacuacgacggccugcugagaguggcccaccuguacaucaugggcaacgagaagugcagccagcaccacagaggcaaggugacccugaacgagagcgagaucugcgccggcgccgagaagaucggcagcggccccugcgagggcgacuacggcggcccccuggugugcgagcagcacaagaugagaauggugcugggcgugaucgugcccggcagaggcugcgccauccccaacagacccggcaucuucgugagaguggccuacuacgccaaguggauccacaagaucauccugaccuacaaggugccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3013 - RNA, 2308 nt, Artificial Sequence
  mRNA product Design2 comprising derived and/or modified sequence from Homo sapiens__NP_005336.3 __HsHSPA1A (opt4)
ggggcgcugccuacggagguggcagccaucuccuucucggcaucaagcuuaccauggccaaggccgccgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggcccugaacccccagaacaccguguucgacgccaagagacugaucggcagaaaguucggcgaccccguggugcagagcgacaugaagcacuggcccuuccaggugaucaacgacggcgacaagcccaaggugcaggugagcuacaagggcgagaccaaggccuucuaccccgaggagaucagcagcauggugcugaccaagaugaaggagaucgccgaggccuaccugggcuaccccgugaccaacgccgugaucaccgugcccgccuacuucaacgacagccagagacaggccaccaaggacgccggcgugaucgccggccugaacgugcugagaaucaucaacgagcccaccgccgccgccaucgccuacggccuggacagaaccggcaagggcgagagaaacgugcugaucuucgaccugggcggcggcaccuucgacgugagcauccugaccaucgacgacggcaucuucgaggugaaggccaccgccggcgacacccaccugggcggcgaggacuucgacaacagacuggugaaccacuucguggaggaguucaagagaaagcacaagaaggacaucagccagaacaagagagccgugagaagacugagaaccgccugcgagagagccaagagaacccugagcagcagcacccaggccagccuggagaucgacagccuguucgagggcaucgacuucuacaccagcaucaccagagccagauucgaggagcugugcagcgaccuguucagaagcacccuggagcccguggagaaggcccugagagacgccaagcuggacaaggcccagauccacgaccuggugcuggugggcggcagcaccagaauccccaaggugcagaagcugcugcaggacuucuucaacggcagagaccugaacaagagcaucaaccccgacgaggccguggccuacggcgccgccgugcaggccgccauccugaugggcgacaagagcgagaacgugcaggaccugcugcugcuggacguggccccccugagccugggccuggagaccgccggcggcgugaugaccgcccugaucaagagaaacagcaccauccccaccaagcagacccagaucuucaccaccuacagcgacaaccagcccggcgugcugauccagguguacgagggcgagagagccaugaccaaggacaacaaccugcugggcagauucgagcugagcggcaucccccccgcccccagaggcgugccccagaucgaggugaccuucgacaucgacgccaacggcauccugaacgugaccgccaccgacaagagcaccggcaaggccaacaagaucaccaucaccaacgacaagggcagacugagcaaggaggagaucgagagaauggugcaggaggccgagaaguacaaggccgaggacgaggugcagagagagagagugagcgccaagaacgcccuggagagcuacgccuucaacaugaagagcgccguggaggacgagggccugaagggcaagaucagcgaggccgacaagaagaaggugcuggacaagugccaggaggugaucagcuggcuggacgccaacacccuggccgagaaggacgaguucgagcacaagagaaaggagcuggagcaggugugcaaccccaucaucagcggccuguaccagggcgccggcggccccggccccggcggcuucggcgcccagggccccaagggcggcagcggcagcggccccaccaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3014 - RNA, 2308 nt, Artificial Sequence; identical to SEQ ID NO: 3013
  mRNA product Design2 comprising derived and/or modified sequence from Homo sapiens__NP_005337.2 __HsHSPA1B (opt4)

SEQ ID NO: 3015 - RNA, 2308 nt, Artificial Sequence
  mRNA product Design2 comprising derived and/or modified sequence from Homo sapiens__NP_005518.3 __HsHSPA1L (opt4)
ggggcgcugccuacggagguggcagccaucuccuucucggcaucaagcuuaccauggccaccgccaagggcaucgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaacccccagaacaccguguucgacgccaagagacugaucggcagaaaguucaacgaccccguggugcaggccgacaugaagcuguggcccuuccaggugaucaacgagggcggcaagcccaaggugcuggugagcuacaagggcgagaacaaggccuucuaccccgaggagaucagcagcauggugcugaccaagcugaaggagaccgccgaggccuuccugggccaccccgugaccaacgccgugaucaccgugcccgccuacuucaacgacagccagagacaggccaccaaggacgccggcgugaucgccggccugaacgugcugagaaucaucaacgagcccaccgccgccgccaucgccuacggccuggacaagggcggccagggcgagagacacgugcugaucuucgaccugggcggcggcaccuucgacgugagcauccugaccaucgacgacggcaucuucgaggugaaggccaccgccggcgacacccaccugggcggcgaggacuucgacaacagacuggugagccacuucguggaggaguucaagagaaagcacaagaaggacaucagccagaacaagagagccgugagaagacugagaaccgccugcgagagagccaagagaacccugagcagcagcacccaggccaaccuggagaucgacagccuguacgagggcaucgacuucuacaccagcaucaccagagccagauucgaggagcugugcgccgaccuguucagaggcacccuggagcccguggagaaggcccugagagacgccaagauggacaaggccaagauccacgacaucgugcuggugggcggcagcaccagaauccccaaggugcagagacugcugcaggacuacuucaacggcagagaccugaacaagagcaucaaccccgacgaggccguggccuacggcgccgccgugcaggccgccauccugaugggcgacaagagcgagaaggugcaggaccugcugcugcuggacguggccccccugagccugggccuggagaccgccggcggcgugaugaccgcccugaucaagagaaacagcaccauccccaccaagcagacccagaucuucaccaccuacagcgacaaccagcccggcgugcugauccagguguacgagggcgagagagccaugaccaaggacaacaaccugcugggcagauucgaccugaccggcaucccccccgcccccagaggcgugccccagaucgaggugaccuucgacaucgacgccaacggcauccugaacgugaccgccaccgacaagagcaccggcaaggugaacaagaucaccaucaccaacgacaagggcagacugagcaaggaggagaucgagagaauggugcuggacgccgagaaguacaaggccgaggacgaggugcagagagagaagaucgccgccaagaacgcccuggagagcuacgccuucaacaugaagagcguggugagcgacgagggccugaagggcaagaucagcgagagcgacaagaacaagauccuggacaagugcaacgagcugcugagcuggcuggaggugaaccagcuggccgagaaggacgaguucgaccacaagagaaaggagcuggagcagaugugcaaccccaucaucaccaagcuguaccagggcggcugcaccggccccgccugcggcaccggcuacgugcccggcagacccgccaccggccccaccaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3016 - RNA, 2302 nt, Artificial Sequence
  mRNA product Design2 comprising derived and/or modified sequence from Homo sapiens__NP_068814.2 __HsHSPA2 (opt4)
ggggcgcugccuacggagguggcagccaucuccuucucggcaucaagcuuaccaugagcgccagaggccccgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaaccccaccaacaccaucuucgacgccaagagacugaucggcagaaaguucgaggacgccaccgugcagagcgacaugaagcacuggcccuucagaguggugagcgagggcggcaagcccaaggugcagguggaguacaagggcgagaccaagaccuucuuccccgaggagaucagcagcauggugcugaccaagaugaaggagaucgccgaggccuaccugggcggcaaggugcacagcgccgugaucaccgugcccgccuacuucaacgacagccagagacaggccaccaaggacgccggcaccaucaccggccugaacgugcugagaaucaucaacgagcccaccgccgccgccaucgccuacggccuggacaagaagggcugcgccggcggcgagaagaacgugcugaucuucgaccugggcggcggcaccuucgacgugagcauccugaccaucgaggacggcaucuucgaggugaagagcaccgccggcgacacccaccugggcggcgaggacuucgacaacagaauggugagccaccuggccgaggaguucaagagaaagcacaagaaggacaucggccccaacaagagagccgugagaagacugagaaccgccugcgagagagccaagagaacccugagcagcagcacccaggccagcaucgagaucgacagccuguacgagggcguggacuucuacaccagcaucaccagagccagauucgaggagcugaacgccgaccuguucagaggcacccuggagcccguggagaaggcccugagagacgccaagcuggacaagggccagauccaggagaucgugcuggugggcggcagcaccagaauccccaagauccagaagcugcugcaggacuucuucaacggcaaggagcugaacaagagcaucaaccccgacgaggccguggccuacggcgccgccgugcaggccgccauccugaucggcgacaagagcgagaacgugcaggaccugcugcugcuggacgugaccccccugagccugggcaucgagaccgccggcggcgugaugaccccccugaucaagagaaacaccaccauccccaccaagcagacccagaccuucaccaccuacagcgacaaccagagcagcgugcuggugcagguguacgagggcgagagagccaugaccaaggacaacaaccugcugggcaaguucgaccugaccggcaucccccccgcccccagaggcgugccccagaucgaggugaccuucgacaucgacgccaacggcauccugaacgugaccgccgccgacaagagcaccggcaaggagaacaagaucaccaucaccaacgacaagggcagacugagcaaggacgacaucgacagaauggugcaggaggccgagagauacaagagcgaggacgaggccaacagagacagaguggccgccaagaacgcccuggagagcuacaccuacaacaucaagcagaccguggaggacgagaagcugagaggcaagaucagcgagcaggacaagaacaagauccuggacaagugccaggaggugaucaacuggcuggacagaaaccagauggccgagaaggacgaguacgagcacaagcagaaggagcuggagagagugugcaaccccaucaucagcaagcuguaccagggcggccccggcggcggcagcggcggcggcggcagcggcgccagcggcggccccaccaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3017 - RNA, 2905 nt, Artificial Sequence
  mRNA product Design2 comprising derived and/or modified sequence from Homo sapiens__NP_002145.3 __HsHSPA4 (opt4)
ggggcgcugccuacggagguggcagccaucuccuucucggcaucaagcuuaccaugagcguggugggcaucgaccugggcuuccagagcugcuacguggccguggccagagccggcggcaucgagaccaucgccaacgaguacagcgacagaugcacccccgccugcaucagcuucggccccaagaacagaagcaucggcgccgccgccaagagccaggugaucagcaacgccaagaacaccgugcagggcuucaagagauuccacggcagagccuucagcgaccccuucguggaggccgagaagagcaaccuggccuacgacaucgugcagcugcccaccggccugaccggcaucaaggugaccuacauggaggaggagagaaacuucaccaccgagcaggugaccgccaugcugcugagcaagcugaaggagaccgccgagagcgugcugaagaagcccgugguggacugcguggugagcgugcccugcuucuacaccgacgccgagagaagaagcgugauggacgccacccagaucgccggccugaacugccugagacugaugaacgagaccaccgccguggcccuggccuacggcaucuacaagcaggaccugcccgcccuggaggagaagcccagaaacgugguguucguggacaugggccacagcgccuaccaggugagcgugugcgccuucaacagaggcaagcugaaggugcuggccaccgccuucgacaccacccugggcggcagaaaguucgacgaggugcuggugaaccacuucugcgaggaguucggcaagaaguacaagcuggacaucaagagcaagaucagagcccugcugagacugagccaggagugcgagaagcugaagaagcugaugagcgccaacgccagcgaccugccccugagcaucgagugcuucaugaacgacguggacgugagcggcaccaugaacagaggcaaguuccuggagaugugcaacgaccugcuggccagaguggagcccccccugagaagcgugcuggagcagaccaagcugaagaaggaggacaucuacgccguggagaucgugggcggcgccaccagaauccccgccgugaaggagaagaucagcaaguucuucggcaaggagcugagcaccacccugaacgccgacgaggccgugaccagaggcugcgcccugcagugcgccauccugagccccgccuucaaggugagagaguucagcaucaccgacguggugcccuaccccaucagccugagauggaacagccccgccgaggagggcagcagcgacugcgagguguucagcaagaaccacgccgcccccuucagcaaggugcugaccuucuacagaaaggagcccuucacccuggaggccuacuacagcagcccccaggaccugcccuaccccgaccccgccaucgcccaguucagcgugcagaaggugaccccccagagcgacggcagcagcagcaaggugaaggugaaggugagagugaacgugcacggcaucuucagcgugagcagcgccagccugguggaggugcacaagagcgaggagaacgaggagcccauggagaccgaccagaacgccaaggaggaggagaagaugcagguggaccaggaggagccccacguggaggagcagcagcagcagacccccgccgagaacaaggccgagagcgaggagauggagaccagccaggccggcagcaaggacaagaagauggaccagcccccccaggccaagaaggccaaggugaagaccagcaccguggaccugcccaucgagaaccagcugcuguggcagaucgacagagagaugcugaaccuguacaucgagaacgagggcaagaugaucaugcaggacaagcuggagaaggagagaaacgacgccaagaacgccguggaggaguacguguacgagaugagagacaagcugagcggcgaguacgagaaguucgugagcgaggacgacagaaacagcuucacccugaagcuggaggacaccgagaacuggcuguacgaggacggcgaggaccagcccaagcagguguacguggacaagcuggccgagcugaagaaccugggccagcccaucaagaucagauuccaggagagcgaggagagacccaagcuguucgaggagcugggcaagcagauccagcaguacaugaagaucaucagcagcuucaagaacaaggaggaccaguacgaccaccuggacgccgccgacaugaccaagguggagaagagcaccaacgaggccauggaguggaugaacaacaagcugaaccugcagaacaagcagagccugaccauggaccccguggugaagagcaaggagaucgaggccaagaucaaggagcugaccagcaccugcagccccaucaucagcaagcccaagcccaagguggagccccccaaggaggagcagaagaacgccgagcagaacggccccguggacggccagggcgacaaccccggcccccaggccgccgagcagggcaccgacaccgccgugcccagcgacagcgacaagaagcugcccgagauggacaucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3018 - RNA, 2902 nt, Artificial Sequence
  mRNA product Design2 comprising derived and/or modified sequence from Homo sapiens__NP_055093.2 __HsHSPA4L (opt4)
ggggcgcugccuacggagguggcagccaucuccuucucggcaucaagcuuaccaugagcguggugggcaucgaccugggcuuccugaacugcuacaucgccguggccagaagcggcggcaucgagaccaucgccaacgaguacagcgacagaugcacccccgccugcaucagccugggcagcagaaccagagccaucggcaacgccgccaagagccagaucgugaccaacgugagaaacaccauccacggcuucaagaagcugcacggcagaagcuucgacgaccccaucgugcagaccgagagaaucagacugcccuacgagcugcagaagaugcccaacggcagcgccggcgugaaggugagauaccuggaggaggagagacccuucgccaucgagcaggugaccggcaugcugcuggccaagcugaaggagaccagcgagaacgcccugaagaagcccguggccgacugcgugaucagcauccccagcuucuucaccgacgccgagagaagaagcgugauggccgccgcccagguggccggccugaacugccugagacugaugaacgagaccaccgccguggcccuggccuacggcaucuacaagcaggaccugcccccccuggacgagaagcccagaaacgugguguucaucgacaugggccacagcgccuaccaggugcuggugugcgccuucaacaagggcaagcugaaggugcuggccaccaccuucgaccccuaccugggcggcagaaacuucgacgaggcccugguggacuacuucugcgacgaguucaagaccaaguacaagaucaacgugaaggagaacagcagagcccugcugagacuguaccaggagugcgagaagcugaagaagcugaugagcgccaacgccagcgaccugccccugaacaucgagugcuucaugaacgaccuggacgugagcagcaagaugaacagagcccaguucgagcagcugugcgccagccugcuggccagaguggagcccccccugaaggccgugauggagcaggccaaccugcagagagaggacaucagcagcaucgagaucgugggcggcgccaccagaauccccgccgugaaggagcagaucaccaaguucuuccugaaggacaucagcaccacccugaacgccgacgaggccguggccagaggcugcgcccugcagugcgccauccugagccccgccuucaaggugagagaguucagcaucaccgaccuggugcccuacagcaucacccugagauggaagaccagcuucgaggacggcagcggcgagugcgagguguucugcaagaaccaccccgcccccuucagcaaggugaucaccuuccacaagaaggagcccuucgagcuggaggccuucuacaccaaccugcacgaggugcccuaccccgacgccagaaucggcagcuucaccauccagaacguguucccccagagcgacggcgacagcagcaaggugaaggugaaggugagagugaacauccacggcaucuucagcguggccagcgccagcgugaucgagaagcagaaccuggagggcgaccacagcgacgcccccauggagaccgagaccagcuucaagaacgagaacaaggacaacauggacaagaugcagguggaccaggaggagggccaccagaagugccacgccgagcacacccccgaggaggagaucgaccacaccggcgccaagaccaagagcgccgugagcgacaagcaggacagacugaaccagacccugaagaagggcaaggugaagagcaucgaccugcccauccagagcagccugugcagacagcugggccaggaccugcugaacagcuacaucgagaacgagggcaagaugaucaugcaggacaagcuggagaaggagagaaacgacgccaagaacgccguggaggaguacguguacgacuucagagacagacugggcaccguguacgagaaguucaucacccccgaggaccugagcaagcugagcgccgugcuggaggacaccgagaacuggcuguacgaggacggcgaggaccagcccaagcagguguacguggacaagcugcaggagcugaagaaguacggccagcccauccagaugaaguacauggagcacgaggagagacccaaggcccugaacgaccugggcaagaagauccagcuggugaugaaggugaucgaggccuacagaaacaaggacgagagauacgaccaccuggaccccaccgagauggagaagguggagaagugcaucagcgacgccaugagcuggcugaacagcaagaugaacgcccagaacaagcugagccugacccaggaccccguggugaaggugagcgagaucguggccaagagcaaggagcuggacaacuucugcaaccccaucaucuacaagcccaagcccaaggccgaggugcccgaggacaagcccaaggccaacagcgagcacaacggccccauggacggccagagcggcaccgagaccaagagcgacagcaccaaggacagcagccagcacaccaagagcagcggcgagauggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3019 - RNA, 2347 nt, Artificial Sequence
  mRNA product Design2 comprising derived and/or modified sequence from Homo sapiens__NP_005338.1__HsHSPA5 (opt4)
ggggcgcugccuacggagguggcagccaucuccuucucggcaucaagcuuaccaugaagcugagccugguggccgccaugcugcugcugcugagcgccgccagagccgaggaggaggacaagaaggaggacgugggcaccguggugggcaucgaccugggcaccaccuacagcugcgugggcguguucaagaacggcagaguggagaucaucgccaacgaccagggcaacagaaucacccccagcuacguggccuucacccccgagggcgagagacugaucggcgacgccgccaagaaccagcugaccagcaaccccgagaacaccguguucgacgccaagagacugaucggcagaaccuggaacgaccccagcgugcagcaggacaucaaguuccugcccuucaaggugguggagaagaagaccaagcccuacauccagguggacaucggcggcggccagaccaagaccuucgcccccgaggagaucagcgccauggugcugaccaagaugaaggagaccgccgaggccuaccugggcaagaaggugacccacgccguggugaccgugcccgccuacuucaacgacgcccagagacaggccaccaaggacgccggcaccaucgccggccugaacgugaugagaaucaucaacgagcccaccgccgccgccaucgccuacggccuggacaagagagagggcgagaagaacauccugguguucgaccugggcggcggcaccuucgacgugagccugcugaccaucgacaacggcguguucgaggugguggccaccaacggcgacacccaccugggcggcgaggacuucgaccagagagugauggagcacuucaucaagcuguacaagaagaagaccggcaaggacgugagaaaggacaacagagccgugcagaagcugagaagagagguggagaaggccaagagagcccugagcagccagcaccaggccagaaucgagaucgagagcuucuacgagggcgaggacuucagcgagacccugaccagagccaaguucgaggagcugaacauggaccuguucagaagcaccaugaagcccgugcagaaggugcuggaggacagcgaccugaagaagagcgacaucgacgagaucgugcuggugggcggcagcaccagaauccccaagauccagcagcuggugaaggaguucuucaacggcaaggagcccagcagaggcaucaaccccgacgaggccguggccuacggcgccgccgugcaggccggcgugcugagcggcgaccaggacaccggcgaccuggugcugcuggacgugugcccccugacccugggcaucgagaccgugggcggcgugaugaccaagcugauccccagaaacaccguggugcccaccaagaagagccagaucuucagcaccgccagcgacaaccagcccaccgugaccaucaagguguacgagggcgagagaccccugaccaaggacaaccaccugcugggcaccuucgaccugaccggcaucccccccgcccccagaggcgugccccagaucgaggugaccuucgagaucgacgugaacggcauccugagagugaccgccgaggacaagggcaccggcaacaagaacaagaucaccaucaccaacgaccagaacagacugacccccgaggagaucgagagaauggugaacgacgccgagaaguucgccgaggaggacaagaagcugaaggagagaaucgacaccagaaacgagcuggagagcuacgccuacagccugaagaaccagaucggcgacaaggagaagcugggcggcaagcugagcagcgaggacaaggagaccauggagaaggccguggaggagaagaucgaguggcuggagagccaccaggacgccgacaucgaggacuucaaggccaagaagaaggagcuggaggagaucgugcagcccaucaucagcaagcuguacggcagcgccggccccccccccaccggcgaggaggacaccgccgagaaggacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3020 - RNA, 2314 nt, Artificial Sequence
  mRNA product Design2 comprising derived and/or modified sequence from Homo sapiens__NP_002146.2__HsHSPA6 (opt4)
ggggcgcugccuacggagguggcagccaucuccuucucggcaucaagcuuaccaugcaggcccccagagagcuggccgugggcaucgaccugggcaccaccuacagcugcgugggcguguuccagcagggcagaguggagauccuggccaacgaccagggcaacagaaccacccccagcuacguggccuucaccgacaccgagagacuggugggcgacgccgccaagagccaggccgcccugaacccccacaacaccguguucgacgccaagagacugaucggcagaaaguucgccgacaccaccgugcagagcgacaugaagcacuggcccuucagaguggugagcgagggcggcaagcccaaggugagagugugcuacagaggcgaggacaagaccuucuaccccgaggagaucagcagcauggugcugagcaagaugaaggagaccgccgaggccuaccugggccagcccgugaagcacgccgugaucaccgugcccgccuacuucaacgacagccagagacaggccaccaaggacgccggcgccaucgccggccugaacgugcugagaaucaucaacgagcccaccgccgccgccaucgccuacggccuggacagaagaggcgccggcgagagaaacgugcugaucuucgaccugggcggcggcaccuucgacgugagcgugcugagcaucgacgccggcguguucgaggugaaggccaccgccggcgacacccaccugggcggcgaggacuucgacaacagacuggugaaccacuucauggaggaguucagaagaaagcacggcaaggaccugagcggcaacaagagagcccugagaagacugagaaccgccugcgagagagccaagagaacccugagcagcagcacccaggccacccuggagaucgacagccuguucgagggcguggacuucuacaccagcaucaccagagccagauucgaggagcugugcagcgaccuguucagaagcacccuggagcccguggagaaggcccugagagacgccaagcuggacaaggcccagauccacgacguggugcuggugggcggcagcaccagaauccccaaggugcagaagcugcugcaggacuucuucaacggcaaggagcugaacaagagcaucaaccccgacgaggccguggccuacggcgccgccgugcaggccgccgugcugaugggcgacaagugcgagaaggugcaggaccugcugcugcuggacguggccccccugagccugggccuggagaccgccggcggcgugaugaccacccugauccagagaaacgccaccauccccaccaagcagacccagaccuucaccaccuacagcgacaaccagcccggcguguucauccagguguacgagggcgagagagccaugaccaaggacaacaaccugcugggcagauucgagcugagcggcaucccccccgcccccagaggcgugccccagaucgaggugaccuucgacaucgacgccaacggcauccugagcgugaccgccaccgacagaagcaccggcaaggccaacaagaucaccaucaccaacgacaagggcagacugagcaaggaggagguggagagaauggugcacgaggccgagcaguacaaggccgaggacgaggcccagagagacagaguggccgccaagaacagccuggaggcccacguguuccacgugaagggcagccugcaggaggagagccugagagacaagauccccgaggaggacagaagaaagaugcaggacaagugcagagaggugcuggccuggcuggagcacaaccagcuggccgagaaggaggaguacgagcaccagaagagagagcuggagcagaucugcagacccaucuucagcagacuguacggcggccccggcgugcccggcggcagcagcugcggcacccaggccagacagggcgaccccagcaccggccccaucaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3021 - RNA, 1486 nt, Artificial Sequence
  mRNA product Design2 comprising derived and/or modified sequence from Homo sapiens__P48741__HsHSPA7 (opt4)
ggggcgcugccuacggagguggcagccaucuccuucucggcaucaagcuuaccaugcaggcccccagagagcuggccgugggcaucgaccugggcaccaccuacagcugcgugggcguguuccagcagggcagaguggagauccuggccaacgaccagggcaacagaaccacccccagcuacguggccuucaccgacaccgagagacuggugggcgacgccgccaagagccaggccgcccugaacccccacaacaccguguucgacgccaagagacugaucggcagaaaguucgccgacaccaccgugcagagcgacaugaagcacuggcccuuccagguggugagcgagggcggcaagcccaaggugagagugugcuacagaggcgaggacaagaccuucuaccccgaggagaucagcagcauggugcugagcaagaugaaggagaccgccgaggccuaccugggccagcccgugaagcacgccgugaucaccgugcccaccuacuucagcaacagccagagacaggccaccaaggacgccggcgccaucgccggccugaaggugcugcccaucaucaacgaggccaccgccgccgccaucgccuacggccuggacagaagaggcgccggcaagagaaacgugcugaucuucgaccugggcggcggcaccuucgacgugagcgugcugagcaucgacgccggcguguucgaggugaaggccaccgccggcgacacccaccugggcggcgaggacuucgacaacagacuggugaaccacuucauggaggaguucagaagaaagcacggcaaggaccugagcggcaacaagagagcccugagaagacugagaaccgccugcgagagagccaagagaacccccagcagcagcacccaggccacccuggagaucgacagccuguucgagggcguggacuucuacaagagcaucaccagagccagauucgaggagcugugcagcgaccuguucagaagcacccuggagcccguggagaaggcccugagagacgccaagcuggacaaggcccagauccacgacuucgugcugggcggcggccugcacagccacccccagggcgccgagguggccgccggccugcugcagagacagggcgccgagcaggagcaccagcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3022 - RNA, 2323 nt, Artificial Sequence
  mRNA product Design2 comprising derived and/or modified sequence from Homo sapiens__NP_006588.1 __HsHSPA8 (opt4)
ggggcgcugccuacggagguggcagccaucuccuucucggcaucaagcuuaccaugagcaagggccccgccgugggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaaccccaccaacaccguguucgacgccaagagacugaucggcagaagauucgacgacgccguggugcagagcgacaugaagcacuggcccuucaugguggugaacgacgccggcagacccaaggugcagguggaguacaagggcgagaccaagagcuucuaccccgaggaggugagcagcauggugcugaccaagaugaaggagaucgccgaggccuaccugggcaagaccgugaccaacgccguggugaccgugcccgccuacuucaacgacagccagagacaggccaccaaggacgccggcaccaucgccggccugaacgugcugagaaucaucaacgagcccaccgccgccgccaucgccuacggccuggacaagaaggugggcgccgagagaaacgugcugaucuucgaccugggcggcggcaccuucgacgugagcauccugaccaucgaggacggcaucuucgaggugaagagcaccgccggcgacacccaccugggcggcgaggacuucgacaacagaauggugaaccacuucaucgccgaguucaagagaaagcacaagaaggacaucagcgagaacaagagagccgugagaagacugagaaccgccugcgagagagccaagagaacccugagcagcagcacccaggccagcaucgagaucgacagccuguacgagggcaucgacuucuacaccagcaucaccagagccagauucgaggagcugaacgccgaccuguucagaggcacccuggaccccguggagaaggcccugagagacgccaagcuggacaagagccagauccacgacaucgugcuggugggcggcagcaccagaauccccaagauccagaagcugcugcaggacuucuucaacggcaaggagcugaacaagagcaucaaccccgacgaggccguggccuacggcgccgccgugcaggccgccauccugagcggcgacaagagcgagaacgugcaggaccugcugcugcuggacgugaccccccugagccugggcaucgagaccgccggcggcgugaugaccgugcugaucaagagaaacaccaccauccccaccaagcagacccagaccuucaccaccuacagcgacaaccagcccggcgugcugauccagguguacgagggcgagagagccaugaccaaggacaacaaccugcugggcaaguucgagcugaccggcaucccccccgcccccagaggcgugccccagaucgaggugaccuucgacaucgacgccaacggcauccugaacgugagcgccguggacaagagcaccggcaaggagaacaagaucaccaucaccaacgacaagggcagacugagcaaggaggacaucgagagaauggugcaggaggccgagaaguacaaggccgaggacgagaagcagagagacaaggugagcagcaagaacagccuggagagcuacgccuucaacaugaaggccaccguggaggacgagaagcugcagggcaagaucaacgacgaggacaagcagaagauccuggacaagugcaacgagaucaucaacuggcuggacaagaaccagaccgccgagaaggaggaguucgagcaccagcagaaggagcuggagaaggugugcaaccccaucaucaccaagcuguaccagagcgccggcggcaugcccggcggcaugcccggcggcuuccccggcggcggcgccccccccagcggcggcgccagcagcggccccaccaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3023 - RNA, 2422 nt, Artificial Sequence
  mRNA product Design2 comprising derived and/or modified sequence from Homo sapiens__NP_004125.3 __HsHSPA9 (opt4)
ggggcgcugccuacggagguggcagccaucuccuucucggcaucaagcuuaccaugaucagcgccagcagagccgccgccgccagacuggugggcgccgccgccagcagaggccccaccgccgccagacaccaggacagcuggaacggccugagccacgaggccuucagacuggugagcagaagagacuacgccagcgaggccaucaagggcgccguggugggcaucgaccugggcaccaccaacagcugcguggccgugauggagggcaagcaggccaaggugcuggagaacgccgagggcgccagaaccacccccagcgugguggccuucaccgccgacggcgagagacuggugggcaugcccgccaagagacaggccgugaccaaccccaacaacaccuucuacgccaccaagagacugaucggcagaagauacgacgaccccgaggugcagaaggacaucaagaacgugcccuucaagaucgugagagccagcaacggcgacgccuggguggaggcccacggcaagcuguacagccccagccagaucggcgccuucgugcugaugaagaugaaggagaccgccgagaacuaccugggccacaccgccaagaacgccgugaucaccgugcccgccuacuucaacgacagccagagacaggccaccaaggacgccggccagaucagcggccugaacgugcugagagugaucaacgagcccaccgccgccgcccuggccuacggccuggacaagagcgaggacaaggugaucgccguguacgaccugggcggcggcaccuucgacaucagcauccuggagauccagaagggcguguucgaggugaagagcaccaacggcgacaccuuccugggcggcgaggacuucgaccaggcccugcugagacacaucgugaaggaguucaagagagagaccggcguggaccugaccaaggacaacauggcccugcagagagugagagaggccgccgagaaggccaagugcgagcugagcagcagcgugcagaccgacaucaaccugcccuaccugaccauggacagcagcggccccaagcaccugaacaugaagcugaccagagcccaguucgagggcaucgugaccgaccugaucagaagaaccaucgcccccugccagaaggccaugcaggacgccgaggugagcaagagcgacaucggcgaggugauccuggugggcggcaugaccagaaugcccaaggugcagcagaccgugcaggaccuguucggcagagcccccagcaaggccgugaaccccgacgaggccguggccaucggcgccgccauccagggcggcgugcuggccggcgacgugaccgacgugcugcugcuggacgugaccccccugagccugggcaucgagacccugggcggcguguucaccaagcugaucaacagaaacaccaccauccccaccaagaagagccagguguucagcaccgccgccgacggccagacccagguggagaucaaggugugccagggcgagagagagauggccggcgacaacaagcugcugggccaguucacccugaucggcaucccccccgcccccagaggcgugccccagaucgaggugaccuucgacaucgacgccaacggcaucgugcacgugagcgccaaggacaagggcaccggcagagagcagcagaucgugauccagagcagcggcggccugagcaaggacgacaucgagaacauggugaagaacgccgagaaguacgccgaggaggacagaagaaagaaggagagaguggaggccgugaacauggccgagggcaucauccacgacaccgagaccaagauggaggaguucaaggaccagcugcccgccgacgagugcaacaagcugaaggaggagaucagcaagaugagagagcugcuggccagaaaggacagcgagaccggcgagaacaucagacaggccgccagcagccugcagcaggccagccugaagcuguucgagauggccuacaagaagauggccagcgagagagagggcagcggcagcagcggcaccggcgagcagaaggaggaccagaaggaggagaagcagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3024 - RNA, 2410 nt, Artificial Sequence
  mRNA product Design2 comprising derived and/or modified sequence from Homo sapiens__NP_079291.2__HsHSPA12A (opt4)
ggggcgcugccuacggagguggcagccaucuccuucucggcaucaagcuuaccauggccgacaaggaggccggcggcagcgacggccccagagagaccgcccccaccagcgccuacagcagccccgccagaagccugggcgacaccggcaucaccccccugagccccagccacaucgugaacgacaccgacagcaacgugagcgagcagcagagcuuccugguggugguggccguggacuucggcaccaccagcagcggcuacgccuacagcuucaccaaggagcccgagugcauccacgugaugagaagaugggagggcggcgaccccggcgugagcaaccagaagacccccaccaccauccugcugacccccgagagaaaguuccacagcuucggcuacgccgccagagacuucuaccacgaccuggaccccaacgaggccaagcaguggcuguaccuggagaaguucaagaugaagcugcacaccaccggcgaccugaccauggacaccgaccugaccgccgccaacggcaagaaggugaaggcccuggagaucuucgccuacgcccugcaguacuucaaggagcaggcccugaaggagcugagcgaccaggccggcagcgaguucgagaacagcgacgugagaugggugaucaccgugcccgccaucuggaagcagcccgccaagcaguucaugagacaggccgccuaccaggccggccuggccagccccgagaacagcgagcagcugaucaucgcccuggagcccgaggccgccagcaucuacugcagaaagcugagacugcaccagaugaucgagcugagcagcaaggccgccgugaacggcuacagcggcagcgacaccgugggcgccggcuucacccaggccaaggagcacaucagaagaaacagacagagcagaaccuuccugguggagaacgugaucggcgagaucuggagcgagcuggaggagggcgacaaguacguggugguggacagcggcggcggcaccguggaccugaccgugcaccagaucagacugcccgagggccaccugaaggagcuguacaaggccaccggcggccccuacggcagccugggcguggacuacgaguucgagaagcugcuguacaagaucuucggcgaggacuucaucgagcaguucaagaucaagagacccgccgccuggguggaccugaugaucgccuucgagagcagaaagagagccgccgcccccgacagaaccaacccccugaacaucacccugcccuucagcuucaucgacuacuacaagaaguucagaggccacagcguggagcacgcccugagaaagagcaacguggacuucgugaaguggagcagccagggcaugcugagaaugagccccgacgccaugaacgcccuguucaagcccaccaucgacagcaucaucgagcaccugagagaccuguuccagaagcccgaggugagcaccgugaaguuccuguuccuggugggcggcuucgccgaggccccccugcugcagcaggccgugcaggccgccuucggcgaccagugcagaaucaucaucccccaggacgugggccugaccauccugaagggcgccgugcuguucggccuggaccccgccgugaucaaggugagaagaagcccccugaccuacggcgugggcgugcugaacagauacguggagggcaagcacccccccgagaagcugcuggugaaggacggcaccagauggugcaccgacguguucgacaaguucaucagcgccgaccagagcguggcccugggcgagcuggugaagagaagcuacacccccgccaagcccagccagcuggugaucgugaucaacaucuacagcagcgagcacgacaacgugagcuucaucaccgaccccggcgugaagaagugcggcacccugagacuggaccugaccggcaccagcggcaccgccgugcccgccagaagagagauccagacccugaugcaguucggcgacaccgagaucaaggccaccgccaucgacaucgccaccagcaagagcgugaaggugggcaucgacuuccugaacuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3025 - RNA, 2443 nt, Artificial Sequence
  mRNA product Design2 comprising derived and/or modified sequence from Homo sapiens__NP_443202.3 __HsHSPA12B (opt4)
ggggcgcugccuacggagguggcagccaucuccuucucggcaucaagcuuaccaugcuggccgugcccgagaugggccugcagggccuguacaucggcagcagccccgagagaagccccgugcccagcccccccggcagccccagaacccaggagagcugcggcaucgccccccugacccccagccagagccccaagcccgaggugagagccccccagcaggccagcuucagcguggugguggccaucgacuucggcaccaccagcagcggcuacgccuucagcuucgccagcgaccccgaggccauccacaugaugagaaagugggagggcggcgaccccggcguggcccaccagaagacccccaccugccugcugcugacccccgagggcgccuuccacagcuucggcuacaccgccagagacuacuaccacgaccuggaccccgaggaggccagagacuggcuguacuucgagaaguucaagaugaagauccacagcgccaccgaccugacccugaagacccagcuggaggccgugaacggcaagaccaugcccgcccuggagguguucgcccacgcccugagauucuucagagagcacgcccugcaggagcugagagagcagagccccagccugcccgagaaggacaccgugagaugggugcugaccgugcccgccaucuggaagcagcccgccaagcaguucaugagagaggccgccuaccuggccggccuggugagcagagagaacgccgagcagcugcugaucgcccuggagcccgaggccgccagcguguacugcagaaagcugagacugcaccagcugcuggaccugagcggcagagcccccggcggcggcagacugggcgagagaagaagcaucgacagcagcuucagacaggccagagagcagcugagaagaagcagacacagcagaaccuuccugguggagagcggcgugggcgagcugugggccgagaugcaggccggcgacagauacgugguggccgacugcggcggcggcaccguggaccugaccgugcaccagcuggagcagccccacggcacccugaaggagcuguacaaggccagcggcggccccuacggcgccgugggcguggaccuggccuucgagcagcugcugugcagaaucuucggcgaggacuucaucgccaccuucaagagacagagacccgccgccuggguggaccugaccaucgccuucgaggccagaaagagaaccgccggcccccacagagccggcgcccugaacaucagccugcccuucagcuucaucgacuucuacagaaagcagagaggccacaacguggagaccgcccugagaagaagcagcgugaacuucgugaaguggagcagccagggcaugcugagaaugagcugcgaggccaugaacgagcuguuccagcccaccgugagcggcaucauccagcacaucgaggcccugcuggccagacccgaggugcagggcgugaagcugcuguuccuggugggcggcuucgccgagagcgccgugcugcagcacgccgugcaggccgcccugggcgccagaggccugagagugguggugccccacgacgugggccugaccauccugaagggcgccgugcuguucggccaggcccccggcguggugagagugagaagaagcccccugaccuacggcgugggcgugcugaacagauucgugcccggcagacacccccccgagaagcugcuggugagagacggcagaagauggugcaccgacguguucgagagauucguggccgccgagcagagcguggcccugggcgaggaggugagaagaagcuacugccccgccagacccggccagagaagagugcugaucaaccuguacugcugcgccgccgaggacgccagauucaucaccgaccccggcgugagaaagugcggcgcccugagccuggagcuggagcccgccgacugcggccaggacaccgccggcgccccccccggcagaagagagaucagagccgccaugcaguucggcgacaccgagaucaaggugaccgccguggacgugagcaccaacagaagcgugagagccagcaucgacuuccugagcaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3026 - RNA, 1798 nt, Artificial Sequence
  mRNA product Design2 comprising derived and/or modified sequence from Homo sapiens__NP_008879.3__HsHSPA13 (opt4)
ggggcgcugccuacggagguggcagccaucuccuucucggcaucaagcuuaccauggccagagagaugaccauccugggcagcgccgugcugacccugcugcuggccggcuaccuggcccagcaguaccugccccugcccacccccaaggugaucggcaucgaccugggcaccaccuacugcagcgugggcguguucuuccccggcaccggcaaggugaaggugauccccgacgagaacggccacaucagcauccccagcauggugagcuucaccgacaacgacguguacgugggcuacgagagcguggagcuggccgacagcaacccccagaacaccaucuacgacgccaagagauucaucggcaagaucuucaccgccgaggagcuggaggccgagaucggcagauaccccuucaaggugcugaacaagaacggcaugguggaguucagcgugaccagcaacgagaccaucaccgugagccccgaguacgugggcagcagacugcugcugaagcugaaggagauggccgaggccuaccugggcaugcccguggccaacgccgugaucagcgugcccgccgaguucgaccugaagcagagaaacagcaccaucgaggccgccaaccuggccggccugaagauccugagagugaucaacgagcccaccgccgccgccauggccuacggccugcacaaggccgacguguuccacgugcuggugaucgaccugggcggcggcacccuggacgugagccugcugaacaagcagggcggcauguuccugaccagagccaugagcggcaacaacaagcugggcggccaggacuucaaccagagacugcugcaguaccuguacaagcagaucuaccagaccuacggcuucgugcccagcagaaaggaggagauccacagacugagacaggccguggagauggugaagcugaaccugacccugcaccagagcgcccagcugagcgugcugcugaccguggaggagcaggacagaaaggagccccacagcagcgacaccgagcugcccaaggacaagcugagcagcgccgacgaccacagagugaacagcggcuucggcagaggccugagcgacaagaagagcggcgagagccaggugcuguucgagaccgagaucagcagaaagcuguucgacacccugaacgaggaccuguuccagaagauccuggugcccauccagcaggugcugaaggagggccaccuggagaagaccgagaucgacgagguggugcuggugggcggcagcaccagaauccccagaaucagacaggugauccaggaguucuucggcaaggaccccaacaccagcguggaccccgaccuggccguggugaccggcguggccauccaggccggcaucgacggcggcagcuggccccugcaggugagcgcccuggagauccccaacaagcaccugcagaagaccaacuucaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3027 - RNA, 1912 nt, Artificial Sequence
  mRNA product Design2 comprising derived and/or modified sequence from Homo sapiens__NP_057383.2__HsHSPA14 (opt4)
ggggcgcugccuacggagguggcagccaucuccuucucggcaucaagcuuaccauggccgccaucggcgugcaccugggcugcaccagcgccugcguggccguguacaaggacggcagagccggcgugguggccaacgacgccggcgacagagugacccccgccgugguggccuacagcgagaacgaggagaucgugggccuggccgccaagcagagcagaaucagaaacaucagcaacaccgugaugaaggugaagcagauccugggcagaagcagcagcgacccccaggcccagaaguacaucgccgagagcaagugccuggugaucgagaagaacggcaagcugagauacgagaucgacaccggcgaggagaccaaguucgugaaccccgaggacguggccagacugaucuucagcaagaugaaggagaccgcccacagcgugcugggcagcgacgccaacgacguggugaucaccgugcccuucgacuucggcgagaagcagaagaacgcccugggcgaggccgccagagccgccggcuucaacgugcugagacugauccacgagcccagcgccgcccugcuggccuacggcaucggccaggacagccccaccggcaagagcaacauccugguguucaagcugggcggcaccagccugagccugagcgugauggaggugaacagcggcaucuacagagugcugagcaccaacaccgacgacaacaucggcggcgcccacuucaccgagacccuggcccaguaccuggccagcgaguuccagagaagcuucaagcacgacgugagaggcaacgccagagccaugaugaagcugaccaacagcgccgagguggccaagcacagccugagcacccugggcagcgccaacugcuuccuggacagccuguacgagggccaggacuucgacugcaacgugagcagagccagauucgagcugcugugcagcccccuguucaacaagugcaucgaggccaucagaggccugcuggaccagaacggcuucaccgccgacgacaucaacaagguggugcugugcggcggcagcagcagaauccccaagcugcagcagcugaucaaggaccuguuccccgccguggagcugcugaacagcaucccccccgacgaggugauccccaucggcgccgccaucgaggccggcauccugaucggcaaggagaaccugcugguggaggacagccugaugaucgagugcagcgccagagacauccuggugaagggcguggacgagagcggcgccagcagauucaccgugcuguuccccagcggcaccccccugcccgccagaagacagcacacccugcaggcccccggcagcaucagcagcgugugccuggagcuguacgagagcgacggcaagaacagcgccaaggaggagaccaaguucgcccagguggugcugcaggaccuggacaagaaggagaacggccugagagacauccuggccgugcugaccaugaagagagacggcagccugcacgugaccugcaccgaccaggagaccggcaagugcgaggccaucagcaucgagaucgccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3028 - RNA, 2959 nt, Artificial Sequence
  mRNA product Design2 comprising derived and/or modified sequence from Homo sapiens__NP_006635.2 __HsHSPH1 (opt4)
ggggcgcugccuacggagguggcagccaucuccuucucggcaucaagcuuaccaugagcguggugggccuggacgugggcagccagagcugcuacaucgccguggccagagccggcggcaucgagaccaucgccaacgaguucagcgacagaugcacccccagcgugaucagcuucggcagcaagaacagaaccaucggcguggccgccaagaaccagcagaucacccacgccaacaacaccgugagcaacuucaagagauuccacggcagagccuucaacgaccccuucauccagaaggagaaggagaaccugagcuacgaccuggugccccugaagaacggcggcgugggcaucaaggugauguacaugggcgaggagcaccuguucagcguggagcagaucaccgccaugcugcugaccaagcugaaggagaccgccgagaacagccugaagaagcccgugaccgacugcgugaucagcgugcccagcuucuucaccgacgccgagagaagaagcgugcuggacgccgcccagaucgugggccugaacugccugagacugaugaacgacaugaccgccguggcccugaacuacggcaucuacaagcaggaccugcccagccuggacgagaagcccagaaucgugguguucguggacaugggccacagcgccuuccaggugagcgccugcgccuucaacaagggcaagcugaaggugcugggcaccgccuucgaccccuuccugggcggcaagaacuucgacgagaagcugguggagcacuucugcgccgaguucaagaccaaguacaagcuggacgccaagagcaagaucagagcccugcugagacuguaccaggagugcgagaagcugaagaagcugaugagcagcaacagcaccgaccugccccugaacaucgagugcuucaugaacgacaaggacgugagcggcaagaugaacagaagccaguucgaggagcugugcgccgagcugcugcagaagaucgaggugccccuguacagccugcuggagcagacccaccugaagguggaggacgugagcgccguggagaucgugggcggcgccaccagaauccccgccgugaaggagagaaucgccaaguucuucggcaaggacaucagcaccacccugaacgccgacgaggccguggccagaggcugcgcccugcagugcgccauccugagccccgccuucaaggugagagaguucagcgugaccgacgccgugcccuuccccaucagccugaucuggaaccacgacagcgaggacaccgagggcgugcacgagguguucagcagaaaccacgccgcccccuucagcaaggugcugaccuuccugagaagaggccccuucgagcuggaggccuucuacagcgacccccagggcgugcccuaccccgaggccaagaucggcagauucguggugcagaacgugagcgcccagaaggacggcgagaagagcagagugaaggugaaggugagagugaacacccacggcaucuucaccaucagcaccgccagcaugguggagaaggugcccaccgaggagaacgagaugagcagcgaggccgacauggagugccugaaccagagaccccccgagaaccccgacaccgacaagaacgugcagcaggacaacagcgaggccggcacccagccccaggugcagaccgacgcccagcagaccagccagagcccccccagccccgagcugaccagcgaggagaacaagauccccgacgccgacaaggccaacgagaagaagguggaccagccccccgaggccaagaagcccaagaucaagguggugaacguggagcugcccaucgaggccaaccugguguggcagcugggcaaggaccugcugaacauguacaucgagaccgagggcaagaugaucaugcaggacaagcuggagaaggagagaaacgacgccaagaacgccguggaggaguacguguacgaguucagagacaagcugugcggccccuacgagaaguucaucugcgagcaggaccaccagaacuuccugagacugcugaccgagaccgaggacuggcuguacgaggagggcgaggaccaggccaagcaggccuacguggacaagcuggaggagcugaugaagaucggcacccccgugaaggugagauuccaggaggccgaggagagacccaagauguucgaggagcugggccagagacugcagcacuacgccaagaucgccgccgacuucagaaacaaggacgagaaguacaaccacaucgacgagagcgagaugaagaagguggagaagagcgugaacgaggugauggaguggaugaacaacgugaugaacgcccaggccaagaagagccuggaccaggaccccguggugagagcccaggagaucaagaccaagaucaaggagcugaacaacaccugcgagcccguggugacccagcccaagcccaagaucgagagccccaagcuggagagaacccccaacggccccaacaucgacaagaaggaggaggaccuggaggacaagaacaacuucggcgccgagcccccccaccagaacggcgagugcuaccccaacgagaagaacagcgugaacauggaccuggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3029 - RNA, 3382 nt, Artificial Sequence
  mRNA product Design2 comprising derived and/or modified sequence from Homo sapiens__NP_006380.1 __HsHYOU1 (opt4)
ggggcgcugccuacggagguggcagccaucuccuucucggcaucaagcuuaccauggccgacaaggugagaagacagagacccagaagaagagugugcugggcccugguggccgugcugcuggccgaccugcuggcccugagcgacacccuggccgugaugagcguggaccugggcagcgagagcaugaagguggccaucgugaagcccggcgugcccauggagaucgugcugaacaaggagagcagaagaaagacccccgugaucgugacccugaaggagaacgagagauucuucggcgacagcgccgccagcauggccaucaagaaccccaaggccacccugagauacuuccagcaccugcugggcaagcaggccgacaacccccacguggcccuguaccaggccagauuccccgagcacgagcugaccuucgacccccagagacagaccgugcacuuccagaucagcagccagcugcaguucagccccgaggaggugcugggcauggugcugaacuacagcagaagccuggccgaggacuucgccgagcagcccaucaaggacgccgugaucaccgugcccguguucuucaaccaggccgagagaagagccgugcugcaggccgccagaauggccggccugaaggugcugcagcugaucaacgacaacaccgccaccgcccugagcuacggcguguucagaagaaaggacaucaacaccaccgcccagaacaucauguucuacgacaugggcagcggcagcaccgugugcaccaucgugaccuaccagauggugaagaccaaggaggccggcaugcagccccagcugcagaucagaggcgugggcuucgacagaacccugggcggccuggagauggagcugagacugagagagagacuggccggccuguucaacgagcagagaaagggccagagagccaaggacgugagagagaaccccagagccauggccaagcugcugagagaggccaacagacugaagaccgugcugagcgccaacgccgaccacauggcccagaucgagggccugauggacgacguggacuucaaggccaaggugaccagaguggaguucgaggagcugugcgccgaccuguucgagagagugcccggccccgugcagcaggcccugcagagcgccgagaugagccuggacgagaucgagcaggugauccuggugggcggcgccaccagagugcccagagugcaggaggugcugcugaaggccgugggcaaggaggagcugggcaagaacaucaacgccgacgaggccgccgccaugggcgccguguaccaggccgccgcccugagcaaggccuucaaggugaagcccuucguggugagagacgccgugguguaccccauccugguggaguucaccagagagguggaggaggagcccggcauccacagccugaagcacaacaagagagugcuguucagcagaaugggccccuacccccagagaaaggugaucaccuucaacagauacagccacgacuucaacuuccacaucaacuacggcgaccugggcuuccugggccccgaggaccugagaguguucggcagccagaaccugaccaccgugaagcugaagggcgugggcgacagcuucaagaaguaccccgacuacgagagcaagggcaucaaggcccacuucaaccuggacgagagcggcgugcugagccuggacagaguggagagcguguucgagacccugguggaggacagcgccgaggaggagagcacccugaccaagcugggcaacaccaucagcagccuguucggcggcggcaccacccccgacgccaaggagaacggcaccgacaccgugcaggaggaggaggagagccccgccgagggcagcaaggacgagcccggcgagcagguggagcugaaggaggaggccgaggcccccguggaggacggcagccagccccccccccccgagcccaagggcgacgccacccccgagggcgagaaggccaccgagaaggagaacggcgacaagagcgaggcccagaagcccagcgagaaggccgaggccggccccgagggcguggcccccgcccccgagggcgagaagaagcagaagcccgccagaaagagaagaaugguggaggagaucggcguggagcugguggugcuggaccugcccgaccugcccgaggacaagcuggcccagagcgugcagaagcugcaggaccugacccugagagaccuggagaagcaggagagagagaaggccgccaacagccuggaggccuucaucuucgagacccaggacaagcuguaccagcccgaguaccaggaggugagcaccgaggagcagagagaggagaucagcggcaagcugagcgccgccagcaccuggcuggaggacgagggcgugggcgccaccaccgugaugcugaaggagaagcuggccgagcugagaaagcugugccagggccuguucuucagaguggaggagagaaagaaguggcccgagagacugagcgcccuggacaaccugcugaaccacagcagcauguuccugaagggcgccagacugauccccgagauggaccagaucuucaccgagguggagaugaccacccuggagaaggugaucaacgagaccugggccuggaagaacgccacccuggccgagcaggccaagcugcccgccaccgagaagcccgugcugcugagcaaggacaucgaggccaagaugauggcccuggacagagaggugcaguaccugcugaacaaggccaaguucaccaagcccagacccagacccaaggacaagaacggcaccagagccgagcccccccugaacgccagcgccagcgaccagggcgagaaggugaucccccccgccggccagaccgaggacgccgagcccaucagcgagcccgagaagguggagaccggcagcgagcccggcgacaccgagccccuggagcugggcggccccggcgccgagcccgagcagaaggagcagagcaccggccagaagagaccccugaagaacgacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3030 - RNA, 2581 nt, Artificial Sequence
  mRNA product Design2 comprising derived and/or modified sequence from Homo sapiens__NP_005339.3 __HsHSP90AA1 (opt4)
ggggcgcugccuacggagguggcagccaucuccuucucggcaucaagcuuaccaugcccgaggagacccagacccaggaccagcccauggaggaggaggagguggagaccuucgccuuccaggccgagaucgcccagcugaugagccugaucaucaacaccuucuacagcaacaaggagaucuuccugagagagcugaucagcaacagcagcgacgcccuggacaagaucagauacgagagccugaccgaccccagcaagcuggacagcggcaaggagcugcacaucaaccugauccccaacaagcaggacagaacccugaccaucguggacaccggcaucggcaugaccaaggccgaccugaucaacaaccugggcaccaucgccaagagcggcaccaaggccuucauggaggcccugcaggccggcgccgacaucagcaugaucggccaguucggcgugggcuucuacagcgccuaccugguggccgagaaggugaccgugaucaccaagcacaacgacgacgagcaguacgccugggagagcagcgccggcggcagcuucaccgugagaaccgacaccggcgagcccaugggcagaggcaccaaggugauccugcaccugaaggaggaccagaccgaguaccuggaggagagaagaaucaaggagaucgugaagaagcacagccaguucaucggcuaccccaucacccuguucguggagaaggagagagacaaggaggugagcgacgacgaggccgaggagaaggaggacaaggaggaggagaaggagaaggaggagaaggagagcgaggacaagcccgagaucgaggacgugggcagcgacgaggaggaggagaagaaggacggcgacaagaagaagaagaagaagaucaaggagaaguacaucgaccaggaggagcugaacaagaccaagcccaucuggaccagaaaccccgacgacaucaccaacgaggaguacggcgaguucuacaagagccugaccaacgacugggaggaccaccuggccgugaagcacuucagcguggagggccagcuggaguucagagcccugcuguucgugcccagaagagcccccuucgaccuguucgagaacagaaagaagaagaacaacaucaagcuguacgugagaagaguguucaucauggacaacugcgaggagcugauccccgaguaccugaacuucaucagaggcgugguggacagcgaggaccugccccugaacaucagcagagagaugcugcagcagagcaagauccugaaggugaucagaaagaaccuggugaagaagugccuggagcuguucaccgagcuggccgaggacaaggagaacuacaagaaguucuacgagcaguucagcaagaacaucaagcugggcauccacgaggacagccagaacagaaagaagcugagcgagcugcugagauacuacaccagcgccagcggcgacgagauggugagccugaaggacuacugcaccagaaugaaggagaaccagaagcacaucuacuacaucaccggcgagaccaaggaccagguggccaacagcgccuucguggagagacugagaaagcacggccuggaggugaucuacaugaucgagcccaucgacgaguacugcgugcagcagcugaaggaguucgagggcaagacccuggugagcgugaccaaggagggccuggagcugcccgaggacgaggaggagaagaagaagcaggaggagaagaagaccaaguucgagaaccugugcaagaucaugaaggacauccuggagaagaagguggagaaggugguggugagcaacagacuggugaccagccccugcugcaucgugaccagcaccuacggcuggaccgccaacauggagagaaucaugaaggcccaggcccugagagacaacagcaccaugggcuacauggccgccaagaagcaccuggagaucaaccccgaccacagcaucaucgagacccugagacagaaggccgaggccgacaagaacgacaagagcgugaaggaccuggugauccugcuguacgagaccgcccugcugagcagcggcuucagccuggaggacccccagacccacgccaacagaaucuacagaaugaucaagcugggccugggcaucgacgaggacgaccccaccgccgacgacaccagcgccgccgugaccgaggagaugcccccccuggagggcgacgacgacaccagcagaauggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3031 - RNA, 721 nt, Artificial Sequence
  mRNA product Design2 comprising derived and/or modified sequence from Homo sapiens__NG_005218__HsHSP90AA3P (opt4)
ggggcgcugccuacggagguggcagccaucuccuucucggcaucaagcuuaccauggacagcagcaagcuggacagcggcaagggccugcacaucaaccuggugcccaacaagcagaaccagacccugaccaucguggacaccagaaucggcaugaccaagaccgaccugaucaacaaccugggcaccgugaccaagagcggcaccaaggccuucauggaggcccugcaggccgacgccgacaucagcaugaucggccacuucggcgugggcuucuacagcgccuaccugguggccaagaaggugaccgugaucagcaagcacaacaacgacgagcaguacaccugggagagcagcgccggcggcagcuucaccgugagaaccgacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3032 - RNA, 2557 nt, Artificial Sequence
  mRNA product Design2 comprising derived and/or modified sequence from Homo sapiens__NP_031381.2__HsHSP90AB1 (opt4)
ggggcgcugccuacggagguggcagccaucuccuucucggcaucaagcuuaccaugcccgaggaggugcaccacggcgaggaggagguggagaccuucgccuuccaggccgagaucgcccagcugaugagccugaucaucaacaccuucuacagcaacaaggagaucuuccugagagagcugaucagcaacgccagcgacgcccuggacaagaucagauacgagagccugaccgaccccagcaagcuggacagcggcaaggagcugaagaucgacaucauccccaacccccaggagagaacccugacccugguggacaccggcaucggcaugaccaaggccgaccugaucaacaaccugggcaccaucgccaagagcggcaccaaggccuucauggaggcccugcaggccggcgccgacaucagcaugaucggccaguucggcgugggcuucuacagcgccuaccugguggccgagaaggugguggugaucaccaagcacaacgacgacgagcaguacgccugggagagcagcgccggcggcagcuucaccgugagagccgaccacggcgagcccaucggcagaggcaccaaggugauccugcaccugaaggaggaccagaccgaguaccuggaggagagaagagugaaggagguggugaagaagcacagccaguucaucggcuaccccaucacccuguaccuggagaaggagagagagaaggagaucagcgacgacgaggccgaggaggagaagggcgagaaggaggaggaggacaaggacgacgaggagaagcccaagaucgaggacgugggcagcgacgaggaggacgacagcggcaaggacaagaagaagaagaccaagaagaucaaggagaaguacaucgaccaggaggagcugaacaagaccaagcccaucuggaccagaaaccccgacgacaucacccaggaggaguacggcgaguucuacaagagccugaccaacgacugggaggaccaccuggccgugaagcacuucagcguggagggccagcuggaguucagagcccugcuguucauccccagaagagcccccuucgaccuguucgagaacaagaagaagaagaacaacaucaagcuguacgugagaagaguguucaucauggacagcugcgacgagcugauccccgaguaccugaacuucaucagaggcgugguggacagcgaggaccugccccugaacaucagcagagagaugcugcagcagagcaagauccugaaggugaucagaaagaacaucgugaagaagugccuggagcuguucagcgagcuggccgaggacaaggagaacuacaagaaguucuacgaggccuucagcaagaaccugaagcugggcauccacgaggacagcaccaacagaagaagacugagcgagcugcugagauaccacaccagccagagcggcgacgagaugaccagccugagcgaguacgugagcagaaugaaggagacccagaagagcaucuacuacaucaccggcgagagcaaggagcagguggccaacagcgccuucguggagagagugagaaagagaggcuucgaggugguguacaugaccgagcccaucgacgaguacugcgugcagcagcugaaggaguucgacggcaagagccuggugagcgugaccaaggagggccuggagcugcccgaggacgaggaggagaagaagaagauggaggagagcaaggccaaguucgagaaccugugcaagcugaugaaggagauccuggacaagaagguggagaaggugaccaucagcaacagacuggugagcagccccugcugcaucgugaccagcaccuacggcuggaccgccaacauggagagaaucaugaaggcccaggcccugagagacaacagcaccaugggcuacaugauggccaagaagcaccuggagaucaaccccgaccaccccaucguggagacccugagacagaaggccgaggccgacaagaacgacaaggccgugaaggaccugguggugcugcuguucgagaccgcccugcugagcagcggcuucagccuggaggacccccagacccacagcaacagaaucuacagaaugaucaagcugggccugggcaucgacgaggacgagguggccgccgaggagcccaacgccgccgugcccgacgagauccccccccuggagggcgacgaggacgccagcagaauggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3033 - RNA, 2794 nt, Artificial Sequence
  mRNA product Design2 comprising derived and/or modified sequence from Homo sapiens__NP_003290.1__HsHSP90B1 (opt4)
ggggcgcugccuacggagguggcagccaucuccuucucggcaucaagcuuaccaugagagcccugugggugcugggccugugcugcgugcugcugaccuucggcagcgugagagccgacgacgagguggacguggacggcaccguggaggaggaccugggcaagagcagagagggcagcagaaccgacgacgagguggugcagagagaggaggaggccauccagcuggacggccugaacgccagccagaucagagagcugagagagaagagcgagaaguucgccuuccaggccgaggugaacagaaugaugaagcugaucaucaacagccuguacaagaacaaggagaucuuccugagagagcugaucagcaacgccagcgacgcccuggacaagaucagacugaucagccugaccgacgagaacgcccugagcggcaacgaggagcugaccgugaagaucaagugcgacaaggagaagaaccugcugcacgugaccgacaccggcgugggcaugaccagagaggagcuggugaagaaccugggcaccaucgccaagagcggcaccagcgaguuccugaacaagaugaccgaggcccaggaggacggccagagcaccagcgagcugaucggccaguucggcgugggcuucuacagcgccuuccugguggccgacaaggugaucgugaccagcaagcacaacaacgacacccagcacaucugggagagcgacagcaacgaguucagcgugaucgccgaccccagaggcaacacccugggcagaggcaccaccaucacccuggugcugaaggaggaggccagcgacuaccuggagcuggacaccaucaagaaccuggugaagaaguacagccaguucaucaacuuccccaucuacguguggagcagcaagaccgagaccguggaggagcccauggaggaggaggaggccgccaaggaggagaaggaggagagcgacgacgaggccgccguggaggaggaggaggaggagaagaagcccaagaccaagaagguggagaagaccgugugggacugggagcugaugaacgacaucaagcccaucuggcagagacccagcaaggagguggaggaggacgaguacaaggccuucuacaagagcuucagcaaggagagcgacgaccccauggccuacauccacuucaccgccgagggcgaggugaccuucaagagcauccuguucgugcccaccagcgcccccagaggccuguucgacgaguacggcagcaagaagagcgacuacaucaagcuguacgugagaagaguguucaucaccgacgacuuccacgacaugaugcccaaguaccugaacuucgugaagggcgugguggacagcgacgaccugccccugaacgugagcagagagacccugcagcagcacaagcugcugaaggugaucagaaagaagcuggugagaaagacccuggacaugaucaagaagaucgccgacgacaaguacaacgacaccuucuggaaggaguucggcaccaacaucaagcugggcgugaucgaggaccacagcaacagaaccagacuggccaagcugcugagauuccagagcagccaccaccccaccgacaucaccagccuggaccaguacguggagagaaugaaggagaagcaggacaagaucuacuucauggccggcagcagcagaaaggaggccgagagcagccccuucguggagagacugcugaagaagggcuacgaggugaucuaccugaccgagcccguggacgaguacugcauccaggcccugcccgaguucgacggcaagagauuccagaacguggccaaggagggcgugaaguucgacgagagcgagaagaccaaggagagcagagaggccguggagaaggaguucgagccccugcugaacuggaugaaggacaaggcccugaaggacaagaucgagaaggccguggugagccagagacugaccgagagccccugcgcccugguggccagccaguacggcuggagcggcaacauggagagaaucaugaaggcccaggccuaccagaccggcaaggacaucagcaccaacuacuacgccagccagaagaagaccuucgagaucaaccccagacacccccugaucagagacaugcugagaagaaucaaggaggacgaggacgacaagaccgugcuggaccuggccguggugcuguucgagaccgccacccugagaagcggcuaccugcugcccgacaccaaggccuacggcgacagaaucgagagaaugcugagacugagccugaacaucgaccccgacgccaagguggaggaggagcccgaggaggagcccgaggagaccgccgaggacaccaccgaggacaccgagcaggacgaggacgaggagauggacgugggcaccgacgaggaggaggagaccgccaaggagagcaccgccgagaaggacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3034 - RNA, 2497 nt, Artificial Sequence
  mRNA product Design2 comprising derived and/or modified sequence from Homo sapiens__NP_057376.2__HsTRAP1 (opt4)
ggggcgcugccuacggagguggcagccaucuccuucucggcaucaagcuuaccauggccagagagcugagagcccugcugcuguggggcagaagacugagaccccugcugagagcccccgcccuggccgccgugcccggcggcaagcccauccugugccccagaagaaccaccgcccagcugggccccagaagaaaccccgccuggagccugcaggccggcagacuguucagcacccagaccgccgaggacaaggaggagccccugcacagcaucaucagcagcaccgagagcgugcagggcagcaccagcaagcacgaguuccaggccgagaccaagaagcugcuggacaucguggccagaagccuguacagcgagaaggagguguucaucagagagcugaucagcaacgccagcgacgcccuggagaagcugagacacaagcuggugagcgacggccaggcccugcccgagauggagauccaccugcagaccaacgccgagaagggcaccaucaccauccaggacaccggcaucggcaugacccaggaggagcuggugagcaaccugggcaccaucgccagaagcggcagcaaggccuuccuggacgcccugcagaaccaggccgaggccagcagcaagaucaucggccaguucggcgugggcuucuacagcgccuucaugguggccgacagaguggagguguacagcagaagcgccgcccccggcagccugggcuaccaguggcugagcgacggcagcggcguguucgagaucgccgaggccagcggcgugagaaccggcaccaagaucaucauccaccugaagagcgacugcaaggaguucagcagcgaggccagagugagagacguggugaccaaguacagcaacuucgugagcuucccccuguaccugaacggcagaagaaugaacacccugcaggccaucuggaugauggaccccaaggacgugagagaguggcagcacgaggaguucuacagauacguggcccaggcccacgacaagcccagauacacccugcacuacaagaccgacgccccccugaacaucagaagcaucuucuacgugcccgacaugaagcccagcauguucgacgugagcagagagcugggcagcagcguggcccuguacagcagaaaggugcugauccagaccaaggccaccgacauccugcccaaguggcugagauucaucagaggcgugguggacagcgaggacaucccccugaaccugagcagagagcugcugcaggagagcgcccugaucagaaagcugagagacgugcugcagcagagacugaucaaguucuucaucgaccagagcaagaaggacgccgagaaguacgccaaguucuucgaggacuacggccuguucaugagagagggcaucgugaccgccaccgagcaggaggugaaggaggacaucgccaagcugcugagauacgagagcagcgcccugcccagcggccagcugaccagccugagcgaguacgccagcagaaugagagccggcaccagaaacaucuacuaccugugcgcccccaacagacaccuggccgagcacagccccuacuacgaggccaugaagaagaaggacaccgaggugcuguucugcuucgagcaguucgacgagcugacccugcugcaccugagagaguucgacaagaagaagcugaucagcguggagaccgacaucgugguggaccacuacaaggaggagaaguucgaggacagaagccccgccgccgagugccugagcgagaaggagaccgaggagcugauggccuggaugagaaacgugcugggcagcagagugaccaacgugaaggugacccugagacuggacacccaccccgccauggugaccgugcuggagaugggcgccgccagacacuuccugagaaugcagcagcuggccaagacccaggaggagagagcccagcugcugcagcccacccuggagaucaaccccagacacgcccugaucaagaagcugaaccagcugagagccagcgagcccggccuggcccagcugcugguggaccagaucuacgagaacgccaugaucgccgccggccugguggacgaccccagagccauggugggcagacugaacgagcugcuggugaaggcccuggagagacacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3035 - RNA, 844 nt, Artificial Sequence
  mRNA product Design2 comprising derived and/or modified sequence from Homo sapiens__NP_000609.1__HsIGF1 (opt4)
ggggcgcugccuacggagguggcagccaucuccuucucggcaucaagcuuaccaugggcaagaucagcagccugcccacccagcuguucaagugcugcuucugcgacuuccugaaggugaagaugcacaccaugagcagcagccaccuguucuaccuggcccugugccugcugaccuucaccagcagcgccaccgccggccccgagacccugugcggcgccgagcugguggacgcccugcaguucgugugcggcgacagaggcuucuacuucaacaagcccaccggcuacggcagcagcagcagaagagccccccagaccggcaucguggacgagugcugcuucagaagcugcgaccugagaagacuggagauguacugcgccccccugaagcccgccaagagcgccagaagcgugagagcccagagacacaccgacaugcccaagacccagaaggaggugcaccugaagaacgccagcagaggcagcgccggcaacaagaacuacagaaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3036 - RNA, 925 nt, Artificial Sequence
  mRNA product Design2 comprising derived and/or modified sequence from Homo sapiens__NP_000603.1__HsIGF2 (opt4)
ggggcgcugccuacggagguggcagccaucuccuucucggcaucaagcuuaccaugggcauccccaugggcaagagcaugcuggugcugcugaccuuccuggccuucgccagcugcugcaucgccgccuacagacccagcgagacccugugcggcggcgagcugguggacacccugcaguucgugugcggcgacagaggcuucuacuucagcagacccgccagcagagugagcagaagaagcagaggcaucguggaggagugcugcuucagaagcugcgaccuggcccugcuggagaccuacugcgccacccccgccaagagcgagagagacgugagcaccccccccaccgugcugcccgacaacuuccccagauaccccgugggcaaguucuuccaguacgacaccuggaagcagagcacccagagacugagaagaggccugcccgcccugcugagagccagaagaggccacgugcuggccaaggagcuggaggccuucagagaggccaagagacacagaccccugaucgcccugcccacccaggaccccgcccacggcggcgccccccccgagauggccagcaacagaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3037 - RNA, 1021 nt, Artificial Sequence
  mRNA product Design2 comprising derived and/or modified sequence from Homo sapiens__NP_000591.1__HsIL6 (opt4)
ggggcgcugccuacggagguggcagccaucuccuucucggcaucaagcuuaccaugaacagcuucagcaccagcgccuucggccccguggccuucagccugggccugcugcuggugcugcccgccgccuuccccgcccccgugccccccggcgaggacagcaaggacguggccgccccccacagacagccccugaccagcagcgagagaaucgacaagcagaucagauacauccuggacggcaucagcgcccugagaaaggagaccugcaacaagagcaacaugugcgagagcagcaaggaggcccuggccgagaacaaccugaaccugcccaagauggccgagaaggacggcugcuuccagagcggcuucaacgaggagaccugccuggugaagaucaucaccggccugcuggaguucgagguguaccuggaguaccugcagaacagauucgagagcagcgaggagcaggccagagccgugcagaugagcaccaaggugcugauccaguuccugcagaagaaggccaagaaccuggacgccaucaccacccccgaccccaccaccaacgccagccugcugaccaagcugcaggcccagaaccaguggcugcaggacaugaccacccaccugauccugagaagcuucaaggaguuccugcagagcagccugagagcccugagacagaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3038 - RNA, 1663 nt, Artificial Sequence
  mRNA product Design2 comprising derived and/or modified sequence from Homo sapiens__NP_002183.1__HsINHBA (opt4)
ggggcgcugccuacggagguggcagccaucuccuucucggcaucaagcuuaccaugccccugcuguggcugagaggcuuccugcuggccagcugcuggaucaucgugagaagcagccccacccccggcagcgagggccacagcgccgcccccgacugccccagcugcgcccuggccgcccugcccaaggacgugcccaacagccagcccgagaugguggaggccgugaagaagcacauccugaacaugcugcaccugaagaagagacccgacgugacccagcccgugcccaaggccgcccugcugaacgccaucagaaagcugcacgugggcaaggugggcgagaacggcuacguggagaucgaggacgacaucggcagaagagccgagaugaacgagcugauggagcagaccagcgagaucaucaccuucgccgagagcggcaccgccagaaagacccugcacuucgagaucagcaaggagggcagcgaccugagcgugguggagagagccgagguguggcuguuccugaaggugcccaaggccaacagaaccagaaccaaggugaccaucagacuguuccagcagcagaagcacccccagggcagccuggacaccggcgaggaggccgaggaggugggccugaagggcgagagaagcgagcugcugcugagcgagaaggugguggacgccagaaagagcaccuggcacguguuccccgugagcagcagcauccagagacugcuggaccagggcaagagcagccuggacgugagaaucgccugcgagcagugccaggagagcggcgccagccuggugcugcugggcaagaagaagaagaaggaggaggagggcgagggcaagaagaagggcggcggcgagggcggcgccggcgccgacgaggagaaggagcagagccacagacccuuccugaugcugcaggccagacagagcgaggaccacccccacagaagaagaagaagaggccuggagugcgacggcaaggugaacaucugcugcaagaagcaguucuucgugagcuucaaggacaucggcuggaacgacuggaucaucgcccccagcggcuaccacgccaacuacugcgagggcgagugccccagccacaucgccggcaccagcggcagcagccugagcuuccacagcaccgugaucaaccacuacagaaugagaggccacagccccuucgccaaccugaagagcugcugcgugcccaccaagcugagacccaugagcaugcuguacuacgacgacggccagaacaucaucaagaaggacauccagaacaugaucguggaggagugcggcugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3039 - RNA, 1606 nt, Artificial Sequence
  mRNA product Design2 comprising derived and/or modified sequence from Homo sapiens__NP_002184.2__HsINHBB (opt4)
ggggcgcugccuacggagguggcagccaucuccuucucggcaucaagcuuaccauggacggccugcccggcagagcccugggcgccgccugccugcugcugcuggccgccggcuggcugggccccgaggccuggggcagccccacccccccccccacccccgccgcccccccccccccccccccccccggcagccccggcggcagccaggacaccugcaccagcugcggcggcuucagaagacccgaggagcugggcagaguggacggcgacuuccuggaggccgugaagagacacauccugagcagacugcagaugagaggcagacccaacaucacccacgccgugcccaaggccgccauggugaccgcccugagaaagcugcacgccggcaaggugagagaggacggcagaguggagaucccccaccuggacggccacgccagccccggcgccgacggccaggagagagugagcgagaucaucagcuucgccgagaccgacggccuggccagcagcagagugagacuguacuucuucaucagcaacgagggcaaccagaaccuguucguggugcaggccagccuguggcuguaccugaagcugcugcccuacgugcuggagaagggcagcagaagaaaggugagagugaagguguacuuccaggagcagggccacggcgacagauggaacaugguggagaagagaguggaccugaagagaagcggcuggcacaccuucccccugaccgaggccauccaggcccuguucgagagaggcgagagaagacugaaccuggacgugcagugcgacagcugccaggagcuggccguggugcccguguucguggaccccggcgaggagagccacagacccuucgugguggugcaggccagacugggcgacagcagacacagaaucagaaagagaggccuggagugcgacggcagaaccaaccugugcugcagacagcaguucuucaucgacuucagacugaucggcuggaacgacuggaucaucgcccccaccggcuacuacggcaacuacugcgagggcagcugccccgccuaccuggccggcgugcccggcagcgccagcagcuuccacaccgccguggugaaccaguacagaaugagaggccugaaccccggcaccgugaacagcugcugcauccccaccaagcugagcaccaugagcaugcuguacuucgacgacgaguacaacaucgugaagagagacgugcccaacaugaucguggaggagugcggcugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3040 - RNA, 3841 nt, Artificial Sequence
  mRNA product Design2 comprising derived and/or modified sequence from Homo sapiens__NP_000623.2__HsITGAM (opt4)
ggggcgcugccuacggagguggcagccaucuccuucucggcaucaagcuuaccauggcccugagagugcugcugcugaccgcccugacccugugccacggcuucaaccuggacaccgagaacgccaugaccuuccaggagaacgccagaggcuucggccagagcguggugcagcugcagggcagcagagugguggugggcgccccccaggagaucguggccgccaaccagagaggcagccuguaccagugcgacuacagcaccggcagcugcgagcccaucagacugcaggugcccguggaggccgugaacaugagccugggccugagccuggccgccaccaccagccccccccagcugcuggccugcggccccaccgugcaccagaccugcagcgagaacaccuacgugaagggccugugcuuccuguucggcagcaaccugagacagcagccccagaaguuccccgaggcccugagaggcugcccccaggaggacagcgacaucgccuuccugaucgacggcagcggcagcaucaucccccacgacuucagaagaaugaaggaguucgugagcaccgugauggagcagcugaagaagagcaagacccuguucagccugaugcaguacagcgaggaguucagaauccacuucaccuucaaggaguuccagaacaaccccaaccccagaagccuggugaagcccaucacccagcugcugggcagaacccacaccgccaccggcaucagaaagguggugagagagcuguucaacaucaccaacggcgccagaaagaacgccuucaagauccugguggugaucaccgacggcgagaaguucggcgacccccugggcuacgaggacgugauccccgaggccgacagagagggcgugaucagauacgugaucggcgugggcgacgccuucagaagcgagaagagcagacaggagcugaacaccaucgccagcaagccccccagagaccacguguuccaggugaacaacuucgaggcccugaagaccauccagaaccagcugagagagaagaucuucgccaucgagggcacccagaccggcagcagcagcagcuucgagcacgagaugagccaggagggcuucagcgccgccaucaccagcaacggcccccugcugagcaccgugggcagcuacgacugggccggcggcguguuccuguacaccagcaaggagaagagcaccuucaucaacaugaccagaguggacagcgacaugaacgacgccuaccugggcuacgccgccgccaucauccugagaaacagagugcagagccuggugcugggcgcccccagauaccagcacaucggccugguggccauguucagacagaacaccggcaugugggagagcaacgccaacgugaagggcacccagaucggcgccuacuucggcgccagccugugcagcguggacguggacagcaacggcagcaccgaccuggugcugaucggcgccccccacuacuacgagcagaccagaggcggccaggugagcgugugcccccugcccagaggcagagccagauggcagugcgacgccgugcuguacggcgagcagggccagcccuggggcagauucggcgccgcccugaccgugcugggcgacgugaacggcgacaagcugaccgacguggccaucggcgcccccggcgaggaggacaacagaggcgccguguaccuguuccacggcaccagcggcagcggcaucagccccagccacagccagagaaucgccggcagcaagcugagccccagacugcaguacuucggccagagccugagcggcggccaggaccugaccauggacggccugguggaccugaccgugggcgcccagggccacgugcugcugcugagaagccagcccgugcugagagugaaggccaucauggaguucaaccccagagagguggccagaaacguguucgagugcaacgaccagguggugaagggcaaggaggccggcgaggugagagugugccugcacgugcagaagagcaccagagacagacugagagagggccagauccagagcguggugaccuacgaccuggcccuggacagcggcagaccccacagcagagccguguucaacgagaccaagaacagcaccagaagacagacccaggugcugggccugacccagaccugcgagacccugaagcugcagcugcccaacugcaucgaggaccccgugagccccaucgugcugagacugaacuucagccuggugggcaccccccugagcgccuucggcaaccugagacccgugcuggccgaggacgcccagagacuguucaccgcccuguuccccuucgagaagaacugcggcaacgacaacaucugccaggacgaccugagcaucaccuucagcuucaugagccuggacugccugguggugggcggccccagagaguucaacgugaccgugaccgugagaaacgacggcgaggacagcuacagaacccaggugaccuucuucuucccccuggaccugagcuacagaaaggugagcacccugcagaaccagagaagccagagaagcuggagacuggccugcgagagcgccagcagcaccgaggugagcggcgcccugaagagcaccagcugcagcaucaaccaccccaucuuccccgagaacagcgaggugaccuucaacaucaccuucgacguggacagcaaggccagccugggcaacaagcugcugcugaaggccaacgugaccagcgagaacaacaugcccagaaccaacaagaccgaguuccagcuggagcugcccgugaaguacgccguguacaugguggugaccagccacggcgugagcaccaaguaccugaacuucaccgccagcgagaacaccagcagagugaugcagcaccaguaccaggugagcaaccugggccagagaagccugcccaucagccugguguuccuggugcccgugagacugaaccagaccgugaucugggacagaccccaggugaccuucagcgagaaccugagcagcaccugccacaccaaggagagacugcccagccacagcgacuuccuggccgagcugagaaaggcccccguggugaacugcagcaucgccgugugccagagaauccagugcgacauccccuucuucggcauccaggaggaguucaacgccacccugaagggcaaccugagcuucgacugguacaucaagaccagccacaaccaccugcugaucgugagcaccgccgagauccuguucaacgacagcguguucacccugcugcccggccagggcgccuucgugagaagccagaccgagaccaagguggagcccuucgaggugcccaacccccugccccugaucgugggcagcagcgugggcggccugcugcugcuggcccugaucaccgccgcccuguacaagcugggcuucuucaagagacaguacaaggacaugaugagcgagggcggcccccccggcgccgagccccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3041 - RNA, 1786 nt, Artificial Sequence
  mRNA product Design2 comprising derived and/or modified sequence from Homo sapiens__NP_002415.1__HsMMP8 (opt4)
ggggcgcugccuacggagguggcagccaucuccuucucggcaucaagcuuaccauguucagccugaagacccugcccuuccugcugcugcugcacgugcagaucagcaaggccuuccccgugagcagcaaggagaagaacaccaagaccgugcaggacuaccuggagaaguucuaccagcugcccagcaaccaguaccagagcaccagaaagaacggcaccaacgugaucguggagaagcugaaggagaugcagagauucuucggccugaacgugaccggcaagcccaacgaggagacccuggacaugaugaagaagcccagaugcggcgugcccgacagcggcggcuucaugcugacccccggcaaccccaagugggagagaaccaaccugaccuacagaaucagaaacuacaccccccagcugagcgaggccgagguggagagagccaucaaggacgccuucgagcuguggagcguggccagcccccugaucuucaccagaaucagccagggcgaggccgacaucaacaucgccuucuaccagagagaccacggcgacaacagccccuucgacggccccaacggcauccuggcccacgccuuccagcccggccagggcaucggcggcgacgcccacuucgacgccgaggagaccuggaccaacaccagcgccaacuacaaccuguuccugguggccgcccacgaguucggccacagccugggccuggcccacagcagcgaccccggcgcccugauguaccccaacuacgccuucagagagaccagcaacuacagccugccccaggacgacaucgacggcauccaggccaucuacggccugagcagcaaccccauccagcccaccggccccagcacccccaagcccugcgaccccagccugaccuucgacgccaucaccacccugagaggcgagauccuguucuucaaggacagauacuucuggagaagacacccccagcugcagagaguggagaugaacuucaucagccuguucuggcccagccugcccaccggcauccaggccgccuacgaggacuucgacagagaccugaucuuccuguucaagggcaaccaguacugggcccugagcggcuacgacauccugcagggcuaccccaaggacaucagcaacuacggcuuccccagcagcgugcaggccaucgacgccgccguguucuacagaagcaagaccuacuucuucgugaacgaccaguucuggagauacgacaaccagagacaguucauggagcccggcuaccccaagagcaucagcggcgccuuccccggcaucgagagcaagguggacgccguguuccagcaggagcacuucuuccacguguucagcggccccagauacuacgccuucgaccugaucgcccagagagugaccagaguggccagaggcaacaaguggcugaacugcagauacggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3042 - RNA, 2506 nt, Artificial Sequence
  mRNA product Design2 comprising derived and/or modified sequence from Homo sapiens__NP_004985.2__HsMMP9 (opt4)
ggggcgcugccuacggagguggcagccaucuccuucucggcaucaagcuuaccaugagccuguggcagccccuggugcuggugcugcuggugcugggcugcugcuucgccgcccccagacagagacagagcacccuggugcuguuccccggcgaccugagaaccaaccugaccgacagacagcuggccgaggaguaccuguacagauacggcuacaccagaguggccgagaugagaggcgagagcaagagccugggccccgcccugcugcugcugcagaagcagcugagccugcccgagaccggcgagcuggacagcgccacccugaaggccaugagaacccccagaugcggcgugcccgaccugggcagauuccagaccuucgagggcgaccugaaguggcaccaccacaacaucaccuacuggauccagaacuacagcgaggaccugcccagagccgugaucgacgacgccuucgccagagccuucgcccuguggagcgccgugaccccccugaccuucaccagaguguacagcagagacgccgacaucgugauccaguucggcguggccgagcacggcgacggcuaccccuucgacggcaaggacggccugcuggcccacgccuucccccccggccccggcauccagggcgacgcccacuucgacgacgacgagcuguggagccugggcaagggcgugguggugcccaccagauucggcaacgccgacggcgccgccugccacuuccccuucaucuucgagggcagaagcuacagcgccugcaccaccgacggcagaagcgacggccugcccuggugcagcaccaccgccaacuacgacaccgacgacagauucggcuucugccccagcgagagacuguacacccaggacggcaacgccgacggcaagcccugccaguuccccuucaucuuccagggccagagcuacagcgccugcaccaccgacggcagaagcgacggcuacagauggugcgccaccaccgccaacuacgacagagacaagcuguucggcuucugccccaccagagccgacagcaccgugaugggcggcaacagcgccggcgagcugugcguguuccccuucaccuuccugggcaaggaguacagcaccugcaccagcgagggcagaggcgacggcagacuguggugcgccaccaccagcaacuucgacagcgacaagaaguggggcuucugccccgaccagggcuacagccuguuccugguggccgcccacgaguucggccacgcccugggccuggaccacagcagcgugcccgaggcccugauguaccccauguacagauucaccgagggccccccccugcacaaggacgacgugaacggcaucagacaccuguacggccccagacccgagcccgagcccagaccccccaccaccaccaccccccagcccaccgccccccccaccgugugccccaccggcccccccaccgugcaccccagcgagagacccaccgccggccccaccggcccccccagcgccggccccaccggcccccccaccgccggccccagcaccgccaccaccgugccccugagccccguggacgacgccugcaacgugaacaucuucgacgccaucgccgagaucggcaaccagcuguaccuguucaaggacggcaaguacuggagauucagcgagggcagaggcagcagaccccagggccccuuccugaucgccgacaaguggcccgcccugcccagaaagcuggacagcguguucgaggagagacugagcaagaagcuguucuucuucagcggcagacagguguggguguacaccggcgccagcgugcugggccccagaagacuggacaagcugggccugggcgccgacguggcccaggugaccggcgcccugagaagcggcagaggcaagaugcugcuguucagcggcagaagacuguggagauucgacgugaaggcccagaugguggaccccagaagcgccagcgagguggacagaauguuccccggcgugccccuggacacccacgacguguuccaguacagagagaaggccuacuucugccaggacagauucuacuggagagugagcagcagaagcgagcugaaccagguggaccaggugggcuacgugaccuacgacauccugcagugccccgaggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3043 - RNA, 1798 nt, Artificial Sequence
  mRNA product Design2 comprising derived and/or modified sequence from Homo sapiens__NP_002418.1__HsMMP13 (opt4)
ggggcgcugccuacggagguggcagccaucuccuucucggcaucaagcuuaccaugcaccccggcgugcuggccgccuuccuguuccugagcuggacccacugcagagcccugccccugcccagcggcggcgacgaggacgaccugagcgaggaggaccugcaguucgccgagagauaccugagaagcuacuaccaccccaccaaccuggccggcauccugaaggagaacgccgccagcagcaugaccgagagacugagagagaugcagagcuucuucggccuggaggugaccggcaagcuggacgacaacacccuggacgugaugaagaagcccagaugcggcgugcccgacgugggcgaguacaacguguuccccagaacccugaaguggagcaagaugaaccugaccuacagaaucgugaacuacacccccgacaugacccacagcgagguggagaaggccuucaagaaggccuucaagguguggagcgacgugaccccccugaacuucaccagacugcacgacggcaucgccgacaucaugaucagcuucggcaucaaggagcacggcgacuucuaccccuucgacggccccagcggccugcuggcccacgccuucccccccggccccaacuacggcggcgacgcccacuucgacgacgacgagaccuggaccagcagcagcaagggcuacaaccuguuccugguggccgcccacgaguucggccacagccugggccuggaccacagcaaggaccccggcgcccugauguuccccaucuacaccuacaccggcaagagccacuucaugcugcccgacgacgacgugcagggcauccagagccuguacggccccggcgacgaggaccccaaccccaagcaccccaagacccccgacaagugcgaccccagccugagccuggacgccaucaccagccugagaggcgagaccaugaucuucaaggacagauucuucuggagacugcacccccagcagguggacgccgagcuguuccugaccaagagcuucuggcccgagcugcccaacagaaucgacgccgccuacgagcaccccagccacgaccugaucuucaucuucagaggcagaaaguucugggcccugaacggcuacgacauccuggagggcuaccccaagaagaucagcgagcugggccugcccaaggaggugaagaagaucagcgccgccgugcacuucgaggacaccggcaagacccugcuguucagcggcaaccagguguggagauacgacgacaccaaccacaucauggacaaggacuaccccagacugaucgaggaggacuuccccggcaucggcgacaagguggacgccguguacgagaagaacggcuacaucuacuucuucaacggccccauccaguucgaguacagcaucuggagcaacagaaucgugagagugaugcccgccaacagcauccuguggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3044 - RNA, 1450 nt, Artificial Sequence
  mRNA product Design2 comprising derived and/or modified sequence from Homo sapiens__NP_001286.1__HsCCR1 (opt4)
ggggcgcugccuacggagguggcagccaucuccuucucggcaucaagcuuaccauggagacccccaacaccaccgaggacuacgacaccaccaccgaguucgacuacggcgacgccacccccugccagaaggugaacgagagagccuucggcgcccagcugcugcccccccuguacagccugguguucgugaucggccuggugggcaacauccugguggugcuggugcuggugcaguacaagagacugaagaacaugaccagcaucuaccugcugaaccuggccaucagcgaccugcuguuccuguucacccugcccuucuggaucgacuacaagcugaaggacgacuggguguucggcgacgccaugugcaagauccugagcggcuucuacuacaccggccuguacagcgagaucuucuucaucauccugcugaccaucgacagauaccuggccaucgugcacgccguguucgcccugagagccagaaccgugaccuucggcgugaucaccagcaucaucaucugggcccuggccauccuggccagcaugcccggccuguacuucagcaagacccagugggaguucacccaccacaccugcagccugcacuucccccacgagagccugagagaguggaagcuguuccaggcccugaagcugaaccuguucggccuggugcugccccugcuggugaugaucaucugcuacaccggcaucaucaagauccugcugagaagacccaacgagaagaagagcaaggccgugagacugaucuucgugaucaugaucaucuucuuccuguucuggacccccuacaaccugaccauccugaucagcguguuccaggacuuccuguucacccacgagugcgagcagagcagacaccuggaccuggccgugcaggugaccgaggugaucgccuacacccacugcugcgugaaccccgugaucuacgccuucgugggcgagagauucagaaaguaccugagacagcuguuccacagaagaguggccgugcaccuggugaaguggcugcccuuccugagcguggacagacuggagagagugagcagcaccagccccagcaccggcgagcacgagcugagcgccggcuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3045 - RNA, 1018 nt, Artificial Sequence
  mRNA product Design2 comprising derived and/or modified sequence from Homo sapiens__NP_002598.4__HsPDGFA (opt4)
ggggcgcugccuacggagguggcagccaucuccuucucggcaucaagcuuaccaugagaacccuggccugccugcugcugcugggcugcggcuaccuggcccacgugcuggccgaggaggccgagauccccagagaggugaucgagagacuggccagaagccagauccacagcaucagagaccugcagagacugcuggagaucgacagcgugggcagcgaggacagccuggacaccagccugagagcccacggcgugcacgccaccaagcacgugcccgagaagagaccccugcccaucagaagaaagagaagcaucgaggaggccgugcccgccgugugcaagaccagaaccgugaucuacgagauccccagaagccagguggaccccaccagcgccaacuuccugaucuggccccccugcguggaggugaagagaugcaccggcugcugcaacaccagcagcgugaagugccagcccagcagagugcaccacagaagcgugaagguggccaagguggaguacgugagaaagaagcccaagcugaaggaggugcaggugagacuggaggagcaccuggagugcgccugcgccaccaccagccugaaccccgacuacagagaggaggacaccggcagacccagagagagcggcaagaagagaaagagaaagagacugaagcccaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3046 - RNA, 1108 nt, Artificial Sequence
  mRNA product Design2 comprising derived and/or modified sequence from Homo sapiens__NP_002599.1__HsPDGFB (opt4)
ggggcgcugccuacggagguggcagccaucuccuucucggcaucaagcuuaccaugaacagaugcugggcccuguuccugagccugugcugcuaccugagacuggugagcgccgagggcgaccccauccccgaggagcuguacgagaugcugagcgaccacagcaucagaagcuucgacgaccugcagagacugcugcacggcgaccccggcgaggaggacggcgccgagcuggaccugaacaugaccagaagccacagcggcggcgagcuggagagccuggccagaggcagaagaagccugggcagccugaccaucgccgagcccgccaugaucgccgagugcaagaccagaaccgagguguucgagaucagcagaagacugaucgacagaaccaacgccaacuuccugguguggccccccugcguggaggugcagagaugcagcggcugcugcaacaacagaaacgugcagugcagacccacccaggugcagcugagacccgugcaggugagaaagaucgagaucgugagaaagaagcccaucuucaagaaggccaccgugacccuggaggaccaccuggccugcaagugcgagaccguggccgccgccagacccgugaccagaagccccggcggcagccaggagcagagagccaagaccccccagaccagagugaccaucagaaccgugagagugagaagaccccccaagggcaagcacagaaaguucaagcacacccacgacaagaccgcccugaaggagacccugggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3047 - RNA, 1420 nt, Artificial Sequence
  mRNA product Design2 comprising derived and/or modified sequence from Homo sapiens__NP_057289.1__HsPDGFC (opt4)
ggggcgcugccuacggagguggcagccaucuccuucucggcaucaagcuuaccaugagccuguucggccugcugcugcugaccagcgcccuggccggccagagacagggcacccaggccgagagcaaccugagcagcaaguuccaguucagcagcaacaaggagcagaacggcgugcaggacccccagcacgagagaaucaucaccgugagcaccaacggcagcauccacagccccagauucccccacaccuaccccagaaacaccgugcugguguggagacugguggccguggaggagaacguguggauccagcugaccuucgacgagagauucggccuggaggaccccgaggacgacaucugcaaguacgacuucguggagguggaggagcccagcgacggcaccauccugggcagauggugcggcagcggcaccgugcccggcaagcagaucagcaagggcaaccagaucagaaucagauucgugagcgacgaguacuuccccagcgagcccggcuucugcauccacuacaacaucgugaugccccaguucaccgaggccgugagccccagcgugcugccccccagcgcccugccccuggaccugcugaacaacgccaucaccgccuucagcacccuggaggaccugaucagauaccuggagcccgagagauggcagcuggaccuggaggaccuguacagacccaccuggcagcugcugggcaaggccuucguguucggcagaaagagcagagugguggaccugaaccugcugaccgaggaggugagacuguacagcugcacccccagaaacuucagcgugagcaucagagaggagcugaagagaaccgacaccaucuucuggcccggcugccugcuggugaagagaugcggcggcaacugcgccugcugccugcacaacugcaacgagugccagugcgugcccagcaaggugaccaagaaguaccacgaggugcugcagcugagacccaagaccggcgugagaggccugcacaagagccugaccgacguggcccuggagcaccacgaggagugcgacugcgugugcagaggcagcaccggcggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3048 - RNA, 1477 nt, Artificial Sequence
  mRNA product Design2 comprising derived and/or modified sequence from Homo sapiens__NP_149126.1__HsPDGFD (opt4)
ggggcgcugccuacggagguggcagccaucuccuucucggcaucaagcuuaccaugcacagacugaucuucguguacacccugaucugcgccaacuucugcagcugcagagacaccagcgccaccccccagagcgccagcaucaaggcccugagaaacgccaaccugagaagagacgaccuguacagaagagacgagaccauccaggugaagggcaacggcuacgugcagagccccagauuccccaacagcuaccccagaaaccugcugcugaccuggagacugcacagccaggagaacaccagaauccagcugguguucgacaaccaguucggccuggaggaggccgagaacgacaucugcagauacgacuucguggagguggaggacaucagcgagaccagcaccaucaucagaggcagauggugcggccacaaggaggugccccccagaaucaagagcagaaccaaccagaucaagaucaccuucaagagcgacgacuacuucguggccaagcccggcuucaagaucuacuacagccugcuggaggacuuccagcccgccgccgccagcgagaccaacugggagagcgugaccagcagcaucagcggcgugagcuacaacagccccagcgugaccgaccccacccugaucgccgacgcccuggacaagaagaucgccgaguucgacaccguggaggaccugcugaaguacuucaaccccgagagcuggcaggaggaccuggagaacauguaccuggacacccccagauacagaggcagaagcuaccacgacagaaagagcaagguggaccuggacagacugaacgacgacgccaagagauacagcugcacccccagaaacuacagcgugaacaucagagaggagcugaagcuggccaacgugguguucuuccccagaugccugcuggugcagagaugcggcggcaacugcggcugcggcaccgugaacuggagaagcugcaccugcaacagcggcaagaccgugaagaaguaccacgaggugcugcaguucgagcccggccacaucaagagaagaggcagagccaagaccauggcccugguggacauccagcuggaccaccacgagagaugcgacugcaucugcagcagcagaccccccagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3049 - RNA, 1060 nt, Artificial Sequence
  mRNA product Design2 comprising derived and/or modified sequence from Homo sapiens__NP_003946.3__HsSOCS3 (opt4)
ggggcgcugccuacggagguggcagccaucuccuucucggcaucaagcuuaccauggugacccacagcaaguuccccgccgccggcaugagcagaccccuggacaccagccugagacugaagaccuucagcagcaagagcgaguaccagcugguggugaacgccgugagaaagcugcaggagagcggcuucuacuggagcgccgugaccggcggcgaggccaaccugcugcugagcgccgagcccgccggcaccuuccugaucagagacagcagcgaccagagacacuucuucacccugagcgugaagacccagagcggcaccaagaaccugagaauccagugcgagggcggcagcuucagccugcagagcgaccccagaagcacccagcccgugcccagauucgacugcgugcugaagcuggugcaccacuacaugcccccccccggcgcccccagcuuccccagcccccccaccgagcccagcagcgaggugcccgagcagcccagcgcccagccccugcccggcagcccccccagaagagccuacuacaucuacagcggcggcgagaagaucccccuggugcugagcagaccccugagcagcaacguggccacccugcagcaccugugcagaaagaccgugaacggccaccuggacagcuacgagaaggugacccagcugcccggccccaucagagaguuccuggaccaguacgacgccccccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3050 - RNA, 865 nt, Artificial Sequence
  mRNA product Design2 comprising derived and/or modified sequence from Homo sapiens__NP_003227.1__HsTGFA (opt4)
ggggcgcugccuacggagguggcagccaucuccuucucggcaucaagcuuaccauggugcccagcgccggccagcuggcccuguucgcccugggcaucgugcuggccgccugccaggcccuggagaacagcaccagcccccugagcgccgacccccccguggccgccgccguggugagccacuucaacgacugccccgacagccacacccaguucugcuuccacggcaccugcagauuccuggugcaggaggacaagcccgccugcgugugccacagcggcuacgugggcgccagaugcgagcacgccgaccugcuggccgugguggccgccagccagaagaagcaggccaucaccgcccuggugguggugagcaucguggcccuggccgugcugaucaucaccugcgugcugauccacugcugccaggugagaaagcacugcgaguggugcagagcccugaucugcagacacgagaagcccagcgcccugcugaagggcagaaccgccugcugccacagcgagaccguggugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3051 - RNA, 1555 nt, Artificial Sequence
  mRNA product Design2 comprising derived and/or modified sequence from Homo sapiens__NP_000651.3__HsTGFB1 (opt4)
ggggcgcugccuacggagguggcagccaucuccuucucggcaucaagcuuaccaugccccccagcggccugagacugcugccccugcugcugccccugcuguggcugcuggugcugacccccggcagacccgccgccggccugagcaccugcaagaccaucgacauggagcuggugaagagaaagagaaucgaggccaucagaggccagauccugagcaagcugagacuggccagcccccccagccagggcgaggugccccccggcccccugcccgaggccgugcuggcccuguacaacagcaccagagacagaguggccggcgagagcgccgagcccgagcccgagcccgaggccgacuacuacgccaaggaggugaccagagugcugaugguggagacccacaacgagaucuacgacaaguucaagcagagcacccacagcaucuacauguucuucaacaccagcgagcugagagaggccgugcccgagcccgugcugcugagcagagccgagcugagacugcugagacugaagcugaagguggagcagcacguggagcuguaccagaaguacagcaacaacagcuggagauaccugagcaacagacugcuggcccccagcgacagccccgaguggcugagcuucgacgugaccggcguggugagacaguggcugagcagaggcggcgagaucgagggcuucagacugagcgcccacugcagcugcgacagcagagacaacacccugcagguggacaucaacggcuucaccaccggcagaagaggcgaccuggccaccauccacggcaugaacagacccuuccugcugcugauggccaccccccuggagagagcccagcaccugcagagcagcagacacagaagagcccuggacaccaacuacugcuucagcagcaccgagaagaacugcugcgugagacagcuguacaucgacuucagaaaggaccugggcuggaaguggauccacgagcccaagggcuaccacgccaacuucugccugggccccugccccuacaucuggagccuggacacccaguacagcaaggugcuggcccuguacaaccagcacaaccccggcgccagcgccgcccccugcugcgugccccaggcccuggagccccugcccaucguguacuacgugggcagaaagcccaagguggagcagcugagcaacaugaucgugagaagcugcaagugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3052 - RNA, 1627 nt, Artificial Sequence
  mRNA product Design2 comprising derived and/or modified sequence from Homo sapiens__NP_003229.1__HsTGFB2 (opt4)
ggggcgcugccuacggagguggcagccaucuccuucucggcaucaagcuuaccaugcacuacugcgugcugagcgccuuccugauccugcaccuggugaccguggcccugagccugagcaccugcagcacccuggacauggaccaguucaugagaaagagaaucgaggccaucagaggccagauccugagcaagcugaagcugaccagcccccccgaggacuaccccgagcccgaggaggugccccccgaggugaucagcaucuacaacagcaccagagaccugcugcaggagaaggccagcagaagagccgccgccugcgagagagagagaagcgacgaggaguacuacgccaaggagguguacaagaucgacaugccccccuucuuccccagcgagaacgccaucccccccaccuucuacagacccuacuucagaaucgugagauucgacgugagcgccauggagaagaacgccagcaaccuggugaaggccgaguucagaguguucagacugcagaaccccaaggccagagugcccgagcagagaaucgagcuguaccagauccugaagagcaaggaccugaccagccccacccagagauacaucgacagcaagguggugaagaccagagccgagggcgaguggcugagcuucgacgugaccgacgccgugcacgaguggcugcaccacaaggacagaaaccugggcuucaagaucagccugcacugccccugcugcaccuucgugcccagcaacaacuacaucauccccaacaagagcgaggagcuggaggccagauucgccggcaucgacggcaccagcaccuacaccagcggcgaccagaagaccaucaagagcaccagaaagaagaacagcggcaagaccccccaccugcugcugaugcugcugcccagcuacagacuggagagccagcagaccaacagaagaaagaagagagcccuggacgccgccuacugcuucagaaacgugcaggacaacugcugccugagaccccuguacaucgacuucaagagagaccugggcuggaaguggauccacgagcccaagggcuacaacgccaacuucugcgccggcgccugccccuaccuguggagcagcgacacccagcacagcagagugcugagccuguacaacaccaucaaccccgaggccagcgccagccccugcugcgugagccaggaccuggagccccugaccauccuguacuacaucggcaagacccccaagaucgagcagcugagcaacaugaucgugaagagcugcaagugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3053 - RNA, 1621 nt, Artificial Sequence
  mRNA product Design2 comprising derived and/or modified sequence from Homo sapiens__NP_003230.1__HsTGFB3 (opt4)
ggggcgcugccuacggagguggcagccaucuccuucucggcaucaagcuuaccaugaagaugcaccugcagagagcccugguggugcuggcccugcugaacuucgccaccgugagccugagccugagcaccugcaccacccuggacuucggccacaucaagaagaagagaguggaggccaucagaggccagauccugagcaagcugagacugaccagcccccccgagcccaccgugaugacccacgugcccuaccaggugcuggcccuguacaacagcaccagagagcugcuggaggagaugcacggcgagagagaggagggcugcacccaggagaacaccgagagcgaguacuacgccaaggagauccacaaguucgacaugauccagggccuggccgagcacaacgagcuggccgugugccccaagggcaucaccagcaagguguucagauucaacgugagcagcguggagaagaacagaaccaaccuguucagagccgaguucagagugcugagagugcccaaccccagcagcaagagaaacgagcagagaaucgagcuguuccagauccugagacccgacgagcacaucgccaagcagagauacaucggcggcaagaaccugcccaccagaggcaccgccgaguggcugagcuucgacgugaccgacaccgugagagaguggcugcugagaagagagagcaaccugggccuggagaucagcauccacugccccugccacaccuuccagcccaacggcgacauccuggagaacauccacgaggugauggagaucaaguucaagggcguggacaacgaggacgaccacggcagaggcgaccugggcagacugaagaagcagaaggaccaccacaacccccaccugauccugaugaugauccccccccacagacuggacaaccccggccagggcggccagagaaagaagagagcccuggacaccaacuacugcuucagaaaccuggaggagaacugcugcgugagaccccuguacaucgacuucagacaggaccugggcuggaagugggugcacgagcccaagggcuacuacgccaacuucugcagcggccccugccccuaccugagaagcgccgacaccacccacagcaccgugcugggccuguacaacacccugaaccccgaggccagcgccagccccugcugcgugccccaggaccuggagccccugaccauccuguacuacgugggcagaacccccaagguggagcagcugagcaacaugguggugaagagcugcaagugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3054 - RNA, 1768 nt, Artificial Sequence
  mRNA product Design2 comprising derived and/or modified sequence from Homo sapiens__NP_001057.1__HsTNFRSF1B (opt4)
ggggcgcugccuacggagguggcagccaucuccuucucggcaucaagcuuaccauggcccccguggccgugugggccgcccuggccgugggccuggagcugugggccgccgcccacgcccugcccgcccagguggccuucacccccuacgcccccgagcccggcagcaccugcagacugagagaguacuacgaccagaccgcccagaugugcugcagcaagugcagccccggccagcacgccaagguguucugcaccaagaccagcgacaccgugugcgacagcugcgaggacagcaccuacacccagcuguggaacugggugcccgagugccugagcugcggcagcagaugcagcagcgaccagguggagacccaggccugcaccagagagcagaacagaaucugcaccugcagacccggcugguacugcgcccugagcaagcaggagggcugcagacugugcgccccccugagaaagugcagacccggcuucggcguggccagacccggcaccgagaccagcgacguggugugcaagcccugcgcccccggcaccuucagcaacaccaccagcagcaccgacaucugcagaccccaccagaucugcaacgugguggccauccccggcaacgccagcauggacgccgugugcaccagcaccagccccaccagaagcauggcccccggcgccgugcaccugccccagcccgugagcaccagaagccagcacacccagcccacccccgagcccagcaccgcccccagcaccagcuuccugcugcccaugggccccagcccccccgccgagggcagcaccggcgacuucgcccugcccgugggccugaucgugggcgugaccgcccugggccugcugaucaucggcguggugaacugcgugaucaugacccaggugaagaagaagccccugugccugcagagagaggccaaggugccccaccugcccgccgacaaggccagaggcacccagggccccgagcagcagcaccugcugaucaccgcccccagcagcagcagcagcagccuggagagcagcgccagcgcccuggacagaagagcccccaccagaaaccagccccaggcccccggcguggaggccagcggcgccggcgaggccagagccagcaccggcagcagcgacagcagccccggcggccacggcacccaggugaacgugaccugcaucgugaacgugugcagcagcagcgaccacagcagccagugcagcagccaggccagcagcaccaugggcgacaccgacagcagccccagcgagagccccaaggacgagcaggugcccuucagcaaggaggagugcgccuucagaagccagcuggagacccccgagacccugcugggcagcaccgaggagaagccccugccccugggcgugcccgacgccggcaugaagcccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3055 - RNA, 895 nt, Artificial Sequence
  mRNA product Design2 comprising derived and/or modified sequence from Homo sapiens__NP_002623.2__HsPGF (opt4)
ggggcgcugccuacggagguggcagccaucuccuucucggcaucaagcuuaccaugcccgugaugagacuguuccccugcuuccugcagcugcuggccggccuggcccugcccgccgugcccccccagcagugggcccugagcgccggcaacggcagcagcgagguggagguggugcccuuccaggagguguggggcagaagcuacugcagagcccuggagagacugguggacguggugagcgaguaccccagcgagguggagcacauguucagccccagcugcgugagccugcugagaugcaccggcugcugcggcgacgagaaccugcacugcgugcccguggagaccgccaacgugaccaugcagcugcugaagaucagaagcggcgacagacccagcuacguggagcugaccuucagccagcacgugagaugcgagugcagaccccugagagagaagaugaagcccgagagaagaagacccaagggcagaggcaagagaagaagagagaagcagagacccaccgacugccaccugugcggcgacgccgugcccagaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3056 - RNA, 1621 nt, Artificial Sequence
  mRNA product Design2 comprising derived and/or modified sequence from Homo sapiens__NP_001020537.2__HsVEGFA (opt4)
ggggcgcugccuacggagguggcagccaucuccuucucggcaucaagcuuaccaugaccgacagacagaccgacaccgcccccagccccagcuaccaccugcugcccggcagaagaagaaccguggacgccgccgccagcagaggccagggccccgagcccgcccccggcggcggcguggagggcgugggcgccagaggcguggcccugaagcuguucgugcagcugcugggcugcagcagauucggcggcgccguggugagagccggcgaggccgagcccagcggcgccgccagaagcgccagcagcggcagagaggagccccagcccgaggagggcgaggaggaggaggagaaggaggaggagagaggcccccaguggagacugggcgccagaaagcccggcagcuggaccggcgaggccgccgugugcgccgacagcgcccccgccgccagagccccccaggcccuggccagagccagcggcagaggcggcagaguggccagaagaggcgccgaggagagcggccccccccacagccccagcagaagaggcagcgccagcagagccggccccggcagagccagcgagaccaugaacuuccugcugagcugggugcacuggagccuggcccugcugcuguaccugcaccacgccaaguggagccaggccgcccccauggccgagggcggcggccagaaccaccacgagguggugaaguucauggacguguaccagagaagcuacugccaccccaucgagacccugguggacaucuuccaggaguaccccgacgagaucgaguacaucuucaagcccagcugcgugccccugaugagaugcggcggcugcugcaacgacgagggccuggagugcgugcccaccgaggagagcaacaucaccaugcagaucaugagaaucaagccccaccagggccagcacaucggcgagaugagcuuccugcagcacaacaagugcgagugcagacccaagaaggacagagccagacaggagaagaagagcgugagaggcaagggcaagggccagaagagaaagagaaagaagagcagauacaagagcuggagcguguacgugggcgccagaugcugccugaugcccuggagccugcccggcccccaccccugcggccccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3057 - RNA, 1081 nt, Artificial Sequence
  mRNA product Design2 comprising derived and/or modified sequence from Homo sapiens__NP_001165094.1__HsVEGFA (opt4)
ggggcgcugccuacggagguggcagccaucuccuucucggcaucaagcuuaccaugaacuuccugcugagcugggugcacuggagccuggcccugcugcuguaccugcaccacgccaaguggagccaggccgcccccauggccgagggcggcggccagaaccaccacgagguggugaaguucauggacguguaccagagaagcuacugccaccccaucgagacccugguggacaucuuccaggaguaccccgacgagaucgaguacaucuucaagcccagcugcgugccccugaugagaugcggcggcugcugcaacgacgagggccuggagugcgugcccaccgaggagagcaacaucaccaugcagaucaugagaaucaagccccaccagggccagcacaucggcgagaugagcuuccugcagcacaacaagugcgagugcagacccaagaaggacagagccagacaggagaagaagagcgugagaggcaagggcaagggccagaagagaaagagaaagaagagcagauacaagagcuggagcguguacgugggcgccagaugcugccugaugcccuggagccugcccggcccccaccccugcggccccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3058 - RNA, 1006 nt, Artificial Sequence
  mRNA product Design2 comprising derived and/or modified sequence from Homo sapiens__NP_003368.1__HsVEGFB (opt4)
ggggcgcugccuacggagguggcagccaucuccuucucggcaucaagcuuaccaugagcccccugcugagaagacugcugcuggccgcccugcugcagcuggcccccgcccaggcccccgugagccagcccgacgcccccggccaccagagaaagguggugagcuggaucgacguguacaccagagccaccugccagcccagagaggugguggugccccugaccguggagcugaugggcaccguggccaagcagcuggugcccagcugcgugaccgugcagagaugcggcggcugcugccccgacgacggccuggagugcgugcccaccggccagcaccaggugagaaugcagauccugaugaucagauaccccagcagccagcugggcgagaugagccuggaggagcacagccagugcgagugcagacccaagaagaaggacagcgccgugaagcccgacagagccgccaccccccaccacagaccccagcccagaagcgugcccggcugggacagcgcccccggcgcccccagccccgccgacaucacccaccccacccccgcccccggccccagcgcccacgccgcccccagcaccaccagcgcccugacccccggccccgccgccgccgccgccgacgccgccgccagcagcguggccaagggcggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3059 - RNA, 1642 nt, Artificial Sequence
  mRNA product Design2 comprising derived and/or modified sequence from Homo sapiens__NP_005420.1__HsVEGFC (opt4)
ggggcgcugccuacggagguggcagccaucuccuucucggcaucaagcuuaccaugcaccugcugggcuucuucagcguggccugcagccugcuggccgccgcccugcugcccggccccagagaggcccccgccgccgccgccgccuucgagagcggccuggaccugagcgacgccgagcccgacgccggcgaggccaccgccuacgccagcaaggaccuggaggagcagcugagaagcgugagcagcguggacgagcugaugaccgugcuguaccccgaguacuggaagauguacaagugccagcugagaaagggcggcuggcagcacaacagagagcaggccaaccugaacagcagaaccgaggagaccaucaaguucgccgccgcccacuacaacaccgagauccugaagagcaucgacaacgaguggagaaagacccagugcaugcccagagaggugugcaucgacgugggcaaggaguucggcguggccaccaacaccuucuucaagccccccugcgugagcguguacagaugcggcggcugcugcaacagcgagggccugcagugcaugaacaccagcaccagcuaccugagcaagacccuguucgagaucaccgugccccugagccagggccccaagcccgugaccaucagcuucgccaaccacaccagcugcagaugcaugagcaagcuggacguguacagacaggugcacagcaucaucagaagaagccugcccgccacccugccccagugccaggccgccaacaagaccugccccaccaacuacauguggaacaaccacaucugcagaugccuggcccaggaggacuucauguucagcagcgacgccggcgacgacagcaccgacggcuuccacgacaucugcggccccaacaaggagcuggacgaggagaccugccagugcgugugcagagccggccugagacccgccagcugcggcccccacaaggagcuggacagaaacagcugccagugcgugugcaagaacaagcuguuccccagccagugcggcgccaacagagaguucgacgagaacaccugccagugcgugugcaagagaaccugccccagaaaccagccccugaaccccggcaagugcgccugcgagugcaccgagagcccccagaagugccugcugaagggcaagaaguuccaccaccagaccugcagcugcuacagaagacccugcaccaacagacagaaggccugcgagcccggcuucagcuacagcgaggaggugugcagaugcgugcccagcuacuggaagagaccccagaugagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3060 - RNA, 1447 nt, Artificial Sequence
  mRNA product Design2 comprising derived and/or modified sequence from Homo sapiens__NP_004460.1__HsVEGFD (opt4)
ggggcgcugccuacggagguggcagccaucuccuucucggcaucaagcuuaccauguacagagagugggugguggugaacguguucaugaugcuguacgugcagcuggugcagggcagcagcaacgagcacggccccgugaagagaagcagccagagcacccuggagagaagcgagcagcagaucagagccgccagcagccuggaggagcugcugagaaucacccacagcgaggacuggaagcuguggagaugcagacugagacugaagagcuucaccagcauggacagcagaagcgccagccacagaagcaccagauucgccgccaccuucuacgacaucgagacccugaaggugaucgacgaggaguggcagagaacccagugcagccccagagagaccugcguggagguggccagcgagcugggcaagagcaccaacaccuucuucaagccccccugcgugaacguguucagaugcggcggcugcugcaacgaggagagccugaucugcaugaacaccagcaccagcuacaucagcaagcagcuguucgagaucagcgugccccugaccagcgugcccgagcuggugcccgugaagguggccaaccacaccggcugcaagugccugcccaccgcccccagacaccccuacagcaucaucagaagaagcauccagauccccgaggaggacagaugcagccacagcaagaagcugugccccaucgacaugcugugggacagcaacaagugcaagugcgugcugcaggaggagaacccccuggccggcaccgaggaccacagccaccugcaggagcccgcccugugcggcccccacaugauguucgacgaggacagaugcgagugcgugugcaagacccccugccccaaggaccugauccagcaccccaagaacugcagcugcuucgagugcaaggagagccuggagaccugcugccagaagcacaagcuguuccaccccgacaccugcagcugcgaggacagaugccccuuccacaccagacccugcgccagcggcaagaccgccugcgccaagcacugcagauuccccaaggagaagagagccgcccagggcccccacagcagaaagaaccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3061 - RNA, 1012 nt, Artificial Sequence
  mRNA product Design2 comprising derived and/or modified sequence from Homo sapiens__NP_061986.1__HsFGF21 (opt5)
ggggcgcugccuacggagguggcagccaucuccuucucggcaucaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagcugcuucuggaagauggcuauaacguguaccaguccgaggcccacgggcucccccugcaucugccuggaaauaaaagcccgcacagagaccccgcgccucggggccccgcccgcuuucucccucugcccgggcuuccgccugcucugcccgaaccucccggaauccucgcuccccagccuccggauguugggucuuccgacccccugagcauggugggcccuucucaggggagaucccccagcuaugccucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3062 - RNA, 1792 nt, Artificial Sequence
  mRNA product Design2 comprising derived and/or modified sequence from Homo sapiens__NP_002412.1__HsMMP1 (opt5)
ggggcgcugccuacggagguggcagccaucuccuucucggcaucaagcuuaccaugcacagcuuucccccucugcuccugcuucuguucuggggcguggucucccauucuuucccggccacccucgagacacaggaacaagacguugaucuggugcagaaguaccuugagaaauauuacaaccugaagaaugacgggagacagguggaaaaacggcgcaacagcggacccgucguggagaagcucaaacagaugcaagaauuuuucggccugaagguuacggggaagccugaugcugagacccugaaagugaugaagcagcccagaugcggagucccugacguggcccaguuuguucucacagagggcaauccccggugggaacagacccaccugacauaucgcaucgagaacuacaccccugaucuuccgagagcggacguggaucaugcuauugaaaaagccuuccaacugugguccaaugucacaccccucaccuuuacgaaggugucugaggggcaggccgacaucaugauuagcuucgugcggggagaucaccgcgacaacuccccuuuugauggccccggcgggaaucuggcucaugccuuccagccuggacccggcaucgggggagacgcucacuuugaugaggacgaaagauggaccaacaauuuccgggaguauaaccuucaccgcgucgccgcgcaugaacugggccacucucucgggcugagccauuccacagacauuggagcccugauguacccgagcuauaccuuuucuggcgauguucagcucgcucaagacgauaucgacggcauccaggccauuuacgggagaucccagaauccugugcaacccaucggaccucagacacccaaggcuugugauagcaaacugaccuucgacgccauuacgacaauccggggcgaggugauguucuuuaaggaucgcuucuacaugagaaccaaccccuuuuauccugaagucgagcuuaauuucauuucuguguuuuggccgcagcugcccaacgggcucgaggcggccuacgaguucgcugaccgggaugaaguucgcuuuuucaaaggaaauaaguauugggccgugcagggccaaaacguccugcacggguacccuaaagacaucuauuccagcuuuggauuccccagaacagugaagcacauugaugcugcccuuucugaagagaacaccggcaaaaccuacuuuuucguugccaauaaguauuggcgguacgacgaauacaaaagauccauggacccuggcuaucccaagaugaucgcucaugauuuuccggggaucggacacaagguggacgcggucuucaugaaagauggcuucuuuuacuucuuucaugggacacgccaguauaaguucgacccuaaaacgaagcggauucugacccuccagaaagccaacagcugguuuaauugcagaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3063 - RNA, 1552 nt, Artificial Sequence
  mRNA product Design2 comprising derived and/or modified sequence from Homo sapiens__NP_002412.1__HsMMP1(1-19,100-469) (opt5)
ggggcgcugccuacggagguggcagccaucuccuucucggcaucaagcuuaccaugcacagcuuucccccucugcuccugcuucuguucuggggcguggucucccauucuuucguucucaccgaggggaacccgagaugggaacagacacaccugacguaccggauugagaauuauacccccgaccuuccucgcgccgauguggaccaugcuauugaaaaggccuuucaacuguggagcaacgugacaccccucaccuucacaaaagucuccgagggacaggcggauaucaugauuucuuuugugagaggcgaccaccgggauaauagcccuuucgacgggcccggaggcaaccuggcucaugccuuucagccugggccgggaaucggcggcgaugcccacuucgacgaagaugagcgcuggaccaauaacuuuagagaguacaaucugcaccggguugcugcccaugaacucgggcacucccugggacuuucucauagcacagacauuggcgcucugauguaucccuccuacaccuucagcggggaugugcagcucgcccaagacgauaucgacggaauccaggcgauuuauggccgcucucagaacccuguccagcccaucgggccucaaacgcccaaggccugcgacuccaaacugaccuuugaugcuauuacaaccaucagaggagaggugauguucuuuaaggaccgguucuacaugcgcacaaauccguucuauccugaaguugagcuuaacuuuauuagcguguucuggccccagcugccuaauggccucgaggccgcuuacgaauuugccgauagagacgagguccgguucuuuaaaggcaacaaguacugggcggugcaggggcagaaugugcugcacggauaucccaaggauaucuacucuuccuucggcuuuccccgcaccgucaaacacauugacgccgcucugagcgaagagaacacggggaagacauauuucuuuguugccaauaaauacuggagauaugaugaauacaagcggucuauggacccuggauauccgaaaaugaucgcucaugauuuccccggcaucgggcacaagguggacgccguguuuaugaaggauggauucuuuuacuucuuccauggcacccgccaauacaaauuugacccuaagacaaaaagaauccucacccugcagaaggccaacuccugguucaacugucggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3064 - RNA, 3739 nt, Artificial Sequence
  mRNA product Design2 comprising derived and/or modified sequence from Clostridium histolyticum__BAA77453.1__ColG (opt5)
ggggcgcugccuacggagguggcagccaucuccuucucggcaucaagcuuaccaugaagaaaaacauccugaagauucucauggacagcuacuccaaagagucuaagauccagaccgugagacgggucacaagcguuucccugcuugccguguaucugacgaugaauaccucuagccucgugcuggcuaaacccauugaaaacacaaaugauaccuccaucaagaacgucgagaaacuucgcaaugccccuaacgaagaaaauucuaaaaagguggaagacagcaaaaacgauaagguugagcacgugaaaaauauugaggaagcgaaggucgagcaaguggcuccggaaguuaaguccaaaagcacacugagaucugccuccaucgccaacaccaauagcgagaaguacgacuucgaguaucucaacggccugucuuacacagaacugaccaaucucaucaaaaacauuaaguggaaucagaucaacgggcuguuuaacuauuccacgggaagccagaaauucuuuggcgauaagaaucgggugcaggcuauuaucaacgcccuucaagagucugggcgcaccuacacagcuaaugacaugaaaggaauugaaaccuucacagagguccugagagccggcuuuuaucucggguacuacaacgauggacuguccuaucuuaaugaccggaacuuccaggauaagugcauccccgcgaugauugccauccagaagaauccuaacuuuaaacugggcaccgcugugcaggacgaagugaucacgagccucggcaagcugauugggaaugccuccgcuaacgccgaggucguuaauaacugugugcccgugcugaaacaauuccgcgagaaucucaaccaguacgcgccugauuaugucaagggaacagccgugaaugaacugaucaaaggcauugaguuugacuucucuggggcugccuacgaaaaggauguuaagaccaugcccugguauggaaaaaucgacccuuuuauuaacgagcuuaaggcucugggccucuacgggaacaucacaagcgccaccgaaugggccuccgacgugggaaucuauuaccugagcaaauucggccuuuacucuaccaauagaaacgauauuguccagucccuggagaaggcuguggacauguauaaauacggcaagaucgcguuuguugccauggagcggauuacaugggauuaugacgggaucggaagcaauggcaagaaaguggaucaugacaaguuccucgaugacgcugaaaaacacuaccugccgaagacguauaccuucgauaacgggacauuuauuauccgcgccggagacaaagucucugaggaaaagaucaagagacuguacugggccagccgggaggugaaaucccaguuccaucgcgucgugggcaaugauaaggcucucgaaguugggaacgccgacgacgugcugaccaugaaaauuuuuaauucucccgaggaguauaaguucaacacaaauaucaacggagucagcaccgauaauggcggccuuuacauugaaccuagagggacguuuuacacauaugagcggacaccccaacaguccaucuucagccuggaggagcucuuucgccacgaguacacccauuaucugcaggcgagauaccuuguggacggacuguggggccaagggccuuucuaugagaaaaaccggcucaccugguuugaugaaggaaccgcugaguucuuugccggcucuacaagaacguccgggguucugccccgcaagagcauucugggcuaccucgccaaagacaagguggaucaccgguauucucugaagaaaacccuuaauuccggauacgacgauagcgacuggauguucuacaacuauggcuuugcugucgcccacuaccuguaugaaaaggauaugccgacauucaucaaaaugaauaaggcuauucucaacaccgacgugaaauccuacgaugaaaucaucaagaagcugucugacgaugccaacaaaaauacagaguaucagaaccauauucaggagcuggcggacaaguaccagggggccggaaucccucuugugagcgacgauuaucucaaagaccacggcuacaagaaggcuuccgaaguuuacucugagauuagcaaggccgcuucccugaccaauacgagcgucaccgccgaaaagucucaauauuucaacacauuuacccugagagggacauacaccggagagacguccaaaggcgaguucaaggauugggacgaaaugagcaaaaagcucgaugggacacuggagucucuugcgaaaaauuccuggagcggcuauaagacccugacagccuacuuuaccaacuaucgcgugaccucugacaauaaggugcaguacgaugucguguuccauggaguucucacagacaacgcugauaucagcaauaacaaagcccccauugcuaaggugacgggcccuuccaccggggccgucggacggaauaucgaauuuagcggcaaagacucuaaggaugaggacgggaaaaucguguccuaugauugggacuucggagacggcgccacaagcagagggaagaacuccguucacgcuuacaaaaaggcgggcaccuacaaugugacacugaaggucaccgaugacaaaggagccacggcuacagaaucuuuuaccauugagaucaagaacgaagauaccacaacccccauuacaaaagagauggagcccaaugacgauaucaaggaagccaacggcccuauuguggaggggguuacggugaaaggagaccugaacggcagcgaugacgccgauaccuucuauuuugacgucaaggaagauggggacgugacaaucgagcuuccguacuccggaucuagcaauuucaccuggcucguguauaaggagggcgacgaucagaaccacaucgcuuccgggauugacaaaaauaacucuaaggucggcacauuuaaaagcaccaagggacgccauuacguuuucaucuauaaacacgauuccgccagcaauauuucuuacucccugaacaucaagggccuggggaaugaaaagcucaaagagaaggaaaacaaugacagcucugauaaagcgacggugauucccaacuuuaauaccacaaugcagggaucccugcuuggcgacgauagccgggacuauuacucuuucgaggugaaggaagagggggaggucaacaucgaacuggauaaaaaggacgaguucggagugaccuggacacuccauccugaauccaauaucaacgauagaauuaccuacggccaaguugacggcaauaaggugagcaacaaagucaagcugcgccccgggaaauauuaccugcuuguguauaaguacuccggaagcggcaauuaugagcuccggguuaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3065 - RNA, 3463 nt, Artificial Sequence
  mRNA product Design2 comprising derived and/or modified sequence from Clostridium histolyticum__BAA77453.1__HsALB(1-18)_ColG(111-1118) (opt5)
ggggcgcugccuacggagguggcagccaucuccuucucggcaucaagcuuaccaugaagugggugaccuucaucagccugcucuuucuguucuccucugccuacagcauugcuaacacaaauuccgagaaauaugacuuugaauaccuuaacggccugucuuauacggagcucaccaaucugaucaagaacauuaaauggaaucagaucaacgggcuuuucaauuacagcacaggaucccaaaaguuuuucggcgauaaaaacagaguccaggccauuaucaaugcgcugcaggaaucugggcggaccuauacagcuaacgacaugaagggaaucgagaccuuuacagaaguucuccgcgccggcuucuaccugggguauuacaaugauggacugagcuaccucaacgacagaaauuuucaggauaagugcauucccgccaugaucgcuauucagaaaaacccuaauuucaagcugggcaccgccgugcaagacgaggugaucacgucccuuggcaaacugauugggaacgcuagcgccaacgcggaggucgugaauaacuguguuccggugcucaagcaguuucgggaaaaucugaaccaguaugcccccgauuacgucaaaggaaccgcugugaaugagcuuaucaagggcauugaguucgacuuuucuggggccgcuuaugaaaaggauguuaaaacaaugccuugguacggaaagaucgaccccuucaucaacgagcugaaagcccucggccuguaugggaauauuaccuccgcgacagaaugggccagcgaugugggaaucuacuaucugucuaaguucggccucuacuccaccaaccgcaaugacauuguccaaagccuggagaaagcuguggauauguacaaguauggcaaaaucgccuuuguggcuauggaaagaauuacgugggacuacgacgggaucggaucuaacggcaagaaggucgaucacgacaaauuccuugaugacgccgagaagcauuaucugccuaaaacauacaccuuugauaaugggacauucaucauucgggccggagacaagguuuccgaagagaaaaucaagcgccucuauugggcuagcagagaggugaagucccaguuucaccggguggucggcaacgauaaagcgcuggaaguggggaaugccgacgauguucuuaccaugaagauuuucaacucucccgaggaauacaaauuuaauaccaacaucaacggagugagcacagacaauggcggccuguauauugagccucgcgggacguucuacaccuacgaaagaacaccgcagcaguccaucuuuagccucgaggagcuguuccggcaugaauauacccacuaccugcaagcucgcuaucucgucgauggacuguggggccaggggcccuuuuacgagaagaacagacuuacaugguucgacgaaggaaccgccgaguuuuucgccggcucuacgcggacauccggggugcugccucgcaaaagcauccucggcuaucuggcuaaggacaagguugaucauagauacucucuuaaaaagacccugaauagcggauaugacgauuccgacuggauguucuacaacuacggcuuugccguggcgcacuaucucuacgaaaaagauaugcccaccuucauuaagaugaauaaagcuauccugaacacagacgucaagucuuaugaugagauuaucaagaaacugagcgacgaugccaauaagaacaccgaguaccagaaucacauucaagaacucgccgacaaauaucagggggcuggaaucccucugguguccgaugacuaccuuaaggaucauggcuauaaaaaggccagcgaggucuacucugaaauuuccaaagcugccagccugacaaacacgucugugaccgcggagaagucccaguacuuuaauacauucacccuccgggggacauauaccggagagacgagcaagggcgaauuuaaagacugggacgagauguccaagaaacuggaugggacccuggaaucucuugccaagaacagcugguccggcuacaaaacacucaccgcuuauuucacaaauuacagaguuaccucugacaacaaggugcaguaugaugucguguuucacggaguucugacggacaaugccgauaucagcaacaacaaggcucccaucgccaaagugacaggcccguccaccggggcggucggacgcaauauugaguucagcggcaaggacucuaaagaugaagacgggaagaucguguccuacgauugggacuuuggagauggcgccacaagccgggggaaaaacucugugcaugcuuauaagaaggccggcaccuacaauguuacccugaaagucacagacgauaagggagcuacggccaccgaguccuucacaauugagaucaaaaacgaagacaccacaaccccuauuacgaaggagauggaacccaaugacgauaucaaagaggccaacggcccuaucguggaaggggugacagucaagggagaccucaauggcagcgaugacgcugauaccuuuuacuucgacgugaaggaggauggggacguuaccauugagcugcccuauucuggaagcuccaacuuuacauggcuuguguacaaagaaggcgaugaccaaaaucacaucgcgagcgggauugauaagaacaauucuaaagucggcaccuucaaguccacaaaaggaagacacuauguguucaucuacaagcaugacagcgccuccaacauuucuuauagccugaauaucaaaggccucgggaacgagaagcugaaggaaaaagagaauaacgacuccucugauaaggcuacgguuauccccaacuuuaauaccacaaugcagggaagccugcuuggcgacgauucccgcgacuacuauucuuucgaagugaaagaggagggggaagucaacauugagcucgauaagaaagacgaauuuggagugaccuggacacugcacccugagagcaauaucaacgaucggauuaccuacggccagguugacggcaauaagguguccaacaaggucaaacugagaccggggaaguacuaucuccugguguacaaauauagcggaucuggcaauuacgagcuucgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3066 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt5)
ggggcgcugccuacggagguggcagccaucuccuucucggcaucaagcuuaccaugaagugggugaccuucaucagccugcucuuucuguucuccucugccuacagcaugaaaaagaacauucuuaaaauccugauggacuccuauucuaaggagagcaaaauucagacagucagacggguuacguccgugucucuccuggcuguguaccuuaccaugaauacaagcucccugguccucgccaagcccaucgaaaacaccaaugauacaagcauuaagaacguggagaaacugcgcaaugcgccuaacgaagaaaauucuaagaaaguugaagacuccaagaacgauaaaguggagcacgucaagaauaucgaggaagcuaagguggagcaaguugccccggaagugaaaagcaagucuacccugagauccgccagccggcgcagacggaaacgcaucgcuaacacaaauucugagaaguaugacuuugaguaccucaacggccuguccuauaccgaacuuacgaaucugauuaaaaacaucaaguggaaucagauuaacggacucuucaacuacagcaccggaucccagaaauuuuucggcgauaagaauagaguccaggccaucauuaacgcucugcaagagucugggcggacauauaccgccaaugacaugaagggaaucgaaacauuuaccgaggugcuucgcgcgggcuucuaccugggguacuauaacgauggacucagcuaccugaaugacagaaacuuucaggauaaaugcauucccgccaugaucgcuauccagaagaauccuaacuucaaacugggcacggccgugcaggacgaagucauuacaucccucggcaagcugaucgggaaugcuagcgccaacgcggagguugugaauaacugugugcccguccuuaaacaauuucgggagaaucugaaccaguaugccccugauuacgugaagggaaccgcuguuaaugaacucauuaagggcaucgaguucgacuuuucuggggccgcuuaugaaaaagaugugaagacaaugcccugguacggaaaaauugacccuuucaucaacgagcugaaggcccuuggccuguaugggaacaucaccuccgccaccgaaugggcuagcgacgucggaauuuacuaccucucuaaauucggccuguauagcacaaaucgcaacgauaucgugcagucccuggagaaggcgguugacauguacaaguauggcaaaauugccuuuguggcuauggagagaaucacgugggauuacgacgggauuggaucuaauggcaagaaagucgaucaugacaaguuccucgaugacgccgaaaaacacuaucugccgaagaccuacacauuugauaacgggaccuucaucauccgggccggagacaaggugagcgaggaaaagauuaagcgccuuuauugggcuuccagagaggucaaaagccaguuucaucgggugguuggcaaugauaaggcccuggaaguggggaacgcggacgacguccucacaaugaaaaucuucaauucucccgaggaguacaaguuuaacaccaauauuaacggaguguccacggauaauggcggccuguacaucgaaccuagagggacauucuauaccuacgagcgcacaccccaacagagcauuuuuagccuugaggagcuguuccggcacgaguauacccauuaccuccaggcuagauaucugguugacggacuguggggccaagggccuuuuuacgagaaaaaccgccucaccugguucgaugaaggaacagccgaauuuuucgccggcuccacgcggaccagcggggugcugcccagaaaguccauccuuggcuaucuggcuaaggacaaagucgaucaccgcuacucucucaagaaaacacugaauagcggauacgacgauuccgacuggauguucuauaacuacggcuuugccguggcucacuaucuguacgagaaggauaugccgaccuucauuaaaaugaauaaggccauccuuaacacagacgugaagucuuaugaugaaaucauuaaaaagcucagcgacgaugcgaacaaaaauaccgaguaccagaaccauauccaggagcuggccgacaaguaucagggggcugggauuccucugguuuccgacgauuaccucaaagaccacggcuacaagaaggccagcgaagucuauucugagaucuccaaagcugccagccugacgaauaccucugugacagcggaaaagucccaauacuuuaacaccuucacacuucgggggaccuauacgggagagacaagcaaaggcgaauuuaaggauugggacgagaugucuaaaaagcuggaugggacccucgagagccuggccaaaaauuccuggagcggcuacaaaacacugaccgcuuauuucaccaacuacagagugacaucugacaauaagguccaguaugaugugguuuuucauggagugcuuacggacaacgccgauauuuccaauaacaaagcucccaucgccaaggucaccggcccuagcacaggggccgugggacgcaauaucgaguucuccggcaaagacucuaaggaugaagacgggaaaauuguuagcuacgauugggacuuuggagacggcgcuaccucccgggggaagaacucugugcacgcguacaagaaagccggcacauauaaugucacccucaaggugacggaugacaaaggagcuacagccaccgaaucuuucaccaucgagauuaagaacgaagauacaaccacacccaucacgaaagagauggagcccaaugacgauauuaaggaagccaacggcccuaucguugagggggugaccgucaagggagaccugaacggcuccgaugacgcugauacauuuuacuucgacgugaaagaagauggggacgugaccaucgagcugccguauucuggaagcuccaauuuuacauggcucgucuacaaggagggcgacgaucagaaccacauugccagcgggaucgacaaaaauaacucuaagguuggcaccuucaaauccacgaagggaagacauuauguguucauuuacaagcacgauagcgcgucuaauaucuccuauagccugaacauuaaaggccuugggaaugaaaagcugaaagagaaggaaaacaaugacucuuccgauaaagcuaccgugauccccaacuuuaauacaaccaugcagggaagccuccugggcgacgauucccgcgacuacuacagcuucgaggucaaggaagagggggaggugaacaucgaacuggauaagaaagacgaguuuggaguuacauggacccuucauccugaaucuaauauuaacgaucggaucacauauggccaaguggacggcaauaaggucagcaacaaagugaagcucagacccgggaaauacuaucugcugguuuacaaguauuccggaucuggcaauuacgagcuccgggugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3067 - RNA, 3487 nt, Artificial Sequence
  mRNA product Design2 comprising derived and/or modified sequence from Clostridium histolyticum__BAA34542.1__ColH (opt5)
ggggcgcugccuacggagguggcagccaucuccuucucggcaucaagcuuaccaugaacuuccugaagaucauucucaauagaggcaaaaccaugaagcggaaaugccugagcaagcgccuuaugcuggccaucacaauggcuacgauuuuuaccgugaacuccacacuccccaucuacgccgcggucgacaaaaauaacgcuaccgccgccguucagaaugagucuaagagauauacagugagcuaccugaagacccuuaacuauuacgaucugguggaccuccuggucaaaacagaaauugagaaucugccugaucucuuccaauauuccucugacgcuaaggaauuuuacgggaacaaaacccggaugagcuucaucauggaugagaucggacgcagagccccgcaguauacggaaauugaccacaagggcauccccacccugguggagguugugcgggcuggguuuuaccuuggauuccauaauaaagagcugaacgaaauuaauaagcgcuccuuuaaggagagagucaucccuucuauucucgccauccagaaaaaccccaauuucaagcugggcacagaagugcaggauaaaauuguuagcgcgaccgggcuucuggccggaaacgagacagcuccucccgagguggucaauaacuuuaccccuauccuccaagacuguaucaagaacauugaucgguacgcccuggacgaucugaaauccaaggcucucuucaaugugcuggccgcgccgacguaugacaucacagaauaccuucgcgccaccaaagagaagcccgaaaacacaccuugguauggcaagauugauggcuuuaucaaugagcugaaaaagcucgcucuguacgggaaaauuaacgacaauaacagcuggaucaucgacaauggaauuuaucacaucgcuccccuuggcaagcugcauucuaacaauaaaauugggaucgaaacccucaccgaggugaugaaggucuacccuuaucuguccaugcagcaccuucagagcgccgaucagauuaagagacauuacgacucuaaagaugccgagggaaacaagaucccccucgacaaauucaagaaagaaggcaaggagaaguacugcccgaaaacauauacguuugaugacgggaagguuaucauuaaagccggagcucggguggaagaggaaaaggugaaacgccuguacugggcguccaaggaggucaauagccaauucuucagaguguauggcaucgauaagccucuugaggaaggcaaccccgacgauauucugaccaugguuaucuacaauucuccugaggaauauaaacucaacuccgugcuguacggguaugacacaaauaacggaggcauguacauugagcccgaagggaccuuuuucacauacgagcgggaggcccaggaaagcaccuauacgcuugaggaacuguuucgccacgaguacacacacuaucuccagggaagauacgcuguccccggccagugggggcggaccaagcuguaugauaacgacagacugaccugguacgaggaaggaggcgccgaacucuucgccggcuccacacgcaccucugggauccugccucggaaaagcauuguguccaauauccauaacacaacgagaaauaaccgcuauaagcugagcgacaccguucacucuaaauacggagcuuccuuugaguucuacaauuaugccuguauguuuauggauuacauguauaacaaggacaugggcauccugaauaaacucaacgaucuggcgaagaauaacgacguggauggguacgacaauuauauucgggaucugagcucuaacuacgcucuuaaugacaaguaucaagaucauaugcaggagagaaucgacaacuacgaaaaucucacagucccguucguggccgaugacuaccugguccgccacgccuauaaaaaccccaacgagauuuacagcgagaucuccgaaguggcuaagcugaaagaugccaagucugagguuaaaaagagccaguauuuuuccaccuucacacuccggggaagcuacaccggcggggcuucuaagggcaaacuggaagaccaaaaggccaugaauaaauuuauugacgauucccuuaagaaacuggacacguauagcuggucuggauacaagacccucacagcguauuucaccaacuacaagguggauuccagcaauagagucacauacgacgugguuuuucacggcuaucugccuaacgagggggauuccaaaaauucucugcccuacggaaagaucaacggcaccuauaaagggacggaaaaggagaaaaucaaguucagcuccgagggaucuuucgacccugauggcaagauugugagcuacgaaugggacuuuggggauggcaauaaauccaacgaggaaaaucccgagcauagcuaugacaaggucggaacauacaccgugaaacuuaaggugacagaugacaaaggcgaaucuuccguuagcaccaccacagccgagaucaaggaucucucugagaacaaacugccggucauuuauaugcacgugccuaaguccggggcucugaaucagaagguggucuucuacggaaaaggcacguacgaccccgacgggagcaucgccggauaucagugggauuuuggcgacgggucugauuucagcuccgaacagaacccuagccauguguacaccaagaaaggcgaguauacaguuacccuccgcgugauggacucuuccggacaaaugagcgaaaagacaaugaaaauuaagaucaccgaucccgucuacccuaucggcacggagaaggagcccaauaacuccaaagaaacagcuucugggccgauugugccuggaauccccguuagcggcaccauugagaauaccuccgaccaggauuauuuuuacuucgacgugaucacacccggggaagucaagauugauaucaacaaacugggauauggcggggccaccugggugguuuacgacgagaacaauaacgcggugucuuacgccacagaugacggccagaaucuuagcggaaaguuuaaagcugacaagccuggccgguauuacauccaccuguauauguucaacggguccuacaugccguauagaauuaauaucgaaggaucugucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3068 - RNA, 3448 nt, Artificial Sequence
  mRNA product Design2 comprising derived and/or modified sequence from Clostridium histolyticum__BAA34542.1__ColH (opt5)
ggggcgcugccuacggagguggcagccaucuccuucucggcaucaagcuuaccaugaagagaaaaugccugagcaagcggcucaugcuggccaucaccauggcuacaauuuucacggugaacuccacccuucccaucuacgccgcggucgacaaaaauaacgcuacagccgccguucagaaugagucuaagcgcuauaccgugagcuaccugaaaacacucaacuauuacgaucugguggaccuucuggucaagaccgaaauugagaaucucccugaucuguuucaauauuccucugacgcuaaggaguucuacggcaacaaaacaagaaugagcuuuaucauggaugaaauugggcggcgcgccccgcaguauaccgaaaucgaccacaagggaauccccacgcugguggagguugugagagcuggcuucuaccucggguuucauaauaaagagcugaacgaaauuaauaagcgguccuucaaagagcgcgucaucccuucuauucuugccauccagaagaaccccaauuuuaagcugggaaccgaagugcaggauaaaauuguuagcgcgacaggccuccuggccgggaacgagaccgcuccucccgagguggucaauaacuucacaccuauccuucaagacuguauuaagaauaucgauagauacgcccuggacgaucucaaauccaaggcucuguuuaacgugcuggccgcgccgaccuaugacaucacggaauaccuccgggccacaaaagagaagcccgaaaacaccccuugguauggaaaaauugauggcuucaucaaugagcugaagaaacuugcucuguacggcaagauuaacgacaauaacagcuggaucauugacaaugggaucuaucacaucgcuccccucggaaagcugcauucuaacaauaaaauuggcaucgaaacacuuaccgaggugaugaaggucuacccuuaucuguccaugcagcaccuccagagcgccgaucagauuaaacgccauuacgacucuaaggaugccgaggggaacaagaucccccuggacaaauuuaagaaagaaggaaaggagaaauacugcccgaagaccuauacauucgaugacggcaagguuauuaucaaagccggggcuagaguggaagaggaaaaggugaaacggcuguacugggcguccaaggaggucaauagccaauuuuuccgcguguauggaaucgauaaaccucucgaggaaggcaaccccgacgauauucugacgaugguuaucuacaauucuccugaggaauauaaacuuaacuccgugcuguacggcuaugacaccaauaacgggggaauguacauugagcccgaaggcacauucuuuaccuacgagagagaggcccaggaaagcacauauacccucgaggaacuguuccggcacgaguacacgcacuaucuucaggggcgcuacgcuguccccggacaguggggcagaacaaagcuguaugauaaugaccggcucaccugguacgaggaagggggagccgagcuguuugccggcuccaccagaacaucuggcauccugccucgcaagagcauuguguccaacauccauaacaccacacggaauaacagauauaagcucagcgacacgguucacucuaaauacggggcuuccuucgaauuuuacaauuaugccuguauguucauggauuacauguauaacaaggacaugggcauucugaauaaacuuaacgaucuggcgaagaauaacgacguggauggauacgacaauuauauccgcgaucucagcucuaacuacgcucugaaugacaaauaucaagaucauaugcaggagcggaucgacaacuacgaaaaucugaccgucccguuuguggccgaugacuaccuugucagacacgccuauaagaaccccaaugagauuuacagcgagaucuccgaaguggcuaagcucaaagaugccaagucugagguuaaaaagagccaguauuucuccacauuuacccugcgcgggagcuacacaggaggcgcuucuaaagggaagcuggaagaccaaaaggccaugaacaaauucauugacgauucccucaagaaacuggacaccuauagcuggucuggcuacaagacgcuuaccgcguauuuuacaaacuacaaaguggauuccagcaaucgggucaccuacgacgugguuuuccacggauaucugccuaacgagggcgauuccaaaaauucucuccccuacgggaagaucaacggaacauauaagggcaccgaaaaggagaaaauuaaguuuagcuccgaggggucuuucgacccugauggaaaaaucgugagcuacgaaugggacuucggcgaugggaauaaguccaacgaggaaaaucccgagcauagcuaugacaaggucggcacguacacagugaaacugaaggugaccgaugacaaaggagaaucuuccguuagcacaaccaccgccgagaucaaggaucugucugagaacaaacuuccggucauuuauaugcacgugccuaaguccggcgcucucaaucagaaaguggucuuuuacgggaagggaacauacgaccccgacggcagcaucgccggguaucagugggauuucggagacggcucugauuuuagcuccgaacagaacccuagccauguguacacgaagaaaggggaguauaccguuacacugagagugauggacucuuccggccaaaugagcgaaaagaccaugaaaauuaagaucacagaucccgucuacccuauuggaaccgagaaagagcccaauaacuccaaggaaacggcuucuggcccgaucgugccugggauccccguuagcggaacaauugagaauaccuccgaccaggauuauuucuacuuugacgugaucacccccggcgaagucaagauugauaucaacaaacugggguauggaggcgccacaugggugguuuacgacgagaauaacaacgcggugucuuacgccaccgaugacgggcagaaucucagcggcaaguucaaagcugacaagccuggacgcuauuacauucaccuguauauguuuaacggcuccuacaugccguaucggaucaauaucgaagggucugucggaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3069 - RNA, 3382 nt, Artificial Sequence
  mRNA product Design2 comprising derived and/or modified sequence from Clostridium histolyticum__BAA34542.1__HsALB(1-18)_ColH(41-1021) (opt5)
ggggcgcugccuacggagguggcagccaucuccuucucggcaucaagcuuaccaugaagugggugaccuucaucagccugcucuuucuguucuccucugccuacagcguccagaacgaguccaaaagauauacaguuucuuaccuuaagacgcugaauuauuacgaccucguggaucugcuugugaaaaccgaaauugagaaccugcccgaccucuuucaauauagcuccgaugcuaaggaguucuacggcaauaaaacacggaugucuuuuaucauggacgaaauugggcgcagagccccucaguauaccgaaaucgaucacaagggcauuccgacacuggucgaggugguucgggcgggauucuaccugggguuucauaacaaggagcucaaugaaaucaacaaacgcagcuucaaggagagagugauccccuccauucuggcuauccagaaaaauccuaacuuuaagcugggaaccgaaguccaggacaaaauugugagcgccacaggccugcucgccgggaaugagaccgcucccccugagguugugaacaauuucacgcccauccugcaagauugcauuaagaacaucgaccgguacgcccuugaugaccugaagucuaaagcucucuuuaauguccuggccgcgccuaccuaugauauuacagaauaccugcgcgccaccaaggagaaaccggaaaacacacccugguauggaaagaucgacggcuucaucaaugagcucaaaaagcuggcucuuuacggcaaaauuaacgauaacaauuccuggaucauugacaacgggaucuaucacauugccccucugggaaagcuccauagcaauaacaagaucggcaucgaaacccugacggaggugaugaaaguguaccccuaucuuucuaugcagcaccuucaguccgcugaccagauuaagagacauuacgauagcaaagacgccgaggggaauaagaucccucucgauaaauuuaagaaggaaggaaaagagaaguacugucccaaaacauauaccuucgacgauggcaaggucauuaucaaagcgggggcccggguugaagaggaaaaggugaagcgccuguacugggcuucuaaagaggugaacucccaauucuuuagagucuauggaauugacaagccgcuggaggaaggcaauccugaugacauccucacaauggugaucuacaacagccccgaggaauauaaacuuaauuccguucuuuacggcuaugauaccaacaaugggggaauguacauugagccugaaggcaccuucuuuacauacgagcgggaggcccaggaaucuacguauacccuggaggaacucuuccgccacgaguacacacacuaucugcaggggagauacgcugugcccggacaguggggccggaccaagcuguaugacaacgaucgccugacaugguacgaggaagggggagccgagcucuuugccggcagcaccagaacguccggcauccugccccggaaaagcauugucucuaauauccauaacacaaccagaaauaaccgcuauaagcuguccgacaccgugcacagcaaguacggggcuucuuucgaauuuuacaacuaugcgugcauguucauggacuacauguauaauaaagauaugggcauucucaacaagcugaaugaccuugccaaaaacaaugauguugacggauacgauaacuauauccgggaccugagcuccaauuacgcucucaacgauaaguaucaagaccauaugcaggagagaauugauaauuacgaaaaccugacagugccuuuugucgccgacgauuaccuggugcgccacgccuauaaaaauccgaacgagaucuacucugagaucagcgaagucgcuaaacuuaaggacgccaaguccgaggugaagaaaagccaguauuucucuaccuuuacacuccggggguccuacacgggaggcgcgagcaaggggaaacuggaagaucaaaaggcuaugaauaaauucauugacgacucucugaagaagcucgauaccuauuccuggagcggcuacaaaacacugaccgccuauuuuacaaacuacaagguugacuccucuaauagagugaccuacgaugucguguuccacggauaucuucccaacgagggcgacagcaaaaacucccugccuuacgggaagaucaauggaacguauaaaggcaccgaaaaggagaagauuaaauucucuagcgagggguccuuugaucccgacggaaagaucguuagcuacgaaugggauuucggcgacgggaacaaaucuaaugaggaaaacccugagcauuccuaugauaaggugggcacauacaccgucaaacucaaggugacagacgauaagggagaaagcucuguguccaccacgacagccgagauuaaagaccugagcgagaauaagcugcccguuaucuauaugcacgucccgaaaucuggcgcucuuaaccagaaggugguguuuuacgggaaaggaaccuacgauccugacggcagcaucgccggguaucagugggacuucggagauggcuccgacuuuagcucugaacagaaucccucccaugucuacacaaagaaaggggaguauaccgugacccuccgcguuauggauagcuccggccaaaugucugaaaagacaaugaagauuaaaaucacggacccuguguaccccauuggaaccgagaaggagccuaacaauagcaaagaaacagcuuccggccccaucgucccggggauuccugugucuggaaccaucgagaacacaagcgaucaggacuauuucuacuuugauguuaucacccccggcgaagugaagauugacaucaauaaacugggguauggaggcgccacgugggucguguacgaugagaacaauaacgcgguuuccuacgccacagacgaugggcagaaucugucuggcaaguucaaggcugacaaacccggacgguauuacauucaccucuauauguuuaacggcagcuacaugccuuauagaaucaacauugaaggguccgugggacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3070 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt5)
ggggcgcugccuacggagguggcagccaucuccuucucggcaucaagcuuaccaugaagugggugaccuucaucagccugcucuuucuguucuccucugccuacagcaugaaaagaaagugccuuuccaaacggcugaugcucgcuauuacaauggccacgaucuuuaccgucaacucuacacugcccauuuaugcggcuguugacaagaauaacgccaccgccgcucgcagacggcgcaaaagagugcagaaugagagcaagcgguacacaguguccuaucuuaagacccugaacuacuaugaucucgucgaccugcuggugaaaacagaaaucgagaaucucccugaucuguuccaauacucuagcgacgccaaggaauuuuauggcaacaaaacccgcauguccuucauuauggaugagaucgggagacgggcuccgcaguacacggaaaucgaccacaagggcauucccacccuuguugaggugguccgcgccggauuuuaccugggguuccauaauaaagagcucaacgaaaucaauaagagauccuuuaaggagcgggugauuccuucuauccuggcgauucagaaaaaccccaauuucaaacuuggaacagaaguucaggauaagaucguguccgccaccggccugcucgcugggaacgagacagccccucccgaggucgugaauaacuuuaccccuauucugcaagacuguaucaagaauaucgaucgcuaugcucuggacgaucucaaaagcaaggcccuguucaacgugcuugcggccccgacguacgacauuacagaauaucugagagcuaccaaagagaagcccgaaaacacaccuugguacggaaagaucgauggcuuuauuaaugagcucaaaaagcuggcccuuuauggcaaaaucaacgacaauaacucuuggauuaucgacaaugggaucuaccacauugcuccccugggaaagcuccauuccaacaauaaaaucggcauugaaacccugaccgaggucaugaagguuuauccuuaccugagcaugcagcaccuccagucugccgaucagaucaagcggcauuacgacuccaaagaugccgaggggaacaagauuccccuggacaaauucaagaaagaaggaaaggagaaguauugcccgaaaacauacacguucgaugacggcaaggugaucaucaaagcuggggcgcgcguggaagaggaaaaggucaaaagacuuuauugggccagcaaggaggugaauagccaauuuuuccggguuuacggaauugauaagccucuggaggaaggcaaccccgacgauauccucaccauggugauuuauaauucuccugaggaauacaaacugaacagcguccuuuauggcuacgacacaaauaacgggggaauguacaucgagcccgaaggcaccuuuuucacauaugagagagaggcucaggaauccaccuacacgcuggaggaacucuuucgccacgaguauacacacuaccugcaggggcgguaugccgugcccggacaguggggcagaaccaagcuguacgauaaugaccgccucaccugguaugaggaagggggagccgagcuguucgcuggcagcacacggaccucuggcauucuuccuagaaaauccaucguuagcaacauucauaacacaacgcgcaauaaccgguacaagcugucugacaccgugcacagcaaauacggggccuccuuugaguucuauaauuacgcguguauguuuauggauuauauguacaacaaggacaugggaauccucaauaaacugaacgaucuggcuaagaauaacgacgucgauggcuaugacaauuacaucagagaucuuucuagcaacuaugcccucaaugacaaguaccaagaucauaugcaggaacgcauugacaacuacgaaaaucugacagugccguucgucgccgaugacuaucuggugcggcacgcuuacaaaaaccccaaugagaucuauuccgagauuagcgaaguugccaagcucaaagaugcuaagucugaggugaaaaagucccaguacuuuagcaccuucacacugagagggucuuauaccggaggcgccuccaaggggaaacuugaagaccaaaaggcgaugaacaaauuuaucgacgauagccugaagaaacucgacacguacuccuggucuggcuauaagacccugacagccuacuucaccaacuacaaggucgauagcuccaaucgcgugacauaugacguuguguuccacggauaccugccuaacgagggcgauucuaaaaauagccuucccuaugggaagauuaacggaaccuacaaaggcacggaaaaggagaaaaucaaguuuuccagcgaggggucuuucgacccugauggaaagaucgucuccuaugaaugggacuuuggcgaugggaauaaaagcaacgaggaaaaucccgagcauucuuacgacaaggugggcacauauaccgugaaacucaagguuacagaugacaaaggagaauccagcgucucuaccaccacagcugagauuaaggaucugagcgagaacaaacugccggugaucuacaugcacgugccuaaguccggcgcccucaaucagaaggucguguucuacgggaaaggaacguaugaccccgacggcagcauugcuggguaccagugggauuuuggagacggcucugauuucuccagcgaacagaacccuucccauguuuauaccaagaaaggggaguacacagugacccugcgggucauggacucuagcggccaaauguccgaaaagacaaugaaaaucaagauuaccgaucccguguauccuaucggaacggagaaggagcccaauaacucuaaagaaacagccagcggcccgaucguuccugggauucccguguccggaaccaucgagaauaccucugaccaggauuacuuuuauuucgacgucauuacacccggcgaagugaagaucgauauuaacaaacuuggguacggaggcgcgaccuggguuguguacgacgagaauaacaacgccgucagcuaugcuacagaugacgggcagaaucuguccggcaaguuuaaagccgacaagccuggaagauacuauauccaccucuacauguucaacggcagcuauaugccguaccggaucaauauugaagggucugugggacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3071 - RNA, 958 nt, Artificial Sequence
  mRNA product Design2 comprising derived and/or modified sequence from Homo sapiens__NP_001133.1__HsAMELX (opt5)
ggggcgcugccuacggagguggcagccaucuccuucucggcaucaagcuuaccaugggcaccuggauccuguucgccugccuccugggggcugccuuugcgaugccccuuccuccgcaccccggacauccuggcuacauuaacuucagcuaugaggugcugacaccccucaagugguaccaguccaucagaccucccuauccuucuuacggguaugaaccgaugggaggcuggcugcaccaucaaauuauccccguccuuagccagcagcacccucccacgcauacccugcagccucaccaccauauucccguugugccggcucaacagccugugaucccccagcagccuaugaugcccguccccgggcaacacuccaugacaccuauccagcaucaccagccgaaucugcccccucccgcccagcaaccuuaccagccccagccggugcaaccucagccccaccagccuaugcagccccaaccucccguucauccgaugcagccucucccuccccagcccccgcugcccccuauguuucccaugcagccucugcccccuaugcuccccgaccuuacccuggaggccuggccgucuacagauaaaaccaagcgggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3072 - RNA, 517 nt, Artificial Sequence
  mRNA product Design2 comprising derived and/or modified sequence from Homo sapiens__NP_001133.1__HsAMELX-TRAP (opt5)
ggggcgcugccuacggagguggcagccaucuccuucucggcaucaagcuuaccaugccccugccuccgcaccccggccauccuggguacaucaacuucagcuaugaggugcucaccccucugaagugguaccaguccauuagaccucccuaucccucuuacggauaugaaccgaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3073 - RNA, 550 nt, Artificial Sequence
  mRNA product Design2 comprising derived and/or modified sequence from Homo sapiens__NP_001133.1__HsAMELX-LRAP (opt5)
ggggcgcugccuacggagguggcagccaucuccuucucggcaucaagcuuaccaugccccugccuccgcaccccggccauccuggguacaucaacuucagcuaugaggugcucacaccccugaagugguaccaguccauuagaccucccccuaugcuuccggaccugacccucgaagccuggcccucuacggauaaaaccaagcgggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3074 - RNA, 589 nt, Artificial Sequence
  mRNA product Design2 comprising derived and/or modified sequence from Homo sapiens__NP_001133.1__HLA-A2-SP_HsAMELX(17-60) (opt5)
ggggcgcugccuacggagguggcagccaucuccuucucggcaucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuauucggcccccuuauccgagcuacggcuaugaacccaugggaggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3075 - RNA, 622 nt, Artificial Sequence
  mRNA product Design2 comprising derived and/or modified sequence from Homo sapiens__NP_001133.1__HLA-A2-SP_HsAMELX(17-47,168-191) (opt5)
ggggcgcugccuacggagguggcagccaucuccuucucggcaucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuauucggcccccuccgaugcuccccgaccugacacuggaagccuggccuagcaccgauaaaacaaagcgcgaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3076 - RNA, 961 nt, Artificial Sequence
  mRNA product Design2 comprising derived and/or modified sequence from Homo sapiens__NP_001134.1__HsAMELY (opt5)
ggggcgcugccuacggagguggcagccaucuccuucucggcaucaagcuuaccaugggcaccuggauccuguucgccugccucgugggggcugccuuugcgaugccccugccuccgcaccccggacauccuggcuacauuaacuucagcuaugagguccuuacaccccugaagugguaccaguccaugaucagaccucccuauucuagcuacggguaugaaccuaugggaggcuggcuccaccaucaaauuaucccgguugugucccagcagcacccccugacgcauacccuucagucucaccaccauauuccugugguccccgcucaacagccucgggugcgccagcaggcccugaugcccguuccggggcaacagagcaugacaccuacccagcaccaucagcccaaucucccucugcccgcccaacagcccuuucagccucaaccggugcagccccagccucaccagcccaugcaaccucagcccccgguccagccuaugcagccccugcucccucaacccccucugcccccgauguucccucuuagaccccugcccccuauccucccggaccugcaccuugaggcuuggcccgccacagauaaaaccaagcaggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3077 - RNA, 520 nt, Artificial Sequence
  mRNA product Design2 comprising derived and/or modified sequence from Homo sapiens__NP_001134.1__HsAMELY-TRAP (opt5)
ggggcgcugccuacggagguggcagccaucuccuucucggcaucaagcuuaccaugccccugccuccgcaccccggccauccuggguacaucaacuucagcuaugaggugcucaccccucugaagugguaccaguccaugauuagaccucccuauucuagcuacggauaugaacccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3078 - RNA, 553 nt, Artificial Sequence
  mRNA product Design2 comprising derived and/or modified sequence from Homo sapiens__NP_001134.1__HsAMELY-LRAP (opt5)
ggggcgcugccuacggagguggcagccaucuccuucucggcaucaagcuuaccaugccccugccuccgcaccccggccauccuggguacaucaacuucagcuaugaggugcucacaccccugaagugguaccaguccaugauuagaccucccccuauccuuccggaccugcaccucgaagccuggcccgcuaccgauaaaacgaagcaagaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3079 - RNA, 592 nt, Artificial Sequence
  mRNA product Design2 comprising derived and/or modified sequence from Homo sapiens__NP_001134.1__HLA-A2-SP_HsAMELY(17-61) (opt5)
ggggcgcugccuacggagguggcagccaucuccuucucggcaucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuaugauucggcccccuuauagcuccuacggcuaugaaccgaugggaggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3080 - RNA, 625 nt, Artificial Sequence
  mRNA product Design2 comprising derived and/or modified sequence from Homo sapiens__NP_001134.1__HLA-A2-SP_HsAMELY(17-48,169-192) (opt5)
ggggcgcugccuacggagguggcagccaucuccuucucggcaucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuaugauucggcccccuccgauccuccccgaccugcaccuggaagccuggccugccacagauaaaaccaagcaggaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3081 - RNA, 952 nt, Artificial Sequence
  mRNA product Design2 comprising derived and/or modified sequence from Sus scrofa__NP_999071.1__SsAMELX-001-1 (opt5)
ggggcgcugccuacggagguggcagccaucuccuucucggcaucaagcuuaccaugggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuuauacgucuuacggguaugaacccaugggaggcuggcugcaucaccaaauuaucccugucguuagccagcagaccccgcagucccaugcgcuucaaccccaccaccauauuccuauggugcccgcucagcagccugggaucccccagcaaccgaugaugccucugcccggacagcacucuaugacaccuacccagcaucaccagcccaaccucccccugccugcccaacagccguuucagccccaaccugugcagccccagccucaccagccccugcaaccgcagagcccuaugcaucccauccagccucuccugccccagccuccccuuccgccuauguucuccaugcaaucucugcuccccgaccugccccuugaggccuggccugcuacagauaaaaccaagcgggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3082 - RNA, 520 nt, Artificial Sequence
  mRNA product Design2 comprising derived and/or modified sequence from Sus scrofa__NP_999071.1__SsAMELX-TRAP (opt5)
ggggcgcugccuacggagguggcagccaucuccuucucggcaucaagcuuaccaugccccugccuccgcaccccggccauccuggguacaucaacuucagcuaugaggugcucacaccccugaagugguaccagaauaugauuagacacccuuauaccuccuacggauaugaacccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3083 - RNA, 553 nt, Artificial Sequence
  mRNA product Design2 comprising derived and/or modified sequence from Sus scrofa__NP_999071.1__SsAMELX-LRAP (opt5)
ggggcgcugccuacggagguggcagccaucuccuucucggcaucaagcuuaccaugccccugccuccgcaccccggccauccuggguacaucaacuucagcuaugaggugcucacaccccugaagugguaccagaauaugauuagacacccuucccuucugcccgaccucccucuggaagccuggccggcuaccgauaaaacgaagcgggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3084 - RNA, 592 nt, Artificial Sequence
  mRNA product Design2 comprising derived and/or modified sequence from Sus scrofa__NP_999071.1__HLA-A2-SP_SsAMEL(17-61) (opt5)
ggggcgcugccuacggagguggcagccaucuccuucucggcaucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaaauaugauucggcaccccuauacaucuuacggcuaugaaccuaugggaggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3085 - RNA, 625 nt, Artificial Sequence
  mRNA product Design2 comprising derived and/or modified sequence from Sus scrofa__NP_999071.1__HLA-A2-SP_SsAMEL(17-49,167-189) (opt5)
ggggcgcugccuacggagguggcagccaucuccuucucggcaucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaaauaugauucggcaccccucucuccugccugaccugccgcucgaagccuggcccgccacagauaaaaccaagcgcgaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3086 - RNA, 916 nt, Artificial Sequence
  mRNA product Design2 comprising derived and/or modified sequence from Sus scrofa__P45561-2__SsAMELX-001-2 (opt5)
ggggcgcugccuacggagguggcagccaucuccuucucggcaucaagcuuaccaugggcaccuggauccuguucgccugccuccugggggcugccuuuagcaugccccuuccuccgcaccccggacauccuggcuacauuaacuucuccuauaucagacaccccuacacaucuuauggguacgagccuaugggaggcuggcugcaucaccagauuauccccguggucagccaacagacgccucagucccaugcgcuccagccgcaccaccauauucccaugguuccugcucaacagcccgggaucccucagcagcccaugaugccgcugccuggacaacacucuaugacccccacacagcaucaccagccuaaucuuccccugcccgcccagcaaccuuuucagccgcagcccgugcaaccucagccccaccagccucuccagccccaaagcccgaugcauccuauccagccccugcugccucagcccccucugcccccgauguucuccaugcagucucuccuuccugaccugccccucgaagccuggcccgcuaccgauaagacaaaacgggaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3087 - RNA, 952 nt, Artificial Sequence
  mRNA product Design2 comprising derived and/or modified sequence from Sus scrofa__NP_998965.1__SsAMELX-001-3 (opt5)
ggggcgcugccuacggagguggcagccaucuccuucucggcaucaagcuuaccaugggcaccuggaucuucuuugccugccugcucggggcuagccuggccaugccccuuccuccgcaccccggacauccuggcuacauuaacuucuccuaugaggugcugacaccccucaagugguaccagaauaugaucagacacccuuauacgucuuacggguaugaacccaugggaggcuggcugcaucaccaaauuaucccugucguuagccagcagaccccgcagucccaugcgcuucaaccccaccaccauauuccuauggugcccgcucagcagccugggaucccccagcaaccgaugaugccucugcccggacagcacucuaugacaccuacccagcaucaccagcccaaccucccccugccugcccaacagccguuucagccccaaccugugcagccccagccucaccagccccugcaaccgcagagcccuaugcaucccauccagccucuccugccccagccuccccuuccgccuauguucuccaugcaaucucugcuccccgaccugccccuugaggccuggccugcuacagauaaaaccaagcgggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3088 - RNA, 601 nt, Artificial Sequence
  mRNA product Design2 comprising derived and/or modified sequence from Sus scrofa__K7GPB2__SsAMELX-002 (opt5)
ggggcgcugccuacggagguggcagccaucuccuucucggcaucaagcuuaccaugggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuucucugcuucccgaccugccucucgaagcguggccggcuacggauaaaaccaagcgggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3089 - RNA, 994 nt, Artificial Sequence
  mRNA product Design2 comprising derived and/or modified sequence from Sus scrofa__K7GLD0__SsAMELX-003 (opt5)
ggggcgcugccuacggagguggcagccaucuccuucucggcaucaagcuuaccaugggcaccuggauccuguucgccugccuccugggggcugccuuuagcaugccccuuccuccgcaccccggacauccuggcuacauuaacuucuccuaugaggaccuguaccucgaagcgaucagaauugaucggacagcuuuugugcugacgccccuuaagugguaucagaauaugauccgccacccuuacaccucuuauggguacgagcccaugggaggcuggcugcaucaccaaauuaucccugucguuagccagcagacaccgcagucccaugcccuccaaccccaccaccauaucccuauggugcccgcccagcagccugggauuccccagcaaccgaugaugccucugcccggacagcacucuaugaccccuacacagcaucaccagcccaaccugccccucccugcucaacagccguuccagccccaaccugugcagccccagccucaccagccccugcaaccgcagagcccuaugcaucccauccagccucuucugccccagccuccccucccgccuauguuuuccaugcaaucucugcuucccgaccugccccucgaagccuggccugcuaccgauaaaacaaagagagaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3090 - RNA, 880 nt, Artificial Sequence
  mRNA product Design2 comprising derived and/or modified sequence from Sus scrofa__K7GPE9__SsAMELX-004 (opt5)
ggggcgcugccuacggagguggcagccaucuccuucucggcaucaagcuuaccaugggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuacgccccaaucucaugcgcugcagccucaccaucacauuccgaugguccccgcucagcagccugggaucccccaacagccuaugaugccccuuccgggacagcacagcaugaccccuacacagcaucaccaacccaaccugccucuccccgcccagcagcccuuucagccucaaccgguucagccccagccucaucaaccccugcagccucagucccccaugcacccgauucagccucugcucccccaaccuccccugccucccauguucucuaugcagagccuucugccggaccucccucuggaagccuggcccgcuaccgauaaaacaaagcgggaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3091 - RNA, 904 nt, Artificial Sequence
  mRNA product Design2 comprising derived and/or modified sequence from Sus scrofa__J9JIM4__SsAMELX-201 (opt5)
ggggcgcugccuacggagguggcagccaucuccuucucggcaucaagcuuaccaugccccugccuccgcaccccggccauccuggguacaucaacuucagcuaugaggugcucacaccccugaagugguaccagaauaugauuagacacccuuauaccuccuacggauaugaacccaugggcggguggcuucaucaccaaaucauuccugucguuucucagcagacgccgcagagccaugcccugcaaccccaccaccauaucccuauggugcccgcucagcagccuggcauuccccagcaaccgaugaugccucuccccggacagcacuccaugaccccuacacagcaucaccagcccaaccugccccuuccugcccaacagccguuucagccccaaccugugcagccccagccucaccagccccugcaaccgcagucuccuaugcaucccauccagccucuccugccccagccuccccugccgccuauguucagcaugcaaucccuccugcccgaccuuccccuggaggcguggccugcuaccgauaaaacaaagcgggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3092 - RNA, 3343 nt, Artificial Sequence
  mRNA product Design2 comprising derived and/or modified sequence from Homo sapiens__NP_006120.1__HsBMP1 (opt5)
ggggcgcugccuacggagguggcagccaucuccuucucggcaucaagcuuaccaugcccggcguggccagacugccucuccugcuugggcugcuccugcuuccgcggcccggacgcccucuggaccucgcugauuacaccuaugaccuggccgaggaagaugacagcgagccccugaacuacaaggauccuugcaaagcggcugccuuccucggcgacaucgcccuggaugaagaggaccuuagagcuuuucagguccaacaggccguugaucugcggcgccacacagcuagaaaguccucuauuaaagccgcggugcccgggaauacgagcaccccuuccugucagucuacaaacggacagccgcaacggggcgccugcgggcgcuggagaggacggagccgcuccagacgggcugccaccucucgccccgaaagaguguggccugacggcgucauccccuucgugauuggcgggaauuuuacaggaagccagcgggcuguuuuccgccaggccaugagacauugggagaagcacaccugugugacauuucucgagcggaccgaugaagacuccuauaucgucuucacguacagaccuugcggcuguugcagcuauguggggcgccggggaggcgggccccaggcgauuucuaucggaaagaacugugauaaguuuggcaucguugugcaugagcugggccacgucgugggguucuggcaugaacacaccagaccggaccgcgaccggcacguguccauugucagagagaauauccaaccuggacaggaguacaacuuucuuaagauggaaccccaggagguugaaagccugggcgagacauaugauuucgacucuauuaugcauuacgcccgcaauaccuuuucccgggggaucuuccucgauacaauugugccuaaauacgaagugaacggagucaagccucccaucggccagagaacccgccugagcaaaggggacauugcucaagcccggaagcuguauaaaugccccgcuuguggagagacgcuccaggauucuacaggcaauuuuuccagcccggaguaccccaacggcuauuccgcccacaugcauugcguguggagaaucucuguuaccccuggggaaaagaucauucugaauuucacaagccuugaccuguaccgcucccggcucuguugguaugauuacguggaggucagagacggauucuggcggaaggcuccccugcgcggcagauuuugcgggagcaaacuuccugaacccaucgugucuaccgauucccggcuguggguugaguucagaagcucuagcaacugggugggaaagggcuuuuucgccgucuaugaagcgauuugcgggggcgacgugaaaaaggauuacggacacauccaguccccgaauuacccugacgacuaucgccccucuaaagucuguauuuggcggauccaagugagcgagggcuuucacguugggcucaccuuccaguccuuugagaucgaaagacaugauagcugcgccuacgacuaucuggaggugcgcgauggacacucugaauccagcacacugauuggcagauacuguggguaugagaagccugacgauaucaaaucuacguccagccggcucuggcugaaguucgucuccgacggaucuauuaacaaggcuggcuuugccgugaauuucuuuaaagaaguugaugagugcagccgccccaacagagggggcugugagcagcggugccuuaacacccugggauccuacaaguguucuugcgacccuggcuaugaacucgcccccgauaaacgcagaugugaggcugccugcgggggauuccugacaaaacuuaauggcagcaucaccuccccgggguggccuaaagaauacccucccaacaagaauuguauuuggcagcugguggcgcccacacaauaccggaucagccuccaguuugacuucuucgagaccgagggaaacgaugucugcaaguaugacuuuguggaagugcgcucuggccugacggcugauuccaaacugcaugggaaguucugcggcagcgagaaaccggaaguuaucacaucucaguacaauaacaugagagucgaguuuaaguccgacaauaccgugagcaaaaagggauucaaggcccacuuuuucucugacaaagaugaauguagcaaggacaacggcgggugccagcaagauugugugaauaccuuuggauccuaugagugccagugucggagcggcuucguccuccaugacaacaaacacgauugcaaggaggccgggugugaccacaaagugacaucuaccuccggaacaauuacgagccccaauuggccugauaaguaccccuccaagaaagaaugcaccugggcuaucucuagcacaccuggccaucgcguuaagcugaccuuuauggagauggacauugaaucccagcccgagugugccuaugaucaccuugaaguguucgacgggagagaugcuaaagccccuguccugggccgguuuugcggaucuaagaaacccgagccggugcucgcgacaggcagcagaauguuccugcgcuuuuacuccgacaacucuguucagcggaagggguuccaagccagccaugcuaccgaguguggaggccaggugagagccgaugucaaaacgaaggaccuguauucccacgcucaguucggggacaauaacuacccuggaggcguggauugcgaauggguuaucguggccgaggaaggcuacggggucgagcuuguguuucagaccuucgaaguggaggaggaaacagacugcggauaugauuacauggagcucuuugacggcuaugauagcaccgcgccccgccuggggcgguacuguggaucuggcccucccgaagaggucuauuccgccggggacagcguucuggugaaguuccacucugaugacacaauuaccaaaaagggauuucaucucagauacacguccacaaaauuccaagauacccugcacagccgcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3093 - RNA, 1573 nt, Artificial Sequence
  mRNA product Design2 comprising derived and/or modified sequence from Homo sapiens__NP_001191.1__HsBMP2 (opt5)
ggggcgcugccuacggagguggcagccaucuccuucucggcaucaagcuuaccaugguggccggcaccagaugccugcucgcucugcuucugccccagguccuccuugggggagccgcgggccugguuccugagcuggggcggcgcaaguucgcugccgccagcuccggaagaccgucuagccaacccuccgacgaagugcucucugaguuugaacugcggcugcucagcauguucggccugaaacagcgcccuacacccuccagagaugcuguggucccucccuacaugcuugaccuguaucggcgccacucugggcagccuggaagcccggcccccgaucauagacucgagcgggcugccucccgcgcgaacacggugagaucuuuucaccaugaagagucucuggaggaacuuccugagaccuccggcaagacaacccggcgcuucuuuuucaaucugagcucuauccccacagaagaguuuauuaccuccgccgagcuccagguuuucagagaacaaaugcaggacgcucugggcaacaauagcucuuuucaccaucggaucaacauuuacgagaucauuaaaccugccacagcuaauuccaaguuccccgugacccgccugcucgauacgagacuggucaaccagaaugccagccggugggaauccuuugacgugaccccggcgguuaugagauggacagcccaggggcacgcuaaccacggauucguggucgagguggcccaucuugaagagaaacaaggcgugucuaagcgccacguccggaucagcagaucccugcaucaggaugagcacagcuggucucagauccgcccucuccugguuaccuuugggcacgacggaaagggccauccccuucacaaacgggaaaagagacaggcuaaacauaagcaacgcaaacggcugaaguccagcuguaagagacacccucucuauguggauuucucugacgugggguggaaugauuggauugucgccccucccggauaccaugccuucuauugccacggcgagugucccuuuccgcuggcugaccaccugaacagcacaaaucaugcgaucgugcagacccucguuaacuccgugaauagcaaaauucccaaggccugcugugucccuacggaacugagcgcuaucuccaugcuuuaccuggaugagaacgaaaaagugguucucaagaauuaucaggacaugguggucgagggcugcgggugucgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3094 - RNA, 1609 nt, Artificial Sequence
  mRNA product Design2 comprising derived and/or modified sequence from Homo sapiens__NP_001193.2__HsBMP4 (opt5)
ggggcgcugccuacggagguggcagccaucuccuucucggcaucaagcuuaccaugauccccggcaacagaaugcugauggugguccuccugugccagguucuucucgggggagccagccacgcuucccugauuccugagaccggcaagaaaaagguggccgaaauccaagggcaugcgggaggccggcgcucugggcagagccacgagcugcuuagagacuucgaagcuacacugcuccagauguuuggacugcggcgcagaccgcagcccuccaaaucugccgugauuccugauuacaugcgggaccuguaucgccuccaaagcggcgaggaagaggaggaacagauccauuccacgggccuggaguaccccgaaagaccugccucucgggcuaauaccguccgcagcuuccaccaugaggagcaccuugaaaacauucccgggacauccgagaauagcgccuuuagauuccuguuuaaccucucuuccaucccugaaaaugaggugaucagcucugcugaacugcggcuuuuccgcgagcagguugaucagggaccggacugggagagaggcuuucaccggauuaacaucuaugaagugaugaagcccccugccgaggucgugcccgggcaucugauuacccgccuccuggauacaagacugguucaccauaaugugacccggugggaaacauucgacgucuccccugcggugcucagauggacccgcgagaaacaacccaacuacggacuggccaucgaagugacgcaccuucaccagacccggacacaucagggccagcacgucagaauuagccgcucucugccgcaaggguccggaaauugggcucagcuccggccucugcuuguuaccuuuggccaugauggcagagggcacgcccugacacgccggagacgcgcuaagcggagccccaagcaucacucccagagagcccgcaaaaagaacaaaaauugucggagacacucucucuauguggacuucagcgaugugggauggaacgacuggaucgucgcgccucccggcuaccaagccuuuuauugccauggggauugucccuucccucuggcugaccaccucaauuccaccaaccaugccauugugcagacgcugguuaauagcgugaacucuuccaucccgaaggcuugcuguguccccacagagcugagcgccaucucuaugcuuuaccuggaugaguacgacaaagugguucucaagaacuaucaggaaaugguggucgagggaugcggcugucggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3095 - RNA, 1924 nt, Artificial Sequence
  mRNA product Design2 comprising derived and/or modified sequence from Homo sapiens__NP_001709.1__HsBMP6 (opt5)
ggggcgcugccuacggagguggcagccaucuccuucucggcaucaagcuuaccaugcccggccuggggagacgggcccaguggcucugcuggugguggggacugcuuuguagcugcuguggcccuccgccccugcgcccuccccucccugcugccgcggcugccgccgcugggggacaacugcuuggcgacgggggaucccccggcagaaccgagcagccuccgcccucuccucagagcuccucuggcuuccuguaccggcgccucaagacacaggagaaaagagaaaugcaaaaggaaauccugagcgugcuggggcucccccaccggccucgcccccugcauggacuucagcagccgcagccucccgcccugagacaacaggaggaacagcagcaacagcagcaacucccucggggcgagcccccucccgggcgccugaaauccgcuccgcuuuuuaugcuggaucucuauaacgcccugucugcggacaaugaugaggacggagccagcgaaggcgagagacagcaguccuggccccacgaagcugccuccucuucccagcggcgccaaccucccccuggggcugcccauccccugaacagaaagagccuccuggcgccgggaucuggcuccggcggggccagcccucuuacgucugcucaggauuccgccuuccugaaugacgcugauauggucaugagcuuuguuaaccucguggaguacgacaaagaguucagcccccggcagcgccaccauaaggaauuuaaguucaaucugucucagauuccugagggagaaguggucaccgccgccgaguuuagaaucuauaaagauugcgugaugggcagcuucaagaaccaaacauuucuuauuuccaucuaccagguucugcaggaacaccagcaccgggacagcgaucucuuccugcuggacaccagaguggucugggcuucugaggagggguggcucgaauuugauauuacagcgaccuccaaucugugggugguuacaccccaacauaacaugggacuucagcugagcguggucacccgcgacggcgugcacgugcauccucgggccgcugggcucgucggaagagacggccccuaugauaaacagccguucaugguugccuuuuucaaggugucugaggugcacguccgcacgacccggagcgccuccucuagacgccggcagcaaagcagaaaucgcuccacacagagccaggacguggcucggguuucuuccgccagcgauuacaacucuuccgaacugaaaaccgcguguagaaagcacgagcuuuaugugagcuuccaagaccugggcuggcaggauuggaucaucgcuccuaagggguacgccgccaauuacugcgacggagaauguuccuuuccccucaacgcucauaugaaugccacaaaccacgcuauuguccagacccuggugcaucugaugaaucccgaguauguuccuaaaccgugcugugcccccacgaagcucaacgcgaucucugugcuguacuucgaugacaacagcaaugucauucuuaaaaaguaucgcaacauggugguccgggccugcggcugucacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3096 - RNA, 1678 nt, Artificial Sequence
  mRNA product Design2 comprising derived and/or modified sequence from Homo sapiens__NP_001710.1__HsBMP7 (opt5)
ggggcgcugccuacggagguggcagccaucuccuucucggcaucaagcuuaccaugcacgugagaagccugcgggccgcugcuccccauuccuucgucgcgcucugggcuccucuguuucuucugcgcucugcccucgccgacuucagccuggauaacgagguucacuccucuuuuauccauagacggcuucgcagccaggaaagacgggagaugcaacgcgaaauucuguccauccucggccugccgcacagaccccggccucaucugcaggggaagcacaauucugcucccauguucaugcucgaccuguacaacgccauggcuguggaggaaggaggcgggccuggaggccagggguuuagcuaucccuacaaagccguguucuccacccagggaccuccgcuugcgagccugcaagauucucacuuucucacagacgccgauauggucauguccuucgugaaucugguugagcaugacaaggaguuuuuccacccccgcuaucaucacagagaauuucgguucgaucuuagcaaaauuccugagggcgaagcugugacggccgcugaguuucgcaucuacaaggacuauauuagagagcgguucgauaacgaaaccuuccgcaucucugucuaccaggugcugcaggagcaccucggcagagaauccgaccuguuucugcucgauagccggacacugugggccucugaggaaggguggcuuguuuucgacaucaccgcgacauccaaucauuggguggucaaccccagacacaaucugggacuccagcugagcguggagacccuugauggccaauccauuaacccuaaacuggccgggcucaucggacgccauggcccccagaauaagcagccguuuaugguggcuuucuuuaaggccacagagguccacuuccggucuauuagaagcaccggguccaaacagcgcagccaaaaccggucuaagacgccuaaaaaucaggaagcucugagaauggccaacguugccgaaaauuccagcucugaccagcgccaagccugcaagaaacaugagcuguaugugagcuuucgggaccucggauggcaggauuggaucauugcgcccgagggcuacgccgcuuacuauugugaaggcgagugcgccuucccucugaacuccuacaugaaugccaccaaccacgcuaucgugcagacacuuguccacuuuauuaaccccgagaccgugcccaagccuuguugcgccccgacacagcugaaugcgaucucuguucucuauuucgacgauagcuccaacgugauccugaagaaauacagaaauauggucgugcgcgcuugugggugccauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3097 - RNA, 682 nt, Artificial Sequence
  mRNA product Design2 comprising derived and/or modified sequence from Homo sapiens__NP_006264.2__HsCCL7 (opt5)
ggggcgcugccuacggagguggcagccaucuccuucucggcaucaagcuuaccaugaaggccagcgcugcccugcucugccugcuucugaccgcggcugccuucucuccccagggccucgcccaaccuguggggaucaacacauccacgaccuguugcuacagauuuauuaauaaaaagaucccgaaacagcggcuggagagcuaucgcagaacaaccuccucucacuguccccgggaagcugucauuuucaagacaaaacuugacaaggagaucugcgccgauccuacccagaaguggguucaggacuuuaugaaacaucuggauaagaaaacacaaacccccaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3098 - RNA, 4006 nt, Artificial Sequence
  mRNA product Design2 comprising derived and/or modified sequence from Homo sapiens__NP_001954.2__HsEGF (opt5)
ggggcgcugccuacggagguggcagccaucuccuucucggcaucaagcuuaccaugcugcucacccugaucauucuucugcccguggucagcaaguucuccuuuguuucucucagcgccccucagcacugguccugcccggagggcacacuggcugggaacggaaauucuacgugugugggccccgccccuuuccuuaucuuuagccaugggaacuccauuuucagaaucgacaccgaaggaacaaauuacgagcaacugguggucgaugcgggcgugucuguuauuauggacuuucacuauaacgaaaaacggaucuacuggguggaucucgagcgccagcugcugcagagagucuuccucaaugggagccggcaggaacgcgugugcaacaucgagaagaauguuuccggaauggcuauuaacuggaucaaugaggaagugauuuggagcaaccaacaggagggcaucauuaccgucacagacaugaaaggcaauaacucucauauccugcuuuccgcccugaaguaucccgccaauguggcuguggauccugucgaaagauuuauuuucuggagcucugagguugccgggucccucuaccgggcugaccuggauggagugggcgugaaagcccuucuggagaccagcgaaaagaucacagcggucucucucgacgugcuggauaagcgccuguuuuggauccaguauaacagagagggguccaauagccucauuuguuccugcgacuacgauggaggcucuguucacaucagcaaacaucccacccagcacaaccuguucgccaugucccuuuuuggggaccggauuuucuauagcacguggaagaugaaaaccaucuggauugcuaacaagcacacaggaaaagauauggugcgcaucaaucugcauucuuccuuugucccucucggcgaacugaaggugguucacccgcuugcccaacccaaggcugaggacgacaccugggaaccugagcagaaacuguguaagcucagaaaaggcaacugcagcucuacagugugugggcaggaucugcagagccaucugugcaugugugccgagggauacgcgcucucccgggaccgcaaguacugcgaagaugucaaugagugugccuucuggaaccacggcugcacccuggggugcaaaaauacgcccggaucuuauuacuguacaugcccugugggcuucguccuucugcccgacgggaagagaugucaccaacucgugagcugcccgcggaacguuuccgaauguagccaugauugcgugcugaccucugagggaccucuuuguuuuugccccgaaggcuccguccuggagcgcgacggcaaaacauguagcggguguucuuccccugauaauggaggcugcagccagcucugcgugccccugucccccguuucuugggagugcgacuguuucccuggguaugaucugcagcucgacgaaaagagcugcgcugccuccggaccgcaacccuuucugcuuuucgcuaacucucaggauaucagacacaugcauuuugacggcaccgacuacgggacccugcucagccagcagaugggcaugguguaugcccuggaucacgacccugucgagaauaagauuuacuucgcccauacagcucugaaauggaucgaacgggcgaacauggauggaucccaaagagagcgccuuauugaagagggcguggacgugcccgaggggcucgccguugauuggaucggacggagauuuuauuggacggaccgcggcaagagccugauugggcggucugaucugaauggaaaaagauccaagaucaucaccaaagaaaacauuagccagccucgcggcaucgcuguccaccccauggccaagcggcuuuucuggacagacaccgggauuaauccgagaaucgagucuuccagccugcagggccuuggacgccuggugauugccucuagcgaucucaucuggccuuccggcauuacaaucgacuuucugaccgauaagcuguacuggugugacgcuaaacagagcgugaucgaaauggccaaccuugaugggucuaagcggagacgccucacgcaaaaugacgucggacaccccuucgcgguggcuguuuuugaggacuacgugugguucuccgauugggccaugccuagcgucaugcgggugaacaaaagaacaggcaaggaccggguucgccugcagggguccaugcugaaacccucuagccucguggucgugcauccucuggccaagcccggagcugauccgugccuuuaucagaacggcgggugugagcacauuugcaagaaaagacugggcaccgccugguguuccugccgggaaggauuuaugaaggcuucugacggcaaaaccugucucgcccuggaugggcaucagcugcuugcgggaggcgagguugaccucaagaaucaagugacaccucuggauauccugagcaaaaccagagucuccgaagacaacauuacagagucucagcacaugcucguggccgaaaucauggugagcgaucaggacgauugcgcucccgucggguguuccauguacgcccgcugcauuagcgagggagaggacgcuacgugccagugucugaagggcuucgccggggauggcaagcucugcucugacaucgacgaaugugagaugggaguucccgugugcccuccggcguccagcaaauguaucaauaccgaaggcggguaugugugccgguguucugagggauaccaaggcgaugggauucacugccuggacaucgaugaaugucagcucggagagcauuccugcggcgagaacgccagcuguacaaauaccgaaggcggguauacaugcaugugcgcuggaagacugucugagcccggccugauuuguccugacuccacgcccccuccccaccuucgcgaagaugaccaucacuacagcgucagaaacuccgauagcgagugcccucucucucaugacggguauugucugcacgauggagugugcauguacaucgaagcccuggacaaguacgcuuguaauugcguugugggcuauauuggggagcggugucaguaccgcgaucucaaauggugggagcugagacacgccggacauggccaacagcagaaggucaucgugguugccgugugcgucgugguucuugugaugcugcuccugcugagccuuuggggcgcucacuauuaccggacccagaaacugcucuccaagaaccccaaaaauccguaugaagagucuagccgcgacgucagaucccggcgcccugcggacaccgaagaugggaugucuagcuguccccaaccuugguucguggugaucaaggagcaucaggaccugaagaacggaggccagcccgucgccggggaggauggacaggcugccgacggcuccaugcaaccgacaucuuggagacaggaaccucagcucugcgggaugggaaccgagcagggcuguuggauucccguuagcuccgauaaaggcagcugcccucaagugauggaacggucuuuucacaugcccuccuacgggacacagacccuggagggaggcguggaaaagccccauagccuucugucugccaauccucucuggcagcaacgcgcucuggacccgccccaccagauggagcugacgcagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3099 - RNA, 892 nt, Artificial Sequence
  mRNA product Design2 comprising derived and/or modified sequence from Homo sapiens__NP_001423.1__HsEREG (opt5)
ggggcgcugccuacggagguggcagccaucuccuucucggcaucaagcuuaccaugaccgccggcagacggauggagaugcugugcgcugggcgcgugcccgcccuccugcuuugucugggauuccaccuccugcaggcgguccuuagcacaacgguuaucccuuccugcauuccgggcgaaucuagcgacaacuguaccgcucuggugcaaacagaggauaaucccagaguggcccaggucuccaucaccaagugcucuagcgacaugaacggguacugucuccauggacagugcauuuaucugguggauaugucccagaauuacugucggugcgaaguuggcuauacaggggugcgcugugagcacuuuuuccugaccguccaucaaccucucucuaaagaauacguggcccugacaguuauccuuauuauccuguuucucaucaccguggucggaagcacguauuacuucugcagaugguaucggaaccgcaaguccaaagagcccaagaaagaguacgaaagagugaccagcggcgacccugagcugccccaggugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3100 - RNA, 850 nt, Artificial Sequence
  mRNA product Design2 comprising derived and/or modified sequence from Homo sapiens__NP_000791.1__HsFGF1 (opt5)
ggggcgcugccuacggagguggcagccaucuccuucucggcaucaagcuuaccauggccgagggcgaaaucaccacauucacggcucugaccgagaaguuuaaccugcccccugggaauuacaaaaagccgaaacuccuuuauugcagcaacggaggccacuuccugcggauucuccccgacgggacaguggauggaaccagagaccgcuccgaucagcauauccaacugcagcuuucugccgaaagcgucggcgagguuuacauuaaguccacagaaaccgggcaguaucuggcgauggacacagauggacuccuguacggcucucagaccccuaaugaggagugucuguuucucgaaagacuggaggaaaaccacuauaauacguacaucagcaaaaagcaugcugagaagaacugguucgugggccuuaaaaagaauggguccugcaaacggggaccccgcacccacuauggccaaaaggccauucuguuucucccucugcccgugucuagcgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3101 - RNA, 1249 nt, Artificial Sequence
  mRNA product Design2 comprising derived and/or modified sequence from Homo sapiens__NP_001997.5__HsFGF2 (opt5)
ggggcgcugccuacggagguggcagccaucuccuucucggcaucaagcuuaccauggugggcgucgggggaggcgacguugaggaugugacccccagaccugggggaugccagaucagcggccgcggggcccggggauguaacggcauuccgggcgcugccgcgugggaagcugcccugcccagacggcgcccuagacggcaccccuccgugaauccucgcucuagagccgcugggagcccccggacacgcggaagacggacggaggaacgcccuuccggcucuagacucggggaccggggacgcggcagagcccugcccgggggacggcuuggcggcagagggcgcggacgggcucccgagagagucggcgggcgcggacggggcagagggaccgccgcgccucgcgccgcucccgccgcucggggaagcagaccuggccccgccggcacaauggcggccggguccaucaccacacugccggcucucccugaagauggaggcucuggggccuucccgccuggacauuuuaaggaccccaaacgccuguacugcaagaacggcggguucuuucuucggauucaccccgauggcagaguggacggaguucgcgagaaaagcgauccucauaucaagcugcaacuccaggcugaggaacggggcguggucuccauuaaaggggugugugccaauagauaucuggccaugaaggaggacggacggcugcucgcuagcaagugcguuaccgaugaauguuucuuuuucgagcgccuggagucuaacaauuacaacacauauagaucccggaaauacaccagcugguauguggcgcuuaagagaacgggccaguacaaacuggggucuaagaccggaccgggccagaaagccauccucuuucugcccauguccgcuaagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3102 - RNA, 967 nt, Artificial Sequence
  mRNA product Design2 comprising derived and/or modified sequence from Homo sapiens__NP_002000.1__HsFGF7 (opt5)
ggggcgcugccuacggagguggcagccaucuccuucucggcaucaagcuuaccaugcacaaguggauccugaccuggauucuccccacacugcuuuacagaagcugcuuccauaucauuugucuggugggcacgaucucccucgccugcaacgacaugaccccugagcagauggcuacaaaugucaacuguucuagcccggaacggcacacccgcuccuaugauuacauggaagggggagacauuagaguucggcgccuguuuugcagaacacaaugguaucuucggaucgauaaacgcggcaaggugaaagggacccaggagaugaagaauaacuacaauaucauggagauuagaacaguggccgucggaaucguggcgauuaaaggcguugaaucugaguucuaucuggcuaugaacaaggaggggaagcucuacgccaaaaaggaauguaaugaggacugcaacuuuaaagaacugauccuggagaaucauuauaacaccuacgccagcgcuaaguggacgcacaauggaggcgagauguucguggcccucaaccagaaaggcauucccguccgggggaagaagaccaaaaaggaacagaaaacagcucauuuucugccuauggccaucaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3103 - RNA, 1009 nt, Artificial Sequence
  mRNA product Design2 comprising derived and/or modified sequence from Homo sapiens__NP_001936.1__HsHBEGF (opt5)
ggggcgcugccuacggagguggcagccaucuccuucucggcaucaagcuuaccaugaagcugcuccccagcgugguccugaaacuuuuccuggccgcuguucucuccgcccuggugaccggcgagucucuugaaagacugcggcgcgggcucgcggcuggaacaagcaacccugacccgcccacgguguccaccgaucagcugcugccucucggcgggggaagagaccggaagguccgcgaucugcaagaggccgaccuugaucugcucagagugacacugucuagcaaaccccaggcccuugcuaccccuaauaaggaggaacacggcaaacggaagaagaaagggaagggacugggcaaaaagcgcgaccccugccucagaaaauacaaggauuuuuguauccauggcgaaugcaaguauguuaaagagcugcgggccccuuccuguauuugccacccgggguaccauggagagcgcugucacggccugucucuccccguggaaaacagacuguauacauacgaccauaccacaauccuugcugucguggccguugugcugagcuccgucugccuccuggugauuguggggcuucugauguuccgguaucaccgcagaggaggcuacgaugucgagaaugaagagaagguuaaacucgggaugaccaacagccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3104 - RNA, 2569 nt, Artificial Sequence
  mRNA product Design2 comprising derived and/or modified sequence from Homo sapiens__NP_000592.3__HsHGF (opt5)
ggggcgcugccuacggagguggcagccaucuccuucucggcaucaagcuuaccaugugggugaccaagcugcuccccgcccugcuucugcagcacguccuccugcaucuucugcuccugccuaucgcuauuccguacgccgagggccaaagaaaacggcgcaacacaauccacgaguucaagaaaagcgcgaagacgacccugauuaaaaucgaccccgcucucaagauuaagaccaaaaagguuaauaccgccgaucagugcgccaacagauguacacggaauaaagggcugccuuuuaccugcaaggcuuucguguuugacaaagcccgcaagcagugucuuugguuccccuuuaacuccaugucuagcggagugaagaaagaguucggccaugaauuugaucuguaugagaauaaggacuacaucagaaacugcaucauugggaaaggacgguccuauaagggcacagucucuaucaccaaaagcgggauuaagugucagccuugguccucuaugaucccccacgaacauagcuuccucccuuccagcuaccgcggaaaagaucugcaagagaauuauugcagaaacccgcggggcgaggaaggcgggcccugguguuuuacgucuaauccugaggugcgcuacgaaguuugcgacauuccccaguguuccgagguggagugcaugaccuguaacggagaaagcuauagaggccuuauggaucacacagagucugggaagaucugccagcggugggaccaccagaccccucaucgccacaaguuccugcccgaaagauacccggauaaaggauuugacgauaauuacugccggaacccugacggccaaccccgcccuugguguuauacacucgauccccauacaagaugggaauacugcgcuauuaagacgugugccgacaauacaaugaacgacaccgaugucccccuggaaacaaccgagugcauccaggggcagggagagggcuaucggggcaccgugaauacaaucuggaacgggauuccuugucagagaugggacucccaauacccgcacgaacacgauaugacgcccgagaacuucaaaugcaaggaccugcgcgaaaauuauugucggaacccugauggaagcgagucucccuggugcuuuaccacagacccuaauaucagaguuggcuacuguucccagauucccaacugcgauaugagccaugggcaggacuguuaucgcggaaauggcaaaaacuacauggggaaucucucccaaacccggucuggacugacaugcagcaugugggauaagaacauggaagaccuucacagacauaucuucugggagccggaugcguccaagcugaaugagaacuacugccgcaauccugacgacgaugcccacggccccugguguuauaccggcaacccucucauucccugggacuacugcccuaucagccggugugaaggggauacgacacccaccaucgugaaucuggaccauccggucauuucuugcgcuaaaaccaagcagcuuagaguggugaacggaaucccuacacgcaccaauauuggcuggauggucucccugcgguauagaaacaaacacaucugugggggaagccucauuaaggagucuuggguucugacagcccgccagugcuuccccagccgggaucugaaagacuacgaggcuuggcucggcauccacgaugugcaugggagaggcgacgaaaaguguaaacaggugcugaacgucucccaacuuguguauggacccgaaggcucugaucugguucucaugaagcuggcccggccugcggugcuugacgauuuugucagcacgaucgaccugccgaauuacgggugcaccauucccgagaagacauccuguagcguguauggauggggcuacaccgggcucaucaacuacgauggacugcugcgcguugcccaccucuauauuaugggcaaugagaaaugcucucagcaucacagagggaaggugacacugaacgaauccgagaucugugcuggcgccgagaaaauuggaagcggcccuugcgaaggggacuacggaggcccccuugucugcgagcagcacaagaugcggauggugcugggggucaucgugccuggaagaggcugugcuauucccaaucgcccugggaucuucguucggguggccuauuacgccaaguggauccauaaaauuauccucaccuauaaggucccccagucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3105 - RNA, 2308 nt, Artificial Sequence
  mRNA product Design2 comprising derived and/or modified sequence from Homo sapiens__NP_005336.3 __HsHSPA1A (opt5)
ggggcgcugccuacggagguggcagccaucuccuucucggcaucaagcuuaccauggccaaggcugccgcgaucggcauugaccuggggaccacauacagcugcgugggagucuuccagcacggcaaaguugagaucauugcuaacgaucaagggaauagaacgacccccuccuauguggccuuuacagacaccgaacggcucaucggagaugccgcuaagaaccagguggcccugaauccucagaacacagucuucgacgcuaaacgccuuauuggcagaaaguuuggggauccggugguucagucugacaugaaacauuggcccuuccaagugaucaaugauggagacaagccuaagguccaggugagcuacaaaggcgagaccaaggccuuuuaucccgaagagaucuccucuaugguucugacaaaaaugaaggaaauugcggaggccuaccucggcuauccugugaccaacgcugucaucacggugcccgccuacuucaaugauagccagcggcaggcuaccaaagacgccggggugauugcgggacugaacguccuucgcaucauuaaugagccuacagccgcugccaucgcuuauggccuggauagaaccgggaagggagaacggaacguucucauuuuugaccugggcgggggaacauucgauguguccauccugaccaucgacgacggcauuuuugaggugaaggccacggccggcgauacacaccucgggggagaagacuucgauaaucgccuggucaaccauuuuguggaggaguucaaaagaaagcacaaaaaggacaucucucaaaauaaacgggcuguucgcagacuucggaccgcgugugaacgcgccaagagaacacugagcuccagcacccaggcuucucucgagauugauucccuguuugaaggcaucgacuucuacaccagcauuacacgggcccgcuucgaggaacuuugcucugaucuguuuagauccacgcucgagccgguggagaaagcccugcgggacgcuaagcuggauaaggcccagauccaugaccucguccugguugggggaagcaccagaauccccaaagugcagaaacuucugcaagauuucuuuaacggccgcgaccucaauaagucuauuaacccugacgaagcgguggcuuacggggccgccguccaggcugccauccugaugggagauaaguccgagaacgugcaggaccuucugcuccuggaugucgcuccccugagccucggccuggaaacagccggcggggugaugaccgcgcuuauuaaacggaauagcacaaucccuaccaagcaaacgcagauuuucacaaccuauucugacaaccagcccggaguucugauccagguguacgagggcgaaagagccaugaccaaggauaauaaccuccuggggcgcuuugagcuuagcggaaucccgccugcuccccggggcgucccucaaauugaggugacauucgacaucgaugccaaugggauucugaacguuaccgcuacagacaaauccacgggcaaggccaauaaaaucaccauuacaaacgauaagggaagacucagcaaagaagagaucgaacgcauggugcaggaggcggaaaaguauaaggccgaggacgagguccagcgggaaagagugucugcuaaaaaugcccuggaguccuacgcuuuuaacaugaaguccgccguggaagaugagggccugaaagggaagauuucugaggccgacaaaaagaagguucucgauaaaugucaggaagucaucagcuggcuggacgcuaauacccuugcggagaaggacgaguucgaacacaaacgcaaggaacuggagcaagugugcaaccccaucauuuccggacucuaucagggcgccgggggacccggcccugggggcuuuggagcucagggcccgaaagggggaucuggcagcgggcccacaaucgaggaaguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3106 - RNA, 2308 nt, Artificial Sequence; identical to SEQ ID NO: 3105
  mRNA product Design2 comprising derived and/or modified sequence from Homo sapiens__NP_005337.2 __HsHSPA1B (opt5)

SEQ ID NO: 3107 - RNA, 2308 nt, Artificial Sequence
  mRNA product Design2 comprising derived and/or modified sequence from Homo sapiens__NP_005518.3 __HsHSPA1L (opt5)
ggggcgcugccuacggagguggcagccaucuccuucucggcaucaagcuuaccauggccaccgcuaagggcaucgccauugggaucgaccugggaacaacguacagcugcgugggcgucuuccagcacgggaagguugagauuaucgcgaacgaucaaggaaauagaaccacacccuccuauguggcuuuuaccgacacagaacggcucauuggcgaugccgccaagaaccagguggcuaugaauccucagaacaccgucuucgacgccaaacgccugaucgggagaaaguuuaaugauccggugguucaggcugacaugaaacuuuggcccuuccaagugaucaacgagggaggcaagccuaagguccuggugucuuacaaaggcgaaaauaaggccuuuuaucccgaggaaauuagcuccaugguucucacaaaacugaaggagaccgcggaggccuuccuugggcauccugugacgaacgcugucaucaccgugcccgccuacuuuaaugauucucagcggcaggcuacaaaagacgccggagugauugcgggccugaacguccuccgcaucauuaaugaaccuaccgccgcugccaucgcuuaugggcuggauaagggaggccagggggagagacacguucugauuuucgaccucggaggcggcacauuugaugugagcauccugaccaucgacgaugggauuuucgaagugaaggccacggccggagacacacaucuuggcggggaggacuuugauaaccggcuggucucccacuucguggaggaauuuaaacgcaagcauaaaaaggacaucucucaaaauaaaagagcuguucggcgccucagaaccgcgugugagcgggccaagcgcacacugagcuccagcacccaggcuaaccuugaaauugauucucuguacgagggaaucgacuucuauaccuccauuacaagagcccgguucgaggaacucugcgccgaucuguuucgcggcacgcuggagccgguggaaaaagcucucagagacgccaagauggauaaggcgaaaauccacgacaucguccugguugggggaagcacccggauucccaaggugcagagacuucugcaggauuacuucaauggccgcgaccucaacaaaucuaucaacccugaugaggcuguggccuacggcgccgcuguccaagccgcuauucugaugggggacaaguccgaaaaagugcaggaccuucugcuccuggaugucgcgccccugagccucggacuggagacagccggcggggugaugaccgcccuuaucaagcggaauagcacaauuccuaccaagcagacgcaaaucuuuacaaccuauuccgacaaccagcccggaguucugauccagguguacgaaggcgagagagcuaugaccaaagauaauaaccuccuggggcgcuucgaccuuacaggcauuccgccugcuccccggggagucccucagaucgaggugaccuuugauauugacgccaauggcauccugaacguuacagccacggauaagagcaccgggaaagugaauaagauuacaaucaccaacgacaaaggaagacucuccaaggaagagauugaacgcaugguccuggaugcggagaaguauaaagccgaagacgaggugcaacgggagaagaucgcugccaaaaaugcucuggaaucuuacgccuucaacaugaagucugugguuuccgaugagggccucaaagggaagaucagcgaaucugacaagaauaaaauucuggauaaguguaacgagcuucuguccuggcucgaggucaaucagcuggccgaaaaagacgaguuugaccacaagagaaaagaacuggagcagaugugcaaccccaucauuacaaaacuuuaucagggaggcuguaccgggcccgcuugcggcacgggauacgugccuggccgcccggcgaccgggcccacaaucgaagagguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3108 - RNA, 2302 nt, Artificial Sequence
  mRNA product Design2 comprising derived and/or modified sequence from Homo sapiens__NP_068814.2 __HsHSPA2 (opt5)
ggggcgcugccuacggagguggcagccaucuccuucucggcaucaagcuuaccaugagcgccagaggccccgcuaucgggauugaccugggaaccacauacuccugcgugggcgucuuccagcacgggaagguugagaucauugccaacgaucaaggaaaucggacgaccccuucuuauguggcguuuacagacaccgaacgccucaucggcgaugcugccaaaaaccagguggccaugaauccgacaaacaccauuuucgacgcuaagagacugaucgggcggaaauuugaggaugccacaguccagagcgacaugaagcauuggcccuuccgcgugguuuccgaaggaggcaaaccuaaggugcaggucgaguacaagggcgaaaccaaaacguuuuuccccgaggagaucucuagcauggugcuuaccaagaugaaagaaauugcugaggccuaucugggaggaaagguucacuccgcggugaucacagucccugccuacuuuaaugauucucaaagacaggcuaccaaagacgccggcacaauuaccgggcucaacgugcugcggaucauuaaugaacccacggcugccgcgaucgccuauggacuugauaagaagggcugugcugggggagagaaaaacgugcugauuuucgaccucggcggcgggacauuugaugucagcauccugaccaucgaggacggaauuuucgaaguuaaguccacagccggcgauacccaucuugggggagaggacuuugacaaucgcauggugagccaccucgcugaagaguucaaaagaaagcauaaaaaggauaucggcccuaacaaacgggccgugcgcagacugcggaccgccugcgaacgcgcuaagagaacacuuucuuccagcacgcaggcgucuauugagaucgacucccuguacgagggggucgauuuuuauaccagcauuacacgggcccgcuucgaggaacucaaugcugaccuguucagaggaacccuugaaccgguggagaaggcccugcgggaugccaaacucgacaagggccagauccaagaaaucguucuggugggcgggucuacacgcauucccaaaauccagaagcugcuccaggacuuuuucaacggaaaagagcugaauaaguccauuaacccugaugaggcugucgccuacggcgcggcugugcaggccgccauccuuauuggggauaagagcgaaaauguucaagaccugcuccugcuugaugugacgccccugucccucggaaucgagaccgcuggcggggucaugacaccucugaucaaaagaaacaccaccauucccacaaagcagacccagacauuuacgaccuacucugacaaccaaagcuccgugcugguccagguguaugaaggcgagcgggccaugacaaaagacaauaaccuccugggaaaguucgaucuuaccggcaucccgccugcucccagagggguuccucagauugaagugacauuugacaucgaugccaaugggauucugaacgucaccgcggccgacaaaagcacgggcaaggagaauaagaucaccauuacaaacgauaaagggcgccucucuaaggacgauaucgaccggauggugcaggaggcugaaagauacaaauccgaggaugaagccaaucgcgaccggguugcugccaagaacgcgcuggagagcuauaccuacaauaucaaacaaacaguggaggaugaaaagcugagaggaaagauuucugagcaggacaaaaacaagauccuggauaaaugucaggaagucauuaauuggcucgaccgcaaccagauggccgagaaggacgaauaugagcacaaacaaaaggagcuggaacgggugugcaaucccaucauuagcaaacuguaccagggcgggcccggcggaggcuccgggggaggcgggucuggagcuagcggcgggccuaccaucgaggaaguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3109 - RNA, 2905 nt, Artificial Sequence
  mRNA product Design2 comprising derived and/or modified sequence from Homo sapiens__NP_002145.3 __HsHSPA4 (opt5)
ggggcgcugccuacggagguggcagccaucuccuucucggcaucaagcuuaccaugagcguggucggcaucgaccugggguuccaguccugcuacguugccguggcuagagccggaggcauugagaccaucgcgaacgaauauucugaucgguguacacccgcuugcauuagcuuugggccuaagaaucgcuccaucggagccgccgcuaaaucucaagugauuagcaacgccaagaauacgguccagggcuucaaaagauuucacgggcgggcuuucuccgacccguuuguggaggccgaaaagucuaaccucgcguacgauaucguucagcugcccaccggacuuacaggcaucaaagugaccuauauggaggaagaacgcaauuucacaaccgagcaggucacagccaugcugcucagcaagcugaaggaaaccgcugaguccgugcuuaaaaagccuguuguggacugugucgugagcgugcccugcuuuuacacggaugccgaaagacggucugucauggacgcuacccaaauugccggccugaacugucuccgccugaugaaugagacaaccgcgguugcccuggcuuaugggaucuacaaacaggaucucccugcccuggaggaaaagcccagaaacgugguguucgucgacaugggacauuccgcuuaucaggugagcguuugcgccuuuaaucggggcaaacuuaaggugcuggccacagcuuucgauaccacgcucgggggacgcaaguuugacgagguccuggugaaccacuucugugaagaguuuggcaaaaaguacaaacuugauauuaagucuaaaaucagagcgcugcuccggcugucccaggaaugcgagaagcugaaaaagcucaugagcgccaaugcuucugaccugccucuuuccauugaguguuucaugaacgauguugacgugagcgggacaaugaaucgcggaaaguuccuggaaaugugcaacgaccuccuggccagagucgagccgccccuucgguccgugcuggaacaaaccaaacucaagaaagaggauaucuacgccgucgaaauugugggcggcgcuacacgcaucccugccguuaaggagaaaaucucuaaguuuuucgggaaggagcugagcaccacccugaaugcggacgaagcugugacaagaggaugugcccuccagugcgccauucugucccccgcuuuuaaaguccgggaguucagcaucacggaugugguuccuuaucccauuucucuuagauggaacuccccggccgaagagggcagcucugacugcgaaguguuuagcaagaaccaugcugccccuuucuccaaaguccugaccuuuuaccgcaaggagcccuucacacucgaggcguauuacucuagcccucaggaucugcccuaucccgacccugccaucgcucaguuuuccgugcaaaaagugaccccgcagagcgaugggucuuccagcaagguuaaggucaaagugcgggugaauguccacggaauuuucucuguguccagcgccucccuuguugaagugcauaagucugaggaaaacgaggagcccauggaaacagaccagaaugcuaaagaggaagagaagaugcaagucgaucaggaggagccucacguggaggaacagcagcaacagacccccgccgagaacaaagcggaaagcgaggaaauggagacgucccaggccggcucuaaggacaagaaaauggaucagccuccccaagcuaagaaagccaagguuaaaacaagcaccguggaccugccgaucgagaaucagcuccuguggcagaucgacagagaaaugcugaaccucuacauugagaaugaagggaagaugaucaugcaggauaaacuggagaaggaacgcaacgacgcuaagaaugccgucgaggaguauguguacgaaaugcgggauaaacuuuccggagaguacgaaaaguuuguuagcgaggacgauagaaacucuuucacccugaaacucgaggacacagaaaauuggcuguaugaggauggcgaagaccaaccuaaacagguguacgucgauaagcuggccgagcuuaagaaccucggccagcccauuaagauccgcuuucaggaauccgaggagcggccuaaacuguucgaggaacuggggaagcaaauucagcaguauaugaaaaucaucagcucuuucaagaauaaagaagaccaauacgaucaccucgacgcugcggauaugaccaagguggagaaguccacaaacgaagccauggaguggaugaauaacaaacugaaccuucagaauaagcagagccugacgauggaccccguggucaaaucuaaggagauugaagcuaaaaucaaggagcucaccagcacauguuccccuauuaucagcaagcccaaaccgaagguugaaccucccaaagaggaacagaagaacgccgagcaaaauggacccguggacggccagggggauaacccuggaccgcaggccgcugagcagggcaccgacacagccgugcccucugauuccgacaaaaagcugccugaaauggauauugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3110 - RNA, 2902 nt, Artificial Sequence
  mRNA product Design2 comprising derived and/or modified sequence from Homo sapiens__NP_055093.2 __HsHSPA4L (opt5)
ggggcgcugccuacggagguggcagccaucuccuucucggcaucaagcuuaccaugagcguggucggcaucgaccugggguuccucaacugcuacauugccguugcuagauccggaggcaucgagaccauugccaaugaauauucugaucgguguacacccgcgugcaucagccuggggucccgcacgagagcuauuggaaacgccgccaagucucagaucgugaccaaugugcggaacacaauccacggcuuuaaaaagcugcaugggcgcagcuucgacgauccuauuguccaaaccgagagaauccggcuuccguacgaacuccagaaaaugcccaauggauccgcuggcgugaagguucgcuaucuggaggaagagagaccuuuugccauugaacaggugacaggcaugcuucuggcuaaacucaaggagaccucugagaacgcccugaagaaacccgucgcggacugugugaucagcauuccuuccuucuuuacagaugccgaacggcgcagcguuauggcugccgcucagguggccgggcugaauugccucagacugaugaacgagaccacggcggucgcccuugcuuacggaaucuauaagcaagaccugcccccucucgaugagaaaccgcggaaugugguguucauugacaugggccacucugccuaccagguccugguuugugcuuuuaacaaggggaaacuuaaggugcuggccaccacauucgaucccuaucucggaggccgcaauuuugacgaagcccugguggauuacuucugcgacgaguuuaagaccaaauacaagaucaacgucaaagaaaauuccagagcucugcuccggcuguaucaggagugugaaaaacuuaagaagcugaugagcgcgaacgccucugaucucccucugaauaucgagugcuucaugaacgaccuugacguguccagcaaaaugaaccgcgcucaguuugagcaacugugugccucucuccuggccagaguugaacccccucugaaggcugugauggagcaggccaaucuccagcgggaagauauuuccagcaucgagauugucgggggagcgacaagaauccccgcugugaaggaacagauuaccaaauucuuccugaaggacaucuccacgacacuuaacgccgaugaggccguugcucgcggcugcgcccugcaaugugcuauccucucuccggccuuuaaagugcgggaguucagcauuaccgaccuggucccuuacuccaucacacuuagauggaagaccagcuuugaagauggcucuggggagugcgaaguguucugcaaaaaucaucccgcgccuuuuuccaaggucauuaccuuccacaagaaagagcccuuugaacuggaggccuucuauacaaaccuccaugaggugcccuacccugacgcucgcaucggcagcuuuacgauucagaauguuuucccgcagucugauggagacagcuccaaggugaaagucaaggugcggguuaacauccacgggaucuuuucuguggccagcgcuuccgucauugaaaaacaaaaucuggagggagaucacagcgacgcccccauggaaaccgagacaucuuucaagaacgagaauaaggauaacauggacaaaaugcaaguggaccaggaagagggccaucagaagugucacgcggaacauaccccugaggaagagaucgaucacacaggggccaaaaccaaguccgcugugagcgacaaacaggauagacugaaucagacgcucaagaagggaaaaguuaagucuauugaccugcccauccaguccagccuuugccgccagcugggccaagaucuccugaacuccuauauugagaaugaaggcaaaaugaucaugcaggacaagcuggagaaagaacggaacgaugccaagaaugcugucgaggaauacguguaugacuuuagagaucgccuugggacaguguacgagaaauucauuaccccugaggaccucucuaagcugagcgccguccuggaagauaccgagaacuggcucuacgaagacggagaggaucagcccaaacagguguauguugacaagcugcaagaacuuaagaaauacggccagccgauccagaugaaguauauggagcacgaggaacggccuaaagcccugaacgaccucgggaagaagauccagcuggugaugaaagucauugaggcuuacagaaauaaggaugaacgcuaugaccaucuggaucccacagagauggagaaaguggaaaaguguaucuccgacgcgaugucuuggcuuaacagcaaaaugaaugcccaaaacaagcucucccugacccaggauccuguugugaaggucagcgagauuguggcuaaaucuaaggaacuggacaauuucugcaaccccaucauuuacaaaccuaagcccaaagccgagguuccggaagauaagccuaaggccaauuccgagcacaacggacccauggacggccagagcgggacagagacgaaaucugauuccaccaaggacagcucucaacauacaaaaagcuccggcgaaauggagguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3111 - RNA, 2347 nt, Artificial Sequence
  mRNA product Design2 comprising derived and/or modified sequence from Homo sapiens__NP_005338.1__HsHSPA5 (opt5)
ggggcgcugccuacggagguggcagccaucuccuucucggcaucaagcuuaccaugaagcugagccucguggccgcuaugcugcuucugcucuccgccgcgagagcugaggaagaggacaaaaaggaagaugucggcaccguuguggggaucgaccugggaacaacguacucuugcgugggcgucuucaaaaacgggcggguggagauuaucgccaaugaucagggaaaccgcauuacccccagcuauguugccuuuacaccugaaggcgagagacuuaucggggacgcugccaagaaucaacugaccuccaacccggagaauacaguguucgaugcuaaacggcucauuggacgcaccuggaacgaccccucuguccagcaggauaucaaguuucugccuuucaaggugguugaaaagaagacaaaacccuacauccagguggacauuggcggcgggcaaaccaagacguuugccccugaggaaaucagcgcgaugguccugaccaaaaugaaggagacagccgaggcuuaucucggaaagaaagugacccacgccguggucacaguucccgcuuacuucaaugaugcccagagacaggcgaccaaggacgccggcacgauugcugggcugaacgugaugcggaucauuaaugaaccuacagccgcugccaucgccuauggacuugauaaacgcgagggcgaaaagaacauucugguguuugaccucgggggaggcaccuucgaugucucccugcuuacaaucgacaauggcguguuugagguuguggcuaccaacggggacacccaucugggaggcgaagauuucgaccagagagucauggagcacuuuaucaaacucuacaagaaaaagacagggaaggaugugcggaaagacaaucgcgcgguucaaaagcugagacgggagguggaaaaagccaagcgcgcucugucuagccagcaucaggccagaauugagaucgaauccuucuaugagggagaagauuuuagcgagacgcucacccgggccaaauucgaggaacugaacauggaccuuuuccgcucuacaaugaagccgguccagaaggugcuggaggauuccgaccucaaaaagagcgauauugacgaaaucguccuggugggcgggucuacccggauucccaaaauccaacagcuuguuaaggaguuuuucaauggaaaagaaccuuccagaggcaucaaccccgaugaggcuguggccuacggcgcggcuguccaggccggggugcugagcggagaccaagacacaggcgaucucguucugcuggacguguguccucucacccuggggauugagacggucggaggcgugaugacaaaacuuauccccagaaacaccgugguuccgaccaagaaaucucagaucuuuuccacagccagcgauaaucagccuaccgucacaauuaagguguacgaaggggagcgcccccugacgaaagacaaccaccuccugggcaccuucgaucuuacaggcauuccucccgcuccccggggagugccucagaucgaagucaccuuugagaucgacgugaaugggauucugagaguuacagccgaggauaagggaaccggcaacaaaaauaagaucacgauuaccaacgaccaaaaucgccucacaccggaagagaucgaacggauggugaacgaugcugagaaguucgccgaagaggacaaaaagcugaaagagagaauugauacccgcaaugaacuggaguccuaugcguacucucucaagaaccagaucggggacaaagaaaagcugggaggcaaacuuagcuccgaggauaaggaaacaauggagaaggccgucgaggagaaaauugaauggcuggaaagccaucaggacgcugacaucgaggauuuuaaggccaaaaagaaagaacucgaggagaucgugcagcccauuaucucuaagcuguauggguccgcuggcccucccccuaccggagaagaggacacggccgaaaaggaugagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3112 - RNA, 2314 nt, Artificial Sequence
  mRNA product Design2 comprising derived and/or modified sequence from Homo sapiens__NP_002146.2__HsHSPA6 (opt5)
ggggcgcugccuacggagguggcagccaucuccuucucggcaucaagcuuaccaugcaggcccccagagagcuggcugugggcaucgaccucgggaccacauacagcugcgucggaguuuuccaacagggccggguggaaauucuggccaacgaucaggggaaucgcacgaccccuuccuauguggcguuuacagacaccgagagacuugucggagaugcugccaagucucaggccgcucugaacccgcacaauacaguguucgacgccaaacggcucaucggccgcaaguuugcugauaccacaguucaaagcgacaugaaacauuggcccuucagaguggucuccgaagggggaaagccuaaagugcggguuuguuaccgcggcgaggauaagaccuuuuaucccgaagagauuucuagcauggugcuguccaagaugaaagagacggccgaagcguaccuuggccagccugucaagcacgccgugaucaccgugcccgcuuauuucaacgacucucagagacaggccacaaaagaugcuggggccauugcgggacugaauguccuccggaucaucaacgagccuaccgccgcugccauugcuuacggccuggaccgcagaggggccggagaacggaauguucugaucuuugaucucggcgggggaacauucgacgugagcgugcuguccauugaugccggcgucuuugaggugaaggcuaccgcgggcgacacgcaucuugggggagaggacuucgauaaccgccugguuaaucacuuuauggaagaguucagacggaaacauggcaaggaccucagcgggaacaagcgcgcccugagacggcuuagaacagcuugcgaacgcgccaaacggacccugucuuccagcacacaagccacccucgagaucgauucucuguuugaaggaguggacuucuauaccuccauuacaagagcucgcuucgaggagcuguguagcgaucucuuucggucuacgcuggaaccggucgagaaggcccuuagagacgcgaaacuggauaaggcucagauccacgacgugguucucgugggcggguccacccgcauucccaaaguccagaagcugcuucaggauuucuuuaauggaaaagaacugaacaagagcaucaauccugacgaggccguggccuacggcgcugccguccaagcugccgugcucaugggcgauaagugcgaaaaaguucaggaccugcugcuccuggacguggcgccccuuucccuggggcucgagacagccggaggcgucaugaccacacugauccagcggaacgcuaccauuccuacgaagcaaacacagaccuucaccacauacucugauaaucagcccgggguguuuauccagguuuaugagggagaaagagccaugaccaaagacaacaaccuucugggccgcuucgagcucagcgggauuccgccugcuccccggggcgugccucaaaucgaagucacauuugauauugacgccaauggaauccuguccgugacggcgaccgauagaagcacaggcaaggccaacaaaaucaccauuacaaaugacaaggggcgccugucuaaggaggaaguggagcggaugguucacgaggcugaacaguacaaagccgaggaugaagcucagagagaccgggucgccgccaagaacucccucgaggcucauguguuccacgugaaaggaagccugcaggaggaaucucuucgcgauaagauccccgaggaagacagacggaaaaugcaagauaaguguagagagguccuggcguggcucgaacauaaucagcuggccgagaaggaggaauaugagcaccagaaacgcgaacuggagcagauuugccggcccaucuuuagcagacuuuacggcgggccuggagugccgggcggguccucuuguggcacccaagcucgccagggagaccccagcacgggcccuauuaucgaagagguugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3113 - RNA, 1486 nt, Artificial Sequence
  mRNA product Design2 comprising derived and/or modified sequence from Homo sapiens__P48741__HsHSPA7 (opt5)
ggggcgcugccuacggagguggcagccaucuccuucucggcaucaagcuuaccaugcaggcccccagagagcuggcugugggcaucgaccucgggaccacauacagcugcgucggaguuuuccaacagggccggguggaaauucuggccaacgaucaggggaaucgcacgaccccuuccuauguggcguuuacagacaccgagagacuugucggagaugcugccaagucucaggccgcucugaacccgcacaauacaguguucgacgccaaacggcucaucggccgcaaguuugcugauaccacaguucaaagcgacaugaaacauuggcccuuccagguggucuccgaagggggaaagccuaaagugagaguuuguuaccggggcgaggauaagaccuuuuaucccgaagagauuucuagcauggugcuguccaagaugaaagagacggccgaagcguaccuuggccagccugucaagcacgccgugaucaccgugcccacauauuucucuaacagccagcgccaagcuaccaaagacgccggggcuauugccggacugaagguccucccuaucaucaaugaggcgacagccgcugccauugcuuacggccuggauagacgcggggccggaaaacggaacguucugaucuuugaccucggcgggggaaccuucgauguguccgugcugagcauugacgccggcgucuuugaagugaaggcuacggcgggcgauacacaucuugggggagaggacuucgacaauagacugguuaaccacuuuauggaggaguuccggcgcaagcauggcaaagaucucucugggaauaagagagcccugcggcgccuuagaaccgcuugcgagcgggccaaaagaacaccguccagcucuacccaggccacccuggaaaucgacucccucuuugagggaguggauuucuauaagagcauuacacgcgcucgguucgaagaacuguguucugaccuguuuagauccacgcucgagcccgucgaaaaagcccugcgcgaugcgaaacuugacaaggcucagauccacgauuucgugcugggcgggggacuccacagccauccucagggcgccgagguugccgcuggccugcuucaacggcagggggccgaacaggagcaccaacccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3114 - RNA, 2323 nt, Artificial Sequence
  mRNA product Design2 comprising derived and/or modified sequence from Homo sapiens__NP_006588.1 __HsHSPA8 (opt5)
ggggcgcugccuacggagguggcagccaucuccuucucggcaucaagcuuaccaugagcaagggccccgccguggggaucgaccugggaaccacauacuccugcgucggcguuuuccagcacgggaaaguggagauuaucgcuaacgaucaaggaaauagaacgaccccuucuuauguggccuuuacagacaccgaacggcucauuggcgaugcggcuaagaaccaggucgccaugaauccgacaaacaccguguucgacgccaaacgccugaucgggagacgguuugaugacgcuguugugcagagcgauaugaagcauuggcccuucauggucgugaaugacgccggacgcccuaaaguucagguggaguacaagggcgaaacaaaguccuuuuaucccgaggaagucucuagcauggugcuuaccaaaaugaaggagauugcugaggccuaccugggcaaaacggugaccaacgcggucguuacagugccugccuauuucaaugauucccaaagacaggcuaccaaggacgccgggacaaucgcuggacucaacgugcugcggaucauuaaugaacccaccgccgcggccaucgcuuacggccuugauaaaaaggucggggccgagcgcaacgugcugauuuuugaccucggaggcgggacguucgauguuucuauccugacaauugaagacggaaucuuugaggugaagucuaccgcuggcgacacacaccugggcggggaggauuucgacaauagaauggucaaccauuuuauugccgaauuuaaacggaagcacaaaaaggauaucuccgagaauaaacgcgccgugagacggcuccgcaccgcuugugaaagagcgaagcggacccugagcagcuccacacaggccagcaucgagauugacucucuuuaugaaggaaucgauuuuuacacguccauuacccgcgcuagauucgaggagcugaacgccgaccucuuccggggcacacuggauccuguugaaaaagcccuuagagacgcuaagcuggauaagagccagauccaugacauugugcucgucgggggaucuacccgcaucccgaaaauccaaaagcugcugcaggauuucuucaauggcaaagagcucaacaaguccauuaaccccgacgaagccguggcguacggggcugccguccaggccgcuauccugagcggagacaaauccgagaaugugcaggaucuucugcuccuggacguuacaccucuuucucugggcauugaaaccgccggcggggugaugacgguccucaucaagcggaacacaaccauucccaccaagcaaacacagaccuuuacaacguauagcgauaaucagccuggagugcugauccaaguuuacgagggcgagagagcuaugaccaaagacaacaaucugcucgggaaguucgaacugacaggaaucccgcccgccccucgcggcgugccccagauugaggucaccuuugauaucgacgcgaacgggauucuuaauguguccgccguggauaaaagcacaggcaaggaaaacaaaaucaccauuacgaaugacaagggacggcugucuaaggaggauaucgaaagaaugguucaggaggcugagaaauauaaggccgaagacgagaaacagcgcgauaaggucuccagcaaaaacucucucgaaagcuacgcuuucaauaugaaggccaccguggaggacgagaagcugcaaggcaaaauuaacgaugaagacaagcagaaaauccuugacaagugcaaugagaucauuaacuggcuggauaaaaaucagacagcggaaaaggaggaauuugagcaccagcaaaaagagcucgaaaagguguguaacccuaucauuaccaagcuguaucaguccgccgggggaaugcccggcgggaugcccggaggcuucccugggggcggagcuccgcccucuggcggggccagcuccggaccuacaaucgaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3115 - RNA, 2422 nt, Artificial Sequence
  mRNA product Design2 comprising derived and/or modified sequence from Homo sapiens__NP_004125.3 __HsHSPA9 (opt5)
ggggcgcugccuacggagguggcagccaucuccuucucggcaucaagcuuaccaugaucagcgccuccagagcugccgcggcucggcuggugggcgccgccgcuucucgcgggcccaccgccgcuagacaccaggacagcuggaacggacucucccaugaggccuuccggcuggucucucgcagagauuacgcgagcgaagccauuaagggcgcuguuguggggaucgaccuuggaacaacgaauagcugcguggccgucauggagggcaaacaagcuaaggugcuggaaaacgccgagggggcgcggaccacaccuucuguuguggccuuuaccgcugauggagaacgccucgucggcaugccggccaaaagacaggcugugacaaaucccaacaauaccuucuaugccacaaagcggcugauuggccgcagauacgacgauccugagguucagaaagacaucaagaacgugcccuuuaagauuguccgggccagcaauggggaugcuuggguggaggcgcacggaaaacuuuauuccccuagccagaucggcgccuucgugcugaugaagaugaaagaaaccgcugagaacuaccucgggcauacggccaagaaugccgucaucaccguucccgcuuauuuuaacgacucucaacgccaggccacaaaagaugcgggacagauuuccggccugaaugugcugagagugaucaacgaaccuaccgcugccgcccucgcuuacgggcuggacaagagcgaggauaaggucauugccguguaugaccuuggaggcggcacauucgauaucucuauucuggagauccagaaagggguuuuugaagugaaguccaccaauggagacacguuccucggcggggaggacuuugaucaagcucugcuucggcacauugucaaagaguucaagcgcgaaacaggaguggaccugaccaaagauaacauggcccuccagagaguucgggaagcggccgagaaggcuaaaugugagcuguccucuuccgugcagacagacaucaaucugccguaccucaccauggauagcuccggccccaagcaucugaacaugaaacuuaccagagcccaguuugaagggaucgucacagaccugauucgccggacgaucgcuccuugccaaaaggccaugcaggaugcggaggugucuaagagcgacauuggagaagucauccucgugggcggcaugaccagaaugcccaaaguucagcaaacagugcaggaucuguucgggcgcgccccuuccaaggcugucaaccccgacgaggccguggcuauuggagccgccauccagggcgggguucuugcuggagaugugaccgacguccugcuccuggacgugacaccgcugagccucggcaucgaaacccugggcggcguguuuacgaaacuuauuaaucggaacacaaccaucccuaccaagaagucucagguuuucuccacagcggccgauggacaaacccaggucgagauuaaagugugucagggcgagagagaaauggcuggggacaauaagcugcucggacaguucacacugaucggcauucccccugcuccccgcggggugccccaaaucgaggucacguuugauaucgacgccaacggaauugugcacguuagcgccaaagauaagggcaccgggcgggaacagcagaucgugauucagucuagcggcggacuuuccaaagacgauaucgagaauauggucaagaacgccgaaaaguacgcggaggaggacagacgcaaaaaggaacggguggaggcuguuaauauggccgaaggcauuauccacgauacagagaccaaaauggaggaguucaaggaccaacugccugccgaugaaugcaacaaacucaaggaagagauuucuaagaugagagaacugcuggcucgcaaagacagcgagacaggggagaauauccggcaggccgcguccagccuccagcaggcuucucugaaacuuuuugaaauggccuauaagaagauggccuccgagagagaaggaagcgggucuuccgggaccggagagcaaaaagaagaucagaaggaggagaaacagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3116 - RNA, 2410 nt, Artificial Sequence
  mRNA product Design2 comprising derived and/or modified sequence from Homo sapiens__NP_079291.2__HsHSPA12A (opt5)
ggggcgcugccuacggagguggcagccaucuccuucucggcaucaagcuuaccauggccgacaaggaggcuggcgggagcgauggacccagagaaaccgccccuacauccgcguacucuagcccggcucggucccugggcgacacggggaucacaccccucucuccuagccacauugugaacgauaccgacuccaaugucucugagcagcagagcuuccugguugugguggccgucgauuuuggaaccacauccagcggcuaugccuacucuuucaccaaagaacccgagugcauccaugugaugcgcagaugggaagggggagacccuggcguuuccaaccaaaagacacccaccacgauucuucugaccccugagcggaaauuucacagcuucggcuaugcugcccgcgauuuuuaccaugaccucgauccgaaugaggcuaagcaguggcuguaucuugaaaaauucaagaugaagcugcacacaaccggggaccucacaauggauaccgaccugacggccgcgaacggcaaaaaggugaaagcccuggagaucuuugcuuacgcccuccaguauuucaaggaacaagcucugaaagagcuuucugaucaggccggauccgaguuugaaaauagcgacgucagaugggugauuacaguucccgcgaucuggaagcagccugccaagcaguucaugcggcaagcugccuaccaggcugggcuggccucucccgagaacuccgaacagcucaucauugcccuggagccugaagcugcgagcaucuacugucgcaaacuuagacugcaucagaugauugagcucuccucuaaggccgcugugaauggauauagcggcuccgacaccgucggggccggauuuacacaagccaaagagcacauccggcgcaacagacagagccggaccuuccugguggaaaaugugauuggcgagaucuggucugaacuggaggaaggcgauaaguacgucguuguggacuccgggggaggcaccguggaucucacaguccaccagauucgccugcccgaggggcaucuuaaagagcuguauaaggcuacgggaggcccguacgggagccucggaguggacuaugaauuugagaaacugcuuuacaagaucuucggcgaagauuucaucgagcaauuuaagauuaaaagaccugccgcguggguugaccugaugaucgcuuucgaaucucggaagcgcgccgccgcucccgauagaaccaacccucucaauauuacacugcccuuuagcuucaucgacuauuacaaaaaguuucggggccacuccguggagcaugcccugagaaaaucuaacgucgauuucgugaaguggagcucccaggggaugcuccgcaugagccccgacgcuaugaaugcccuguuuaagccuaccauugauucuaucaucgagcaccuucgggaccuguuccagaaaccggaaguuuccacagugaaguuucucuuccuggucggaggcuuugcggaggcuccccuucugcagcaagccgugcaggccgcuuucggggaccagugcagaauuaucauuccucaggaugucggacucaccauccugaaaggcgccgugcuguuugggcucgaccccgcgguuauuaaggugcgccggagcccucugacguacggcgucggagugcuuaacagauauguugaaggcaaacaucccccggagaagcugcucgugaaggaugggacacgcugguguaccgacgucuucgauaaauucaucucugccgaccaauccguggcucugggagagcuggugaagcggagcuacaccccugccaaacccucccagcuuguuaucgucauuaauaucuauucuagcgaacacgauaacguguccuuuauuacagacccuggcgugaagaaaugcgggacccucagacuggaucugacaggaacgucuggcaccgcuguccccgcccgccgggagauccagacacucaugcaguucggggacaccgaaauuaaggccacagcuaucgauauugcgaccagcaaguccgugaaaguuggcaucgacuuucugaacuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3117 - RNA, 2443 nt, Artificial Sequence
  mRNA product Design2 comprising derived and/or modified sequence from Homo sapiens__NP_443202.3 __HsHSPA12B (opt5)
ggggcgcugccuacggagguggcagccaucuccuucucggcaucaagcuuaccaugcuggccgugcccgagaugggccuccaggggcuguacaucggaagcuccccugaaagaucuccgguccccagcccucccggcuccccucggacccaagagucuugcgggauugcuccccuuacaccuagccaguccccgaagcccgaaguucgcgccccucagcaggcgucuuucagcgugguggucgcuaucgacuuuggaacgaccuccagcggcuaugccuucucuuuugccuccgaucccgaggcuauucacaugaugagaaaaugggaagggggagacccuggcguggcccaucaaaagacacccaccugucugcuccugacaccggagggcgcuuuccacagcuuuggguacaccgcccgggauuauuaccaugaccuugauccugaggaagcgcgcgacuggcuguauuucgagaaauuuaagaugaaaauccacucugccacagaucucacccugaagacgcagcuggaagcuguuaacggaaagaccaugcccgcccucgagguguucgcucaugcccugagauuuuuccgggagcacgcgcuucaggaacugcgcgagcaguccccuagccuccccgaaaaagacacagucagaugggugcugaccguucccgccauuuggaagcaaccugcuaaacaguuuaugcgggaggccgcuuaccuugccggccuggugucucgcgaaaaugccgagcagcuccugaucgcucuggagccggaagcggccuccgucuauugcagaaagcuccggcugcaccagcuucuggaucucagcgggcgcgcucccggaggcgggagacugggagagcggcgcuccaucgacucuagcuucagacaagcccgggaacagcuuagacgcucccggcauagcagaacauuucugguggagucuggcgugggcgaacucugggccgagaugcaggcuggggaucgcuacgucguugccgacuguggaggcgggaccguggaucugacggugcaccaacuggagcagccucauggaacacucaaagaacuguacaaggcguccggcgggcccuauggagcugucggcguggaccuugccuucgagcagcugcucugccggauuuucggcgaagacuuuaucgccaccuucaagagacagcgcccugcugccuggguugaucugacaauugcuuuugaggcccggaaaagaaccgcggggccccaccgcgccggagcucuuaacaucagccugccguucucuuuuauugacuucuaccggaagcaaagaggccacaauguggaaaccgcccuccgccggagcuccgucaacuuugugaaauggucuagccaggggaugcugagaauguccugugaggcuaugaaugagcuguuccagccuacaguuagcggaaucauucagcauaucgaagcccuccuggcgcggcccgaggugcaaggcgucaaacuucuguuucucgucgggggcuucgccgaaucugcugugcugcagcacgccgugcaggcugcccugggagcccgcggccuuagaguuguggucccucaugauguggggcucacgauccugaagggagcuguucuguuuggccaggcgcccggggugguccgggugagacgcuccccucucaccuauggagugggcguucugaaccgguucguccccgggagacacccgccugagaaacuucuggugcgcgacggcagacgguggugcacagauguguuugagcgcuucgucgccgcugaacaaagcguggcccucggagaggaaguuagacggucuuacugucccgcccgccccggccagagacgggugcugauuaaucuguauugcugugcugccgaggacgcgcgcuucaucaccgauccuggggucagaaagugcggagcucuuucccucgaacuggagccggccgacuguggccaggauacagccggggcucccccuggacggcgcgagauuagagccgcgaugcaguuuggcgacaccgaaaucaaggugacggcuguugaugugagcacaaaccgguccgucagagccucuauugacuuccugagcaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3118 - RNA, 1798 nt, Artificial Sequence
  mRNA product Design2 comprising derived and/or modified sequence from Homo sapiens__NP_008879.3__HsHSPA13 (opt5)
ggggcgcugccuacggagguggcagccaucuccuucucggcaucaagcuuaccauggccagagagaugaccauccugggcagcgcugugcucacacugcuucuggccggguaccucgcgcagcaauaucugccccuuccuacgccgaaggucauuggaaucgaccugggcaccacauacugcuccguugggguguucuuucccggaaccggcaaagugaaggucauuccugaugaaaacgggcacaucucuauucccagcaugguguccuucacagacaaugauguuuaugugggauacgagucugucgaacucgcugacagcaacccucagaauaccaucuaugaugccaaacgguuuaucggcaagauuuucacagccgaggaacuggaggcugagaucggccgcuaccccuuuaaagugcugaacaagaaugggaugguugaguucuccgugaccucuaacgaaacgauuaccgucagcccugaauaugugggauccagacuccugcuuaagcugaaagagauggccgaggcuuaccucggcaugccgguggccaaugcggucaucagcguucccgccgaauuugaccugaagcagcggaacucuacaauugaggcugccaaucuugcugggcugaaaauccuccgcgugauuaacgaaccuaccgccgcggccauggcuuacggacugcauaaggccgauguguuccacguccuggugaucgaccucggcgggggaacacuggauguuucccuucugaauaaacagggcggcauguuucucaccagagcuaugagcgggaacaauaagcugggaggccaagacuucaaccagcggcuucugcaguaucucuacaagcagaucuaucaaacguacggguuugugcccucucgcaaagaggaaauucauagacugcggcaggccgucgagauggugaagcugaaucucacacugcaccaguccgcccagcuuagcguucugcucaccguggaggaacaagaucgcaaagagccucauucuuccgacacagaacugcccaaggauaaacuuagcuccgcugacgaccacagagucaacucuggauucggccgggggcugagcgauaagaaauccggagagagccaggugcucuuugaaaccgagaucucucgcaagcuguucgacacccugaacgaggaucucuuccagaagauucuggucccgauccaacaggugcuuaaagaaggccaccuggagaagacagaaauugacgagguugugcucgucggcggguccacgagaaucccucggauccgccaggugauucaggaauuuuucggaaaagaucccaauaccagcguugacccugaucuggcgguggucacaggcguggccauccaagcugggauugacggaggcucuuggccccuucaggugagcgcccuggagauccccaacaagcaucuccagaaaaccaauuuuaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3119 - RNA, 1912 nt, Artificial Sequence
  mRNA product Design2 comprising derived and/or modified sequence from Homo sapiens__NP_057383.2__HsHSPA14 (opt5)
ggggcgcugccuacggagguggcagccaucuccuucucggcaucaagcuuaccauggccgcuaucggcguccaccuggggugcaccagcgccugugucgcgguuuacaaggacggcagagcuggagugguggccaacgaugccggggaccgggucacacccgcugugguugccuauuccgagaaugaagagauugugggacucgcugccaaacagucucgcaucagaaacauuagcaauacggucaugaaggugaaacaaauccugggccgguccucuagcgauccucaggcgcagaaguacauugccgaauccaaaugccuuguuaucgagaagaacgggaagcugcgcuaugaaaucgacaccggagaggagacaaaauucgugaauccggaagaugucgcuagacucaucuuuucuaagaugaaagagaccgcccauagcgugcugggcuccgacgcuaacgauguggucauuacaguucccuucgacuuuggcgaaaagcagaaaaaugcccuuggggaggcggcccgggcugccggauucaacgugcugcgccucauucacgagccuagcgcugcccugcuggccuacggcaucgggcaagauucucccaccggaaaguccaauauucucguguuuaagcugggcgggacaagccuuucucuguccgucauggaagugaacagcggaaucuauagaguucucucuaccaauacggacgauaacauuggcggcgcucauuucaccgagacacuggcgcaguaccuugccuccgaauuucagcggagcuucaaacacgacgugcgcgggaaugcuagagccaugaugaagcugaccaacuccgccgaggucgcuaaacauucucucagcacacugggauccgccaauuguuuucuggauagccucuaugaaggccaggacuucgacugcaacgugucucgggcgcgcuuugagcugcuuuguuccccucuguucaacaagugcaucgaggcuaucagagggcuccuggaucaaaauggauuuaccgccgacgauauuaacaaaguugugcuuuguggcgggagcucucggauccccaagcugcagcagcucauuaaagaccuguucccugccgucgaacugcucaauagcaucccgcccgaugaggugauuccuaucggagcugccaucgaagcuggcauucugaucggcaaggagaaccuucuggucgaagacucccucaugauugagugcucugcccgcgauauccuggugaaggggguugacgagagcggagcguccagauucacggugcuuuuucccagcggcacaccucugcccgcccggagacagcacacccuccaagcuccggggucuauuuccagcgucugucuggaacuguacgagucugauggcaaaaauuccgccaaggaagagacaaaauucgcucaggugguucuccaggaccuggauaagaaagaaaacggacuucgcgacauccuggccgugcucaccaugaagcgggacgggagccugcacgugaccugcacagaucaagagacgggcaagugugaggcgaucuccauugaaaucgccucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3120 - RNA, 2959 nt, Artificial Sequence
  mRNA product Design2 comprising derived and/or modified sequence from Homo sapiens__NP_006635.2 __HsHSPH1 (opt5)
ggggcgcugccuacggagguggcagccaucuccuucucggcaucaagcuuaccaugagcguggucggccuggacguugggucccagucuugcuacaucgccguggcuagagccggaggcauugagaccaucgcgaacgaauuuagcgaucgguguacacccuccgugauuucuuuugggagcaagaaucgcacgaucggagucgcugccaaaaaccaacagauuacccacgccaauaacacaguguccaauuucaagagauuucauggccgggcuuucaacgacccuuuuauccagaaagagaaggaaaaucucucuuaugaucugguuccgcuuaaaaacgggggagugggcaucaaggucauguacaugggcgaggaacaccuguucagcguggagcagauuaccgccaugcuccugacaaaacuuaaagagaccgcugaaaauucccugaagaaacccguuacagacugcgugaucagcgucccuucuuucuucaccgaugccgagcgcagauccgugcucgacgcggcccaaauuguggggcugaacugucugcggcucaugaaugauaugacggcugucgcccugaacuauggaaucuacaagcaggaccuucccagccuggaugaaaaaccucgcauuguuguguuuguggacaugggccauucugcuuuccaggucuccgccugcgcguuuaauaaggggaagcucaaagugcugggaaccgccuucgaucccuuucuuggcgggaagaacuucgacgagaaacugguugagcacuucugugcugaauuuaagacaaaauauaagcucgaugccaaaagcaagaucagagcucugcugcggcucuaccaggagugcgaaaagcugaaaaagcugaugucuuccaauagcaccgaccuuccucucaacauugaguguuucaugaacgacaaagauguguccggaaagaugaaucgcucucaauuugaggaacugugcgccgagcuucugcagaaaaucgaagucccgcucuauagccugcuggagcagacacaucucaagguggaagacguuuccgccguggagaucgucggcggcgcuacccggauucccgcggugaaggaaagaaucgccaaauucuuugggaaggauauuagcacgacacugaacgcugacgaggccgucgcccgcggaugugcccuucagugcgcuauccugucuccugcguucaaagugagagaguuuuccguuaccgaugcugugcccuucccuauuagccucaucuggaaucacgacucugaagauacagagggcguccacgaaguguuuagccggaaccaugccgcccccuucuccaagguucugaccuuucuucgcagagggccguucgagcuggaggcuuuuuacucugacccucaaggagugcccuacccugaagccaaaaucggccgguucgucgugcagaaugugagcgcucagaaggauggggagaaguccagaguuaaagucaaggugcgcgugaacacccacggaauuuucacaaucagcacggccucuauggucgaaaaagugcccaccgaggaaaaugagauguccagcgaggcggacauggaaugucucaaccaacggcccccugagaauccggauacagacaagaacguucagcaggacaauucugaagccggcacccagccccaagugcagacagaugcucagcagaccucccaaagcccucccuccccugagcugacgucugaagagaacaaaauucccgacgccgauaaggcuaaugagaagaaagucgaccagccgccugaagccaagaaacccaagaucaaagugguuaacguggagcugccuauugaagcgaaucucgucuggcagcugggcaaggaucuucugaacauguauaucgagacagaagggaaaaugaucaugcaggacaagcucgagaaggagagaaacgaugccaaaaaugcuguggaagaguacguuuaugaauuucgcgacaagcugugcggacccuacgagaaauucauuugcgaacaagaucaucagaacuuucugcggcuucucaccgagaccgaggacuggcuguaugaagagggcgaagaucaggccaagcaggcuuacguggacaaacuggaggagcucaugaagaucgggacaccugucaaggugagauuccaagaagccgaggaacgccccaaaauguuugaggaacugggacagcggcuucagcacuaugccaagauugcugcggauuucagaaauaaagacgagaaguacaaccacaucgacgagagcgaaaugaaaaagguggagaaguccgucaaugaaguuauggaguggaugaacaaugugaugaacgcccaagcuaaaaagucucuggaucaggacccggugguccgcgcccaggaaauuaaaaccaagaucaaagagcucaauaacacaugugagccugugguuacgcagcccaagcccaagauugaaagcccuaaacuggagcggaccccgaauggccccaacaucgauaagaaagaagaggaccuggaagauaagaauaacuuuggggccgagccuccccaucaaaauggcgagugcuacccuaacgaaaagaacuccgugaauauggaccuugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3121 - RNA, 3382 nt, Artificial Sequence
  mRNA product Design2 comprising derived and/or modified sequence from Homo sapiens__NP_006380.1 __HsHYOU1 (opt5)
ggggcgcugccuacggagguggcagccaucuccuucucggcaucaagcuuaccauggccgacaaggugagacggcagcgccccagacggcgcgucugcugggcucugguugccgugcuccuggcggaucuucuggcucucagcgacacccuggccgugauguccgucgaucuuggcucugagagcaugaaaguggccaucguuaagccuggggugccgauggaaaucguccugaacaaagaguccagacggaagacacccgugaucguuacgcucaaagaaaaugagcgcuucuuuggagacucugcugccagcauggcuauuaagaacccuaaggccacccugagauacuuccaacaucugcucggcaaacaggcggauaauccccacguggcccuguaucaggcucgguuuccugaacacgagcuuacauucgacccccagcgccaaaccguccauuuucagaucuccucucagcugcaguucagcccugaggaagugcucgggauggugcugaacuacuccagaagccuugccgaggauuuugcugaacaaccgauuaaggacgccgucaucacaguucccguguucuuuaaucaggcggagcggcgcgccgugcugcaggcugccagaauggcuggacucaaaguccugcagcugaucaacgauaauaccgccacagcccucucuuauggcguguuccggcgcaaggacauuaacaccacggcucaaaauaucauguuuuacgauaugggguccggaagcaccguuuguacaauugugaccuaucagauggucaaaacaaaggaggcgggcaugcagccucaacugcagaucagaggcgugggguucgaccggacccuuggaggccuggaaauggagcucagacugcgcgaacggcuugccgggcuguuuaacgagcagagaaagggacagcgcgcuaaagauguucgggaaaaucccagagccauggccaagcuccugcgcgaggcuaaccggcugaaaacggugcucucugccaaugcggaccacauggcucaaauugagggccugauggacgaugucgacuucaaggccaaagugacaagagucgaguucgaggaacuuugcgccgaucuguuugagcgcgugccugggcccguucagcaggcucuccaguccgccgaaaugagccuggacgagaucgagcaagugauucuugucggaggcgcuacccgggugccgagaguucaggaagugcugcucaaggccgucggcaaagaggaacuggggaagaacaucaaugcggaugaggccgcugccaugggagcuguguaccaggccgcggcccugucuaaggcuuucaaagugaagccuuuuguuguccgcgacgccgugguguaucccauccucgucgaguucacacgggagguggaggaagaaccuggcauucauucccugaaacacaacaagagaguucuuuuuagccggauggggcccuacccccagcgcaaagugaucaccuucaacagauacucccacgauuuuaauuuccauauuaacuauggagaccugggcuuucucgggccugaagaucugcgggucuucggaucucaaaaucugaccacagugaagcucaagggcguuggcgacagcuuuaaaaaguacccggauuaugaguccaaagggaucaaggcucacuucaaccucgacgagagcggagugcugucucuggacagagucgaauccguguuugagacgcucguugaagauagcgccgaggaagagucuacccugacaaaacuuggcaauaccauuagcucccuguucgggggaggcacaacccccgacgccaaggagaacgggacggauacagugcaggaagaggaagagucuccugcugaaggcagcaaggacgagcccggagagcaggucgaacucaaagaggaagcggaggccccuguggaagauggcucccagcccccgccucccgagccuaagggggacgcuacccccgagggagaaaaagccaccgagaaggaaaauggcgauaaaagcgaggcccaaaagccuucugagaaggcugaagccgggcccgagggaguggcgccggcuccugaaggcgagaaaaagcagaaacccgcccgcaagcggagaauggucgaagagaucgggguugagcugguggugcuggaccuucccgaucucccugaagacaaacuggcccaguccguccaaaagcugcaggaucucacacugcgcgaccuugagaaacaggaaagagagaaggcugccaacagccuggaagcguucaucuuugagacccaggauaagcucuaccaaccggaguaucaggaagugucuacagaggaacagcgggaggaaauuuccggcaaacugagcgcugccuccacguggcuggaggacgagggaguuggcgccaccacagugaugcuuaaggaaaaacucgcugagcugcgcaagcugugucaggggcuuuucuuuagagucgaagaacggaaaaaguggcccgagcgccugucugcccuugacaaucugcucaaccauagcuccauguuccugaagggagcuagacugaucccugaaauggaucaaauuuuuaccgagguggaaaugacaacccuugagaaaguuaucaaugaaacgugggccuggaagaacgcgacccucgccgagcaggcuaaacugcccgccacagagaagccugugcugcucucuaaagacauugaagcuaagaugauggcccuggaucgggagguccaguaccuucugaauaaggccaaauucaccaagccccgcccuagacccaaagacaagaacggcacacgggcugaaccgccucucaaugcgagcgccuccgaucagggggagaaagugauucccccugcuggacaaaccgaagacgccgagcccaucagcgagccggaaaagguugagacgggcucugaaccuggggauacagagccccuggaacugggcggaccuggcgccgagcccgagcagaaggaacaguccaccgggcaaaaacgcccccuuaagaacgacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3122 - RNA, 2581 nt, Artificial Sequence
  mRNA product Design2 comprising derived and/or modified sequence from Homo sapiens__NP_005339.3 __HsHSP90AA1 (opt5)
ggggcgcugccuacggagguggcagccaucuccuucucggcaucaagcuuaccaugcccgaggaaacccagacacaagaccagcccauggaggaagaggaaguggagacguucgccuuucaggcugagaucgcccagcugaugagccucauuaucaacaccuucuacuccaauaaggaaauuuuucugagagagcuuaucucuaacagcuccgaugcgcuggacaaaauucgguaugaaucucucacagauccgagcaagcuggacuccggcaaagagcuucacaucaaucugauccccaacaagcaagaucgcacccucacaauugucgacaccgggaucggaaugacaaaagcugaucugauuaauaaccugggcaccaucgccaagucugggacgaaggccuucauggaggcucuccaggccggagcugacauuagcaugaucggccaguuugggguuggauucuacuccgccuaucugguggcggaaaaagugaccgucauuacaaagcauaaugaugacgagcaguacgccugggaaagcucugcuggcggcuccuuuaccgugagaacagauaccggggagccuaugggacggggcacgaaaguuauccuucaccugaaggaagaccaaacagaguaucucgaggaacgcagaaucaaagagauugugaagaagcauagccaguucaucggguaccccauuacccuguuugucgaaaaagagcgggauaaggaagugucugacgacgaggccgaggaaaaagaggauaaggaagaggaaaaagagaaggaggaaaaagaguccgaagacaagccugagaucgaggauguuggaagcgacgaagaggaagagaagaaagauggcgacaagaaaaagaaaaagaagauuaaagaaaaguauaucgaucaggaggagcuuaacaaaacaaagcccaucuggacccgcaauccugacgauauuaccaacgaagaguacggggaguucuacaaaucucugacaaaugacugggaggaucaccucgcugugaagcauuuuuccgucgaaggacagcuggaguucagagcccugcucuuugugccgcggcgcgcgcccuucgaccuguucgagaacagaaagaaaaagaauaacaucaaacuuuaugugcggcgcgucuuuauuauggacaauugcgaagaacugaucccugaauaccucaacuucauuagaggcguuguggauagcgaggaccugccccuuaacaucucccgggaaaugcugcaacagucuaagauccucaaagugauucgcaagaaucuggucaagaaaugucuggagcucuuuacggagcuggccgaagauaaggagaacuauaaaaaguucuacgaacaguuuagcaaaaauaucaaacuuggcauucacgaggacucccaaaacagaaagaagcugagcgagcuccugcgguauuacaccucugcuuccggggaugaaauggugagccuuaaggacuauugcacaagaaugaaagagaaucagaagcacaucuacuacauuaccggagaaacaaaagaucagguugccaacucugcuuucguggagcgccugcggaagcauggccucgaagucaucuauaugauugagccuaucgacgaguacugugugcagcaacugaaagaauuugaggggaagacccugguuagcgugacgaaggaaggacucgagcugcccgaagaugaggaggagaaaaagaaacaggaagaaaagaaaacaaaguucgagaaucuuugcaagaucaugaaagacauucuggaaaagaaagucgagaagguggucguguccaacagacucguuaccucuccguguugcaucgugaccagcacauauggcuggaccgccaauauggagcgcauuaugaaagcccaggcucugcgggauaacuccacaaugggguacauggcggccaagaagcaccuggaaaucaauccugaccauagcauuaucgagacgcuuagacagaaagcugaagccgauaagaacgacaaaucugucaaggaccucgugauccugcuguaugagaccgcccuccuguccagcggauuuucucuugaggauccccaaacacacgcuaaucgcauuuaccggaugaucaaacugggccucggcauugacgaagaugacccuaccgccgaugacacauccgcggcuguuaccgaggaaaugccuccccuggagggggaugacgauacgagcagaauggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3123 - RNA, 721 nt, Artificial Sequence
  mRNA product Design2 comprising derived and/or modified sequence from Homo sapiens__NG_005218__HsHSP90AA3P (opt5)
ggggcgcugccuacggagguggcagccaucuccuucucggcaucaagcuuaccauggacagcuccaagcuggauucuggcaaagggcuccacaucaaccuggugcccaauaagcagaaccaaacccuuacaauugucgacacgagaaucggaaugaccaaaacagaucugauuaauaaccucggcaccguuacaaagagcgggaccaaagccuucauggaggcucugcaggccgacgcggauaucuccaugauuggacauuuuggcgugggguucuacucugcuuaucuuguggccaagaaggucacagugaucagcaaacacaauaacgacgaacaguacaccugggaguccucugccggaggcagcuuuacgguucggaccgaugaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3124 - RNA, 2557 nt, Artificial Sequence
  mRNA product Design2 comprising derived and/or modified sequence from Homo sapiens__NP_031381.2__HsHSP90AB1 (opt5)
ggggcgcugccuacggagguggcagccaucuccuucucggcaucaagcuuaccaugcccgaggaagugcaccauggcgaggaagaggucgaaaccuucgccuuucaggcugagaucgcccaacugaugagccucauuaucaacacauucuacuccaauaaggagauuuuucugagagaacuuaucucuaacgcgagcgacgcucuggauaaaauucgguaugagucccucacggacccuucuaagcuggauagcgggaaagaacuuaagaucgacaucauuccgaauccccaggagcgcacccugacacucguugauaccggaaucggcaugacaaaagccgaccugauuaacaaucuggggaccaucgccaaguccggaacaaaggcuuucauggaggcccuccaggcuggcgccgauauuucuaugaucgggcaguuuggagugggcuucuacagcgcguaucugguggccgaaaaagucgugguuauuaccaagcacaacgacgaugagcaauacgcuugggaauccagcgccggcgggucuuuuacggugagagcugaccauggagagccuaucggccgggggaccaaagucauccuucaccugaaggaagaucagacagaguaucucgaggaacgcagagugaaagagguugugaagaagcauucccaguucauuggauaccccaucacccuguaucuugaaaaagagcgggaaaaggagauuagcgacgaugaggccgaagaggaaaaaggcgagaaggaagaggaggacaaagacgaugaagagaagccuaaaaucgaagacgucgggucugaugaggaggacgauuccggaaaggacaagaaaaagaaaacaaagaaaauuaaggaaaaguacaucgaucaggaggaacugaauaaaaccaagcccaucuggacgcgcaacccugacgauauuacacaagaggaauacggcgaguuuuauaaaagccucaccaaugacugggaggaucaccuggcggugaagcacuucucuguggaaggccagcuggaguuuagagcccuccuguucaucccgcggcgcgcucccuuugaccuuuucgaaaacaaaaagaagaaaaauaacauuaagcuguacgucagacggguuuucaucauggacuccugcgaugagcucauuccugaauaucugaauuuuauccgcggggugguggacagcgaggaucuuccccugaacaucuccagagagaugcuccagcagucuaaaauucugaaggucauccggaaaaauauugugaagaagugucuggaacucuucagcgagcuggccgaagacaaagagaacuacaagaaauuuuaugaggcuuucuccaagaaccuuaaacugggaauccaugaggauagcacaaaucgcagacggcucucugagcugcuuagauaccacaccucccaaagcggcgacgaaaugaccucucugagcgaguauguuucccgcaugaaggaaacacagaaaucuauuuacuacaucacgggggagagcaaggaacagguggccaacuccgccuuugucgaacgggugagaaagcgcggauucgagguuguguauaugaccgaaccuauugaugaguacugcguccaacagcucaaagaauuugacggcaagagccuggugucugucacaaaagaggggcuggagcuccccgaagaugaggaagagaagaaaaagauggaagaguccaaggcuaaauucgagaaucuguguaaacuuaugaaggaaauccuggacaagaaaguggagaagguuaccaucagcaaccggcucgugucuuccccgugcuguauugucacaagcaccuauggauggacggcgaauauggaaagaaucaugaaggcccaggcucugcgcgauaacuccacaaugggcuacaugauggccaaaaagcaucuggagauuaauccugaccaccccaucguggaaacccuucggcagaaagccgaggcugauaagaacgacaaagccguuaaggaccucgugguccugcuguuugagaccgcgcuccugucuagcggcuucucccuugaagauccucaaacacacucuaauagaauuuaucgcaugaucaagcuggggcucggaaucgacgaggaugaaguggcugccgaggagcccaacgccgcugugcccgacgaaauuccuccgcuggagggcgaugaagacgccagccggauggaggaaguugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3125 - RNA, 2794 nt, Artificial Sequence
  mRNA product Design2 comprising derived and/or modified sequence from Homo sapiens__NP_003290.1__HsHSP90B1 (opt5)
ggggcgcugccuacggagguggcagccaucuccuucucggcaucaagcuuaccaugagagcccugugggugcucggccugugcuguguccuucugaccuucgggagcguucgggcugacgaugagguggacguggauggaacagucgaagaggaccucggcaagucccgcgaagggucuagaacggaugacgaggugguucagcgggaagaggaggccauccaacuggauggacuuaacgcgagccagauucgcgaacugagagagaaauccgaaaaguuugcuuuccaggccgaggugaaucggaugaugaaacucaucauuaacucucuguacaagaauaaagagaucuuucugcgcgaacucauuagcaacgccuccgacgcucuggauaagaucagacuuaucucucugaccgacgagaaugcccucagcggcaacgaagaacugacagucaagauuaaaugcgauaaggagaaaaaucuucugcacgugaccgacacagggguuggaaugacccgggaggagcucgugaagaaccugggcacaaucgcuaaauccggcaccagcgaguuccugaauaagaugacggaggcccaggaagaugggcaaucuaccuccgagcucauuggacaguuuggcgucggguucuauagcgcguuucugguggccgacaaggugaucgucacaucuaaacauaacaaugacacccagcacauuugggaauccgauagcaacgaguucucuguuaucgcugacccccgcggaaauacacuuggcagagggaccacgauuacacuggugcucaaggaggaagccuccgauuaccuggagcuugacaccaucaaaaaccuggugaagaaauauagccaguuuaucaauuucccuauuuacgucugguccucuaagacagaaaccguggaggaaccgauggaggaggaagaggcugccaaagaagagaaggaggaaagcgaugacgaggcggccguugaagaggaagaggaggaaaagaaacccaagaccaaaaagguggagaaaacagucugggauugggaacucaugaacgacaucaagccuauuuggcaacggcccuccaaggagguggaagaggaugaguauaaagccuuuuacaagagcuucucuaaagaauccgacgauccuauggcuuauauccauuuuacggcugagggagaaguuaccuucaagagcauucuguucgugcccacaucugccccucgcggccuguuugacgaguacggcagcaaaaaguccgacuacaucaagcucuaugucagacggguguucaucaccgaugacuuucacgauaugaugccgaaauaccugaacuucgucaagggggugguugacucugaugaccuuccccugaaugugagccgcgaaacacuccagcagcauaaacugcuuaaggucauucggaaaaagcuggugagaaagacccucgauaugaucaaaaagauugccgacgauaaauauaacgacacguuuuggaaggaguucggaacaaauaucaaacugggcguuauugaggaucacuccaacagaacccgccuggcuaagcuccugcgguuucagagcucucaccauccuaccgacaucacaucccuugaucaauacguggaaagaaugaaagagaagcaggacaagaucuauuucauggcggggagcucucgcaaagaagccgaguccagccccuuugucgagcggcugcucaagaaaggauacgaagugauuuaucugaccgagccuguggacgaauacuguauccaggcucugcccgaguucgauggcaagagauuucaaaauguugccaaagaaggggucaaguucgacgaguccgagaagacaaaagaaucucgcgaggccguggaaaaggaguuugaaccgcuucucaacuggaugaaagauaaggcucugaaagacaagauugagaaggccguggucagccagcggcugacggaguccccuugcgcgcucguggcuucucaguacggauggagcggcaauauggaaagaaucaugaaagcccaggccuaucaaaccggcaaggauauuuccacaaacuacuaugcuagccagaaaaagaccuucgagaucaauccccgccacccucugauucgggacaugcuuagacgcaucaaagaagaugaggacgauaagacaguucuggaccucgccgugguccuguucgaaaccgcuacgcugcggucuggguaccuucuccccgauaccaaggccuauggagacagaaucgagcggaugcugcgccugucccucaacauugaucccgacgcgaaaguggaggaagaaccugaagaggagccggaagagacagccgaagacaccacagaggauaccgaacaggacgaggaugaggaaauggacguuggcacggaugaggaagaggaaacagcuaaggagagcaccgccgagaaagacgaacugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3126 - RNA, 2497 nt, Artificial Sequence
  mRNA product Design2 comprising derived and/or modified sequence from Homo sapiens__NP_057376.2__HsTRAP1 (opt5)
ggggcgcugccuacggagguggcagccaucuccuucucggcaucaagcuuaccauggccagagagcugcgggcucuccugcuuuggggccgcagacugcggccccuccugcgcgccccugcgcuugcugccgugcccgggggaaagccgauccugugcccuagacggaccacagcccagcucggcccccgcagaaacccugcuuggagccugcaagccgggcggcuguucuccacgcagaccgcugaagacaaagaggaaccccuccacucuauuaucagcuccacagagucuguccagggaagcaccuccaagcaugaauuucaggccgagacaaagaagcugcuugauauuguugcgcgcucucuguacagcgagaaagaaguguucaucagagagcucauuuccaaugccagcgacgcucuggaaaaacuucggcacaagcuggugucugauggccaagcccucccugagauggagauccaucugcagaccaacgcugaaaaagggacaaucaccauucaggacacgggaaucggcaugacccaggaggaacuggucuccaaucucggcacaauugcccgcagcgggucuaaggcguuucuggaugcccuucaaaaccaggcugaggccuccagcaaaaucauuggacaguucggcgugggguuuuauucugcuuucaugguugccgacagaguggaagucuacucccggagcgccgcuccgggaucccugggcuaucaguggcucucugaugggagcggaguguuugagaucgcggaggccuccggcguucgcaccggcacaaagauuaucauccaccugaaaagcgacuguaaggaguucucuuccgaggcuagagugcgggaugucgugaccaaguacagcaauuuugugucuuucccccuuuaucugaacgggagacgcaugaauacgcuccaagccauuuggaugauggacccuaaagauguccgggaauggcagcaugaggaauuuuacagauauguugcccaggcucacgacaagccccgcuacacacugcacuacaaaaccgaugccccucugaacauccggagcauuuucuaugugcccgacaugaagccguccauguuugacgugucuagagagcucggaagcuccgucgcgcuguacagccgcaaagugcuuauccaaacaaaggcuaccgauauucugccuaaauggcuccgguucaucagaggcguuguggacucugaggauaucccccugaaucuuucccgcgaacugcuccaggagagcgcccugauucggaagcugagagacguccuccagcagcgccugaucaaguucuuuauugaucaaucuaaaaaggacgccgaaaaauaugcuaaguucuuugaggauuacgggcuuuucaugcgggaaggaaucgugaccgccacagagcaggagguuaaagaagacauugcuaagcugcucagauaugaguccagcgcccugccuuccggccagcugacgucucuuagcgaauacgcgucccggaugcgcgccgggaccagaaacaucuauuaccucugcgcucccaaucggcaucuggccgagcacucucccuacuaugaggcuaugaagaaaaaggauacagaagugcuguuuuguuucgagcaguuugacgaacucacccugcuucaucugagagaguucgauaaaaagaaacucaucagcgucgaaacagacauuguggucgaccacuacaaggaggagaaguuugaagaucgcuccccugccgcggagugccugagcgaaaaagagaccgaagaacugauggccuggaugcggaacgugcuuggaucuagaguuacgaaugugaaggucacacuccgccuggacacccacccggcuauggugaccguucuggagaugggcgccgcuagacauuuccuccggaugcaacagcuggccaaaacacaggaggaacgcgcccagcuucugcaacccacccucgaaaucaacccuagacacgcucugauuaagaaacugaaucagcuucgggcguccgagcccggccucgcccagcugcugguggaucagaucuaugaaaacgcuaugauugccgccgggcucgucgacgauccucgcgcuauggugggaagacugaacgagcuucuggugaaggcccucgagcggcauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3127 - RNA, 844 nt, Artificial Sequence
  mRNA product Design2 comprising derived and/or modified sequence from Homo sapiens__NP_000609.1__HsIGF1 (opt5)
ggggcgcugccuacggagguggcagccaucuccuucucggcaucaagcuuaccaugggcaagaucagcucccugcccacccagcuuuucaaaugcuguuuuugcgacuuccugaaggugaaaaugcacacaaugucuagcucccaucucuuuuaccuggcccucugucugcuuacguucaccucuagcgcuacagccgggccugagacccugugcggagcggaacucgucgaugcucugcaauuuguuuguggcgacagaggguucuauuuuaacaagccgacaggauacggcuccucuagccggcgcgcuccccagaccgggauuguggaugagugcuguuucagauccugcgaccugcggcgccucgaaauguauugugccccucugaaacccgccaagagcgccagaucugugcgggcucagcgccacacagauaugccuaagacccagaaagagguccaucuuaagaaugccuccagaggaagcgcgggcaacaaaaauuaccggaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3128 - RNA, 925 nt, Artificial Sequence
  mRNA product Design2 comprising derived and/or modified sequence from Homo sapiens__NP_000603.1__HsIGF2 (opt5)
ggggcgcugccuacggagguggcagccaucuccuucucggcaucaagcuuaccaugggcauccccaugggaaagagcaugcuggugcuccugaccuuccuugccuuugcuuccugcuguauugccgcguacagaccuucugagacacugugcgggggcgaacucgucgacacgcugcaguucguuuguggggaucggggauuuuauuucagccgcccggcuuccagagugucucggcgcagcagaggcaucguggaggaaugcuguuuucgguccugcgaccuugcccugcucgagaccuacugugccacacccgcuaaaucugaacgcgaugucagcaccccucccacagugcugccugacaacuuccccagauauccuguugggaaguuuuuccaauacgauaccuggaaacaguccacacagcggcugcgcagaggacucccggcccugcuucgggcucgcagaggccacgugcuggccaaggagcucgaggcguuucgggaagccaaacgccauagaccccugauugcccuuccuacccaggaccccgcucacggcggggcuccucccgagauggccagcaaucggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3129 - RNA, 1021 nt, Artificial Sequence
  mRNA product Design2 comprising derived and/or modified sequence from Homo sapiens__NP_000591.1__HsIL6 (opt5)
ggggcgcugccuacggagguggcagccaucuccuucucggcaucaagcuuaccaugaacagcuucuccaccucugccuuuggccccguggcuuucagccuggggcuccugcuuguccugccugccgcguuuccggcucccguuccucccggagaggacuccaaggauguggccgccccucacagacagccccucacaucuagcgaacggaucgacaaacaaauucgcuacauccuggauggcauuuccgcucuuagaaaggagacgugcaauaaaucuaacaugugugaaagcuccaaggaggcccuggcugaaaauaaccucaaucugccuaaaauggccgagaaggacgggugcuuccagagcggauuuaacgaggaaaccugucuggugaagaucauuacaggccuccuggaguucgaagucuaucuugaguaccugcagaaucgguuugagucuuccgaagaacaggcgcgcgccgugcaaaugagcaccaaaguucucauccaguuccugcagaagaaagcuaagaaccuugaugccaucacaaccccggaccccacaaccaaugcuucucugcucacgaaacugcaggcccaaaaccaguggcugcaggauaugaccacacaucucauucugagauccuuuaaggaguuccuucagagcucucugcgggcgcuccgccaaaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3130 - RNA, 1663 nt, Artificial Sequence
  mRNA product Design2 comprising derived and/or modified sequence from Homo sapiens__NP_002183.1__HsINHBA (opt5)
ggggcgcugccuacggagguggcagccaucuccuucucggcaucaagcuuaccaugccccugcucuggcugagaggcuuccuucuggccagcugcuggaucauugugcgguccucuccuaccccggggagcgagggacacuccgcugcccccgacuguccuucuugcgcgcucgcugcccugcccaaggaugucccuaacagccagcccgaaaugguugaggccgugaaaaagcauauccuuaauaugcugcaccucaaaaagcgcccugacgugacacaaccgguccccaaagcugcccugcugaacgcuauuagaaagcuccaugugggcaagguuggggaaaauggauacguggagaucgaagaugacauuggccggcgcgccgagaugaacgagcugauggaacagacguccgagaucaucaccuuugcggaaucugggacagccagaaaaacccuucacuucgagauuagcaaggagggauccgaucugagcgucguggaacgggcugagguuuggcucuuucugaaagugccuaaggccaaucgcacaagaaccaaagucacaauccggcuuuuccagcagcaaaagcauccccagggcucucuggacaccggcgaagaggcugaagagguggggcucaagggagagcgcuccgaacugcugcucagcgagaaaguggucgaugccagaaagucuacguggcacguuuuuccuguguccagcucuauucagcggcugcuugaccagggcaaauccagccuggaugugcgcaucgcgugugaacaaugccaggaguccggggccucucucguccugcuuggaaagaaaaagaaaaaggaagaggagggcgaagggaagaaaaagggaggcggcgaagggggagcuggcgccgacgaggagaaagaacagagccacagacccuuccugaugcuccaggcucggcaauccgaggaucauccgcaccgcagacggagacgcgggcuggagugugacggaaaggugaacauuugcuguaaaaagcaguuuuucguuagcuuuaaggauaucggcuggaaugacuggauuaucgccccuucuggguaucaugccaacuacugcgaaggagagugucccucccacaucgcuggcaccagcggcucuagccuguccuuccacucuacagugauuaaucauuaucggaugagagggcacagcccuuuugcgaaccucaaauccugcuguguccccaccaagcugcgccccaugagcaugcuuuacuaugacgauggacagaauaucauuaaaaaggacauccaaaacaugauuguggaagagugcggcugcucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3131 - RNA, 1606 nt, Artificial Sequence
  mRNA product Design2 comprising derived and/or modified sequence from Homo sapiens__NP_002184.2__HsINHBB (opt5)
ggggcgcugccuacggagguggcagccaucuccuucucggcaucaagcuuaccauggacggccugcccgggagagcccucggagcugccugccugcuucugcucgcggcuggcuggcuggggccugaggccuggggaagcccgacacccccucccaccccugccgcucccccuccgcccccucccccuggcucccccgggggaucucaggauacguguaccagcugcggcggcuuccggcgcccggaggaacuugggagaguggacggagauuuucuggaagccgucaagcggcacauccucucccgccugcaaaugagaggccggccuaacauuacacaugcuguucccaaagccgcgauggugaccgcccugcgcaagcuccacgcugggaaagugagagaggacggacgggucgaaaucccucaucuggauggccacgccucucccggggcugacggacaggagcgcgugagcgagauuaucuccuucgccgaaacagauggccuugcgucuagcagaguucggcuguacuuuuucauuuccaaugagggcaaccagaaucucuuugugguccaggccagccuguggcuuuaucugaagcuccugcccuacgugcuggaaaaagggucucgcagaaagguucgggugaaggucuauuuccaagagcagggacauggcgaccgcuggaacaugguggagaaaagaguggaucucaagcgguccggguggcacaccuuuccucugacagaagcuauccaggcccuuuucgagagaggagaacgccggcugaaucucgacguccagugugauagcugccaagagcuggcuguugugccgguguuugucgaccccggcgaagagucucacagaccuuucgugguugugcaggcccgccuuggggauucccggcauagaauccgcaaacggggacuggagugugacggcagaaccaaccucugcugucgccagcaguuuuucauugacuuucggcugaucggcuggaaugauuggauuaucgcccccacgggguacuauggaaacuacugcgaaggcagcuguccugcuuaucuggcggggguccccggaucugccuccagcuuccacaccgcugugguuaaucaauacagaaugcgcggccucaacccggggacagucaauuccugcuguauuccuaccaagcugucuacaaugagcaugcuuuacuucgacgaugaguauaacaucgugaaacgggacgugcccaauaugauugucgaagagugcggcugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3132 - RNA, 3841 nt, Artificial Sequence
  mRNA product Design2 comprising derived and/or modified sequence from Homo sapiens__NP_000623.2__HsITGAM (opt5)
ggggcgcugccuacggagguggcagccaucuccuucucggcaucaagcuuaccauggcccugagagugcuccugcuuaccgcucugacacucugccacggcuucaaccuggacacggagaaugccaugaccuuucaggaaaacgcgcggggguucggacaaagcgugguucagcuucagggcucccgcgugguggucggggcuccccaggagaucguggccgccaaucaaagaggaucucuguaccagugugauuauagcacaggcuccugcgaaccuauucggcuccagguuccgguggaggcugucaacaugucucuggggcugagccucgccgcuaccacauccccuccucagcugcuugccuguggacccaccgugcaucaaacaugcucugaaaauaccuacguuaagggccuguguuuucucuucggcagcaaccugcgccagcagccucagaaauuucccgaggcgcuuagagggugcccucaagaggacuccgauaucgccuuccugauugacggaagcggcucuaucauuccgcacgauuuucggcgcaugaaggaguucguguccacggucauggaacagcucaaaaagagcaaaacccuguuuucucugaugcaguauuccgaagaguucagaauccauuuuacauucaaggaguuucaaaauaaccccaauccucggagccucgugaagcccaucacccagcugcuugggcgcacacacaccgcuacgggaauuagaaaagugguccgggaacuguucaacaucacaaauggcgcccgcaagaacgcuuucaaaauucucguugugaucaccgacggggagaaguuuggagauccucugggcuacgaagacgugauucccgaggccgauagagaaggcgucauccgguaugugauugggguuggagacgcguuccgcucugagaaauccagacaggagcuuaauacaaucgccagcaagccgccucgggaucauguguuucaggucaacaauuucgaagcucugaagaccauccaaaaccagcucagagagaaaauuuuugccaucgaaggcacccagacaggguccucuagcuccuucgagcacgaaaugagccaggagggauuuucugcugccauuacguccaacggcccccugcugagcaccguggggucuuacgacugggccggaggcguuuuccucuauacaagcaaggagaaauccaccuuuaucaauaugacacgcguggauucugacaugaacgacgcuuaccugggcuacgcggccgcuauuauccuucggaauagaguccaaagccuggugcucggggccccucgcuaucagcacaucggacuggucgccauguuccggcagaacaccggcaugugggaauccaaugcuaacgugaaggggacgcagauuggagccuacuuuggcgcgagccuuuguucuguugauguggacuccaaugggagcacagaucugguccucaucggcgcuccccauuauuacgagcaaaccagaggaggccaggugucuguuugcccccugccucgcgggcgggccagauggcagugugacgccgugcuguauggagaacagggccaaccgugggggcgcuucggagcugcccucaccguccugggcgaugugaacggggacaaacuuacagauguggcuauuggcgcccccggagaggaagacaaucggggcgcgguuuaccuguuucacgggaccuccggaagcggcaucuccccuucucauagccagagaauugccggguccaagcucucuccccgccugcaguauuucggacaaagccuguccggcgggcaggaucuuacaauggacggccucgucgaucugacggugggagcucagggccacgugcugcuccugcggagccagccuguccuuagagugaaagccaucauggaguucaacccccgggagguugcucgcaauguguuugaaugcaacgaccaagucgugaaggggaaggaggccggagaaguuagagugugucugcacguccagaaaucuacccgggacagacuccgcgagggccagauccaguccgugguuacauacgaucuggcgcuggacagcgggcggccgcauucuagagccguguucaaugagaccaagaacuccacacgcagacaaacccagguccuuggacucacgcagaccugcgaaacacugaaacugcagcucccuaauugcauugaggaucccgugagcccuaucgugcugcggcuuaacuuuucucuggucggcacaccccucagcgcuuucgggaaccugcgcccuguucuggccgaagacgcucaaagacuuuuuaccgcccucuuccccuuugagaagaauuguggcaacgauaauauuugccaggacgaucuguccaucaccuucagcuuuaugucucuggacugucucguggugggaggcccgcgggaguucaacgucacggugacaguucgcaaugauggggaagacuccuacagaacccaggugacauuuuucuuuccucuggaucuuagcuaucggaaagucuccacccugcaaaaccagcgcucucagagaagcuggcggcucgccugcgaguccgcuucuagcaccgaaguguccggagcgcugaagucuacaagcuguuccauuaaucaccccaucuuccccgagaacagcgaaguuacguucaauauuaccuuugacguggauucuaaggccucccugggcaacaaacuucuccugaaggcuaaugucacaagcgagaacaauaugccucgcaccaacaaaacagaguuccagcuggaacucccggugaaguacgccguuuauaugguggucaccucucaugggguguccacgaaauaccugaauuuuacagccagcgagaacaccucuagagugaugcaacaccaguaucaggucuccaaccuuggacagcggagccugcccaucucccucguuuuccuggugccugugagacugaaucaaaccgucaucugggaccgcccccaggugacauuuagcgaaaaccuuucuagcacaugccauaccaaggagcggcugccuucccacucugacuuccucgcugaacugagaaaggcccccguugugaauuguagcauugcggucugccagcgcauccagugugauauucccuuuuucggcauccaagaggaauuuaacgcuacgcucaaaggcaaucuguccuucgacugguacauuaagaccucucacaaccaucuucugaucgugagcacagccgagauccucuuuaaugauuccguuuucacccugcugcccgggcagggagccuucgugcggucucagacagagaccaaagucgaaccguuugaggugccuaacccccuuccucugauugucggcagcuccgucgggggacuccugcuccuggcucuuaucacggccgcgcuguauaagcucggcuucuuuaaaagacaguacaaggacaugaugagcgaagggggacccccgggcgcugagccucaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3133 - RNA, 1786 nt, Artificial Sequence
  mRNA product Design2 comprising derived and/or modified sequence from Homo sapiens__NP_002415.1__HsMMP8 (opt5)
ggggcgcugccuacggagguggcagccaucuccuucucggcaucaagcuuaccauguucagccugaagacccuccccuuucugcuucugcuccacgugcagaucuccaaagccuucccugucucuagcaaggagaaaaacacaaagacgguucaagacuaccuggaaaaauuuuaucagcuuccguccaaucaguaccagucuaccagaaagaacggcacaaaugugauuguggagaagcugaaagaaaugcaacgguucuuugggcucaacgucaccggaaagcccaaugaggaaacacuggauaugaugaaaaagccucgcugcggcgugcccgacagcgggggauucaugcugaccccuggcaaccccaaaugggagagaacaaaucucaccuaucggauccgcaacuacacgccucagcuguccgaggcugaaguugagagagccauuaaggaugcguuugaacuuuggucuguggcuagcccgcugaucuucacccggauuucccagggggaggccgacaucaauaucgccuuuuaucagcgcgaucauggagacaacagccccuucgauggcccuaauggcauucucgcucacgccuuucaacccgggcagggaaucggcggggacgcucauuucgaugccgaggaaacauggaccaacacaucugcgaauuacaaccuguuucuugucgccgcucacgaguucggacauucccugggccucgcccacagcucugacccuggggcucugauguaucccaauuacgccuucagagaaaccuccaacuacagccugccgcaggaugacauugauggaauccaggcgauuuauggccucucuuccaacccuauccaacccacgggcccuagcacacccaagcccugugacccuucccugaccuuugacgccauuacaacccuucggggagagauccuguucuuuaaagaucgcuacuucuggagacggcacccgcagcuccagcgcguggaaaugaauuuuaucucucuguucuggcccagccuuccuaccgggauucaagcugccuaugaggacuuugauagagaccugaucuuccucuuuaagggcaaccaguacugggcucuguccggguaugauauucugcagggauaccccaaagacaucagcaauuauggcuucccuucuuccguucaggccauugaugccgcuguguuuuaccggagcaagacauacuucuuugucaacgaccaauucuggcgcuaugauaaucagagacaguucauggagcccggguacccgaaaucuaucagcggagcguuuccuggcaucgaauccaagguggacgccguguuccagcaagagcacuuuuuccaugucuuuucuggcccccgguauuacgcuuucgaucucauugcccagagaguuacgcgcguggcccgggggaacaaauggcugaauugcagauauggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3134 - RNA, 2506 nt, Artificial Sequence
  mRNA product Design2 comprising derived and/or modified sequence from Homo sapiens__NP_004985.2__HsMMP9 (opt5)
ggggcgcugccuacggagguggcagccaucuccuucucggcaucaagcuuaccaugagccuguggcagccccucgugcugguccuucugguucucggcugcuguuucgccgcuccuagacaacggcaguccacccuggugcuuuuuccgggggaccugcgcacaaaccucacggauagacagcuggccgaggaauaccuguaucgguacggauauacccgcguggcggagaugagaggcgaaucuaaaagccucgggcccgcucugcuucugcuccagaaacaacugucccuuccugagacaggagaacuggacucugccacccucaaggccaugcggacaccccgcugcggcgucccugaucuggggagauuccagaccuuugagggagaccugaaauggcaccaucacaauaucacauacuggauucagaacuauagcgaggaucucccccgggcugugaucgacgaugccuucgcucgcgccuuugcgcugugguccgccguuaccccucuuacguucaccagaguguacucucgggacgcugauauugucauccaguuuggcguggccgaacauggcgacggguauccguucgauggaaaggacggccugcucgcucacgccuuucccccugggcccgggauucaaggcgaugcgcauuucgacgacgaugagcuguggagccuugggaaaggaguuguggucccuacacgcuuuggcaaugccgacggcgcugccugucacuuccccuuuaucuucgaagggagauccuacagcgcuugcaccacagauggacggucugacggccugccgugguguuccaccacggccaacuacgauacagacgaucgcuucggguuuugcccuagcgagagacucuauacccaggacggaaaugccgauggcaagcccugucaguucccuuuuaucuuccaggggcaaucuuacuccgcuugcacaaccgacggacggagcgauggcuauagauggugugcgaccacagccaacuacgaccgcgacaagcuguuuggcuucugccccacgcgggcugauucuaccgugaugggaggaaauuccgccggcgagcuguguguguuucccuucacauuucucgggaaagaauauagcacaugcaccuccgagggaagaggcgacgggcgccuguggugcgccaccacgucuaacuucgauagcgacaagaaauggggcuuuuguccugaucagggauacucccuuuuccuggucgcugcccacgaauuuggccaugcgcucgggcuggaccacagcucuguuccggaggcucuuauguaucccauguaccgguucacagaaggaccuccccugcauaaggaugacgugaauggcauuagacaccucuacgggccucgccccgagccggagccucggcccccuaccaccacaacaccccagccuaccgcgcccccgacggugugcccuaccggaccucccacaguccaccccuccgaaagaccgaccgccggccccacagggccucccagcgcuggcccuaccggacccccuacggccggccccucuaccgcuacaaccgugccgcugagcccuguugaugacgccuguaacgugaauaucuucgaugcgauugccgagaucgggaaccaacuguaucucuuuaaagacggaaaguacuggcgcuucuccgaaggccgggggucuagaccccagggaccuuuucugauugcugauaaguggcccgcccuuccgcgcaaacuggacagcgucuucgaggaacggcucuccaagaaacuguuuuucuuuagcggcagacagguguggguuuauacaggggcuucugugcugggcccucggcgccuugacaagcucggacugggcgccgaugucgcccaggugaccggggcccugagauccggacggggcaaaaugcuccuguucagcgggagacgccuuuggcgguuugacgucaaggcucaaaugguggaucccagaucugccuccgagguugaccgcauguucccuggagugccccuggauacgcaugacgucuuucaguacagagagaaggcuuauuucugccaggaucgguuuuacuggcgcgugagcuccagaucugaacucaaucagguugaccaagugggcuaugucacauacgauauccugcagugucccgaggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3135 - RNA, 1798 nt, Artificial Sequence
  mRNA product Design2 comprising derived and/or modified sequence from Homo sapiens__NP_002418.1__HsMMP13 (opt5)
ggggcgcugccuacggagguggcagccaucuccuucucggcaucaagcuuaccaugcaccccggcgugcuggccgcuuuccucuuucugagcuggacccauugcagagcccuuccucugccguccgggggagacgaggaugaccucucugaagaggaucugcaguucgcggaacgguaccuucgcagcuauuaccaccccacaaaccuggcuggcauccucaaggagaaugccgccuccucuaugacggaaagacugcgggagaugcagagcuuuuucgggcuggaggucaccggaaaacucgacgauaacacacuggacguuaugaagaaaccucgcuguggcgugcccgaugugggggaauauaaugucuuuccuagaacccuuaagugguccaaaaugaaccugacauaccggauugugaauuauacccccgacaugacacauucugagguugaaaaggcuuucaagaaagccuuuaagguguggagcgaugucaccccucucaacuucacgcgccugcacgacggaaucgcugauauuaugaucuccuuuggcauuaaagagcauggcgacuucuacccguuugaugggcccagcggacuucuggcccacgcguucccucccggcccuaauuaugggggagacgcccacuuugacgaugacgagaccuggacaucuuccagcaagggcuacaaccucuuccugguggcugcccaugaguucgggcacucucugggacucgaucauuccaaagaccccggcgcucugauguuuccgaucuacaccuauacaggcaagagccacuucaugcuuccugaugacgauguucaagggauccagucucuguacggacccggcgacgaggauccuaaucccaagcaccccaaaaccccugacaagugcgauccgucccucagccuggacgccauuacgucccuuagaggggaaacaaugaucuuuaaagaccgguucuuuuggcgccugcauccccagcaaguggaugcggaacucuuccugaccaagucuuuuuggccugaacugcccaacagaauugacgccgcuuaugagcacccuagccaugaucucaucuucauuuuucggggacgcaaauucugggcccugaauggcuacgacauccuugagggguaucccaagaaaauuuccgaacugggacucccgaaggaggucaagaaaaucagcgcugccgugcacuuugaagauacaggcaagacccugcuuuucucuggcaaccagguguggagauacgacgauaccaaucauaucauggacaaagauuauccucggcugauugaggaagacuuucccgggaucggagauaaggucgacgccguuuacgagaaaaacggcuacauuuauuucuucaaugggccuauccaguuugaguacuccauuuggagcaaccgcaucgugagagugaugcccgcuaacucuauccucugguguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3136 - RNA, 1450 nt, Artificial Sequence
  mRNA product Design2 comprising derived and/or modified sequence from Homo sapiens__NP_001286.1__HsCCR1 (opt5)
ggggcgcugccuacggagguggcagccaucuccuucucggcaucaagcuuaccauggagacccccaacacaacggaagacuacgauaccacaaccgaguucgacuauggcgaugccacaccuugccagaaggugaaugaaagagcuuuuggggcccaacugcucccgccccuguacagccuugucuucguuaucggacuggugggcaacauucucgugguccuggugcuuguucaguauaaacggcugaagaauaugaccuccaucuaccuccugaaccuggcgauuucugaccuccuguuucuuuucacacugccuuuuuggaucgauuauaaacucaaggacgauuggguguucggggacgcuauguguaaaauucugagcggauuuuacuauaccggccuuuacuccgagaucuucuuuaucauucugcucacgaucgaucgcuaccuggccauuguccacgccguguucgcucugagagcccggaccguuacauuuggggugaucaccucuauuaucauuugggcucucgccauccuggcgagcaugcccggacuuuauuucuccaagacacagugggaauuuacccaucacacgugcucucugcauuucccucacgagagccuccgcgaguggaagcuguuccaggcccuuaaacugaaucucuuuggccugguccugccccuccuggugaugaucauuuguuacacaggcaucauuaagauccuucugagacggccuaacgagaaaaaguccaaagcugugcgccucauuuucgucaucaugaucaucuuuuuccuguuuuggaccccguauaaucuuacaauucugauuagcguuuuccaagacuuucucuucacccaugaaugcgaacagucuagacaccuggaucuggccguccaggugaccgaggugaucgcuuacacacacuguugcgugaaccccguuauuuaugccuuugugggggagcgguuccgcaaguaccucagacagcuguuucaucggcgcgucgcggugcaccuuguuaaguggcugccuuuccucuccguggacagacuggaacgggucagcucuacgucccccagcaccggagagcaugaacugucugccggcuuuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3137 - RNA, 1018 nt, Artificial Sequence
  mRNA product Design2 comprising derived and/or modified sequence from Homo sapiens__NP_002598.4__HsPDGFA (opt5)
ggggcgcugccuacggagguggcagccaucuccuucucggcaucaagcuuaccaugagaacccuggccugccuccugcuucugggcuguggguaccucgcucacgugcuggccgaggaagcggagaucccccgggaagucauugagcgccuugcuagaagccagauccauuccauucgggaccugcaacgccuccuggaaaucgauucuguuggaagcgaggacucccuggauacaucucucagagcccacggcgugcaugccacgaagcacgugccugagaaacggccgcugcccauucgcagaaagcggagcaucgaagaggcugucccugccgugugcaaaacccgcacaguuaucuaugaaauucccagaucccagguggacccuaccucugcuaacuuccuuaucuggcccccuugugucgaggugaagcggugcacaggguguugcaauaccagcuccguuaaaugucagccgagccgcgugcaucacagaucugucaagguggccaagguggaguacguccggaaaaagcccaaacugaaggaaguucaggugcgccucgaggaacaccuggagugcgcgugugccacaaccucccuuaacccugauuauagagaagaggacacgggacggcccagagagagcggcaaaaagcgcaagcggaaaagacugaagccuaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3138 - RNA, 1108 nt, Artificial Sequence
  mRNA product Design2 comprising derived and/or modified sequence from Homo sapiens__NP_002599.1__HsPDGFB (opt5)
ggggcgcugccuacggagguggcagccaucuccuucucggcaucaagcuuaccaugaacagaugcugggcccuguuccucagccuguguugcuaccuucggcugguguccgcugagggcgaccccaucccugaggaacucuaugaaaugcugucugaucacagcauucgcuccuuugacgaucuucagagacugcuccauggggacccgggagaggaagauggcgccgagcuggaccugaauaugacccggucucacagcgggggagagcucgaaucccuggcgcgcggcagacggucucuugggagccugacaaucgcugagcccgccaugauugccgaauguaagacgcgcaccgaggucuucgagaucuccagacggcucauugaucgcacaaacgcuaauuuucugguuuggccucccugcguggaagugcaaagauguagcggaugcuguaacaaucggaacguccagugccgcccuacccaggugcagcuuagacccguucaagugcggaaaaucgagaucguccgcaagaaaccuauuuucaagaaagccacagugacccuggaagaccaucucgcuuguaagugcgagacaguugccgcggccagaccggugacccggucucccggcggcucccaggaacagagagcuaagacgccucagacccgcgucacaauccggaccgugagagugcgccggcccccuaaagggaagcacagaaaauuuaagcauacacacgauaaaaccgcccugaaggagacgcugggagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3139 - RNA, 1420 nt, Artificial Sequence
  mRNA product Design2 comprising derived and/or modified sequence from Homo sapiens__NP_057289.1__HsPDGFC (opt5)
ggggcgcugccuacggagguggcagccaucuccuucucggcaucaagcuuaccaugagccuguucggccuccugcuucugaccuccgcccucgcugggcagagacaaggaacacaggccgagucuaaccugagcuccaaguuucaguucucuagcaauaaagaacagaacggcgugcaagacccccagcacgagcggaucauuacggucuccaccaaugggucuauccauagcccucgcuuuccgcacacauaccccagaaacaccguucuuguguggcggcugguggcggucgaagagaauguguggauucagcucacauucgaugaacgcuuuggacuggaggacccugaggaugacaucugcaaguaugauuucguugaaguggaggaacccuccgacggcaccauucuggggagaugguguggaagcggcacagucccuggcaaacagaucucuaaggggaaccaaauccggauucgcuuuguguccgaugaguacuuccccagcgagccuggauuuugcauccauuauaauauuguuaugccgcaguucaccgaagcugugucucccuccguccucccucccagcgcccugccucuugaccugcucaacaaugccaucacggcuuuuucuacccuggaggaucuuauuagauaccuggaacccgagcgguggcagcucgaccuggaagaucuguaucgcccgacauggcagcuccugggcaaagccuucguguuugggagaaagucccggguggucgaccuuaaccugcucaccgaggagguucgccuguacagcuguacaccuagaaauuucuccgugucuauccgggaggaacuuaagcgcaccgauacgauuuucuggcccggaugccugcucgugaaaagauguggcgggaacugcgcuuguugccugcacaauuguaacgaaugccaaugugucccuagcaaggugaccaaaaaguaucaugagguucugcagcuccggcccaaaacaggagugagaggccugcacaagucccuuacagacgucgcccuggaacaccaugaggagugcgacugcgugugucgcggcagcaccgggggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3140 - RNA, 1477 nt, Artificial Sequence
  mRNA product Design2 comprising derived and/or modified sequence from Homo sapiens__NP_149126.1__HsPDGFD (opt5)
ggggcgcugccuacggagguggcagccaucuccuucucggcaucaagcuuaccaugcacagacugaucuucguguacacccucauuugcgccaacuuuuguagcugccgggacacauccgcuacgccccagucugccagcaucaaggcgcugcgcaaugcuaaccuuagacgggaugaccuguaucgcagagaugagaccauucaagucaaaggcaauggguacguucaguccccucgguucccgaacucuuauccccgcaaucuccugcuuacauggagacugcauagccaggaaaacacccggauccagcucguguuugacaaucaauucggacuggaggaagccgagaacgauauuugucgcuacgacuuuguggaagucgaggauaucuccgagacaucuaccaucauuagaggccgguggugcgggcacaaggaagugccuccccgcaucaaaagcagaacaaaucagauuaagaucaccuucaaauccgacgauuauuuuguugccaagccuggauucaagauuuacuauagccugcucgaggacuuucagcccgcugccgcuucugaaacgaacugggaguccgugaccagcucuaucuccggcgucagcuacaauucuccuuccgugacagauccgacccugauugccgacgcgcuugauaaaaagaucgccgaguucgacacaguugaagaccugcucaaauacuuuaaccccgagagcuggcaggaagaucuggagaauauguaucuugacaccccucgguaccgcgggagauccuaucaugaucggaagucuaaaguggaccuggauagacucaacgacgaugcuaagcgcuacagcuguacgccccggaauuauuccgucaacaucagagaggaacugaagcuggccaacgugguguucuuuccucgcugccuccugguccaacgguguggaggcaauugcggcugugggacaguuaacuggagaagcugcaccuguaauucuggaaaaacagugaagaaauaccacgaggugcuucaguucgaacccggccauauuaagcgccgggggagagcuaaaaccauggcccuggucgacauccagcucgaucaccacgagcgcugcgacugcauuuguuccagccggccgccuagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3141 - RNA, 1060 nt, Artificial Sequence
  mRNA product Design2 comprising derived and/or modified sequence from Homo sapiens__NP_003946.3__HsSOCS3 (opt5)
ggggcgcugccuacggagguggcagccaucuccuucucggcaucaagcuuaccauggugacccacagcaaguuccccgccgcuggcauguccagaccucuggacacaucucuccggcugaaaacguuuagcuccaagucugaguaccagcuugucguuaacgccgugcgcaaacugcaagaaagcggguucuauugguccgcggugaccggaggcgaggcuaaucuccugcuuucugccgaaccggccgggacauuucugaucagagauagcuccgaccagcggcauuucuuuacccucagcgucaagacacagucuggaaccaaaaaccugcgcauucagugcgagggcggguccuucagccugcaaucugaucccagauccacacagccugugccccgguuugacuguguucucaagcuggugcaccauuacaugccucccccuggagcuccgagcuuccccucuccucccaccgaaccuuccagcgagguccccgagcagccguccgcccagccucuucccggcucuccuccccgcagagcuuauuacaucuauagcggcggggaaaagauuccccuggugcucucccggccucugagcucuaauguugccacgcuucaacaccugugccgcaaaaccgugaacggacaucucgauuccuacgagaaggucacacagcugccgggccccaucagagaauuucuggaccaguaugaugcgccucucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3142 - RNA, 865 nt, Artificial Sequence
  mRNA product Design2 comprising derived and/or modified sequence from Homo sapiens__NP_003227.1__HsTGFA (opt5)
ggggcgcugccuacggagguggcagccaucuccuucucggcaucaagcuuaccauggugcccagcgccggccagcuggcucucuucgcccuggggaucguccuugcggcuugccaagcccuggagaacuccaccucuccucucagcgccgacccgcccguugcugccgcuguggugucccacuuuaaugauuguccugacucucauacacaguucugcuuucacggaacguguagauuccugguccaggaagauaagcccgccugcgugugucauagcggcuacguuggggcgcggugcgagcacgccgaccuucuggcuguggucgccgcuucccagaaaaagcaagccauuaccgcgcucgugguugugucuaucgucgcccuggcugugcugauuaucacaugugugcucauucauugcugucagguccgcaaacacugcgaaugguguagagcccugaucugccggcacgagaagccuagcgcccuucugaaaggacgcaccgcuugcugucauuccgaaacaguugugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3143 - RNA, 1555 nt, Artificial Sequence
  mRNA product Design2 comprising derived and/or modified sequence from Homo sapiens__NP_000651.3__HsTGFB1 (opt5)
ggggcgcugccuacggagguggcagccaucuccuucucggcaucaagcuuaccaugcccccuagcggccugagacuccugccgcuucugcucccccugcuuuggcugcucgugcugaccccugggcggcccgccgcuggacuguccacaugcaagacgaucgacauggagcucgucaaacgcaagagaauugaagccauccggggccagauucugucuaaacuucgccuggcgagcccucccucccaaggggagguuccuccgggaccccucccugaagcugugcuggcccuuuacaacucuaccagagaucggguggccggcgagagcgcugaacccgagccugagcccgaagccgacuauuacgcuaaggaggucacacgcgugcugaugguugaaacccacaaugagaucuaugauaaauucaagcaguccacacauucuauuuacauguuuuucaacaccagcgagcucagagaagccgugccggagccuguccugcugucccgggcggaacuccgccugcuuagacugaagcucaaaguggagcagcacguugaacuguaucagaaguacagcaauaacucuuggcgguaucuuuccaaucgccugcucgcccccagcgacucuccugaguggcuguccuuugaugugacaggggucgugagacaauggcugagccggggaggcgagaucgaaggcuuccgccucucugcucauuguuccugcgacagcagagauaacacccuucagguggacaucaauggguuuacgaccggacggagaggcgaucuggccacaauucacgggaugaaccgccccuuccugcuccugauggcuacaccccuugagcgggcccagcaucugcaguccucuagacaccgccgggcgcucgacaccaauuacuguuuuagcuccaccgagaaaaacugcugugucagacaacuguacaucgauuuccgcaaggaccugggauggaaauggauucacgaaccuaagggcuaucaugccaauuuuugccucgggccgugucccuacaucuggagccuggauacgcaguauucuaagguucuugcucuguacaaccagcacaauccuggagccuccgcugcccccugcugugugccucaggcccucgaaccccugccgauuguguauuacgucggccggaaaccuaagguggagcaacugagcaacaugaucguuagaucuugcaaauguagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3144 - RNA, 1627 nt, Artificial Sequence
  mRNA product Design2 comprising derived and/or modified sequence from Homo sapiens__NP_003229.1__HsTGFB2 (opt5)
ggggcgcugccuacggagguggcagccaucuccuucucggcaucaagcuuaccaugcacuacugcgugcugagcgccuuccucauccugcaucuugucaccguugcucugucccucucuacauguagcacgcuggacauggaucaguuuaugagaaagcggauugaggccauccgcggccaaauucuuuccaaacugaagcucaccucucccccugaagacuauccggagcccgaagaggugccucccgaagugaucagcauuuacaacuccacaagagaucugcugcaggagaaagcgucucggcgcgcugccgccugcgagagagaacggagcgacgaggaauauuacgcuaaggaggucuauaaaaucgauaugccucccuucuuuccuuccgagaaugccaucccgcccaccuucuaccgcccuuauuuuagaauugugcgguucgacguuagcgcuauggaaaagaacgccucuaaucucgugaaggcggaguuucgcgucuucagacugcagaaccccaaagcccgggugccugaacagcgcaucgagcuuuaccaaauucugaaguccaaagaucucacaagccccacccagagauacaucgacucuaagguugugaaaacacgggcugaaggggaguggcuguccuuugaugucaccgacgccgugcacgaguggcuucaucacaaggaucgcaaucugggauucaagauuagccuccauuguccgugcuguacguuugugccuucuaacaauuauaucauucccaacaaauccgaggaacuggaagcuagauucgccggcaucgacgggaccagcacauacaccuccggagaucagaagacaaucaaaucuacccggaagaaaaauagcggcaagacgccucaucugcuccugaugcuucugcccuccuauagacucgagagccagcaaacaaaccgccggaaaaagagagcgcuggacgccgcuuacugcuuucgcaauguccaggacaacuguugccuucggccccuguauauugauuucaagagagaccucggguggaaauggauccacgaaccuaagggauacaaugccaacuucugugcuggcgccugcccguaucuguggucuuccgauacccagcacagccgcguucugucucucuacaauacaauuaaccccgaggccagcgcuuccccuuguugcgugucucaggaccuggagccccuuaccauccuguacuauauuggcaaaaccccuaagaucgaacaacucagcaacaugaucgugaaauccugcaaguguagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3145 - RNA, 1621 nt, Artificial Sequence
  mRNA product Design2 comprising derived and/or modified sequence from Homo sapiens__NP_003230.1__HsTGFB3 (opt5)
ggggcgcugccuacggagguggcagccaucuccuucucggcaucaagcuuaccaugaagaugcaccuucagagagcccucgugguccuggcucugcugaacuucgccaccguuagccucucccugucuacaugcacgacccuugacuuuggccauaucaaaaagaaacggguggaggcgauucgcgggcaaauccugagcaagcucagacugacaucucccccugaaccgaccgugaugacacacguccccuaccaggugcuggcucucuauaauuccacccgggagcugcuugaagagaugcauggagaacgcgaggagggcuguacacaggaaaacaccgagagcgaauacuaugccaaagagauucacaaguucgauaugauccaggggcuggccgagcauaaugaacucgcuguuugcccuaagggaauuacguccaaaguguuuagauucaacgucucuagcguggagaagaaucggaccaaccuguuucgcgccgaguucagaguucuucgggugcccaauccuuccagcaaacgcaacgaacaaagaaucgaacuguuucagauccuccggcccgacgagcacauugcuaagcagcgcuacaucggcgggaaaaaucugccuacaagaggaaccgccgaguggcugucuuucgaugucacagacaccgugcgggaauggcuccugcgcagagaguccaaccuuggccuggaaauuagcauccacuguccgugccauacguuucagcccaauggcgauauucucgagaacauccacgaagugauggagauuaaguucaagggggucgacaaugaggaugaccauggacggggcgaucuggggagacuuaaaaagcaaaaagaccaccacaacccucaucugauccucaugaugauucccccucaccgccuggauaaucccggacagggcgggcagcggaagaaaagagcgcuggacacaaacuauuguuuucgcaaccucgaagagaauugcuguguucggccgcuguacaucgauuucagacaggaccuuggauggaagugggugcaugaaccuaaaggcuauuacgccaacuuuugcucuggccccuguccuuaccugcgcuccgcugacaccacacacagcaccgugcucgggcuguauaauacccuuaaccccgaggccucugcuucccccugcugugucccucaagaucuggaaccgcucacaauccuguacuaugugggacggacgcccaagguugagcagcugagcaauaugguggucaaguccugcaaaugcucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3146 - RNA, 1768 nt, Artificial Sequence
  mRNA product Design2 comprising derived and/or modified sequence from Homo sapiens__NP_001057.1__HsTNFRSF1B (opt5)
ggggcgcugccuacggagguggcagccaucuccuucucggcaucaagcuuaccauggcccccguggcugucugggccgcgcuggcuguuggccucgagcugugggccgccgcucacgcccuuccugcucagguggccuucaccccguacgcgcccgaaccugggagcacaugcagacugcgggaguauuacgaccaaacggcccagauguguugcuccaaguguucucccggacagcaugcuaaaguguuuugcaccaagacaagcgauaccgucugugacuccugcgaagauucuacauauacccagcucuggaacugggugccugagugucugagcugcggcucccgcuguucuagcgaccaaguugaaacacaggccugcaccagagagcagaaucggaucuguacgugccgccccgggugguacugcgcucuuuccaaacaggagggauguagacugugcgccccucuccggaagugucgcccgggcuucgggguggcgagacccggaaccgaaacaagcgaugucgugugcaaaccuugugcccccggcaccuuuucuaacacaaccuccagcacggacauuugccggccucaccaaaucuguaauguuguggcuauucccggcaacgccucuauggaugcugucugcacauccaccagcccgacacgcucuauggccccuggggccgugcaucugccccagccuguguccaccagaagccagcacacccagcccacacccgagccuuccacggcuccgucuaccagcuuccugcuccccaugggaccuuccccucccgcggaaggcagcacaggggacuuugcccugcccgucggacuuaucguuggcgugaccgcucuggggcuccugauuaucggaguggucaauugugugaucaugacacaaguuaagaagaaaccgcuuugccugcagcgggaggccaaggugccucaucuccccgccgauaaagcucgcggcacccagggcccugagcaacagcaucugcugauuacggcccccucuuccagcucuagcucccucgaaucuagcgcguccgcucuggacagacgggccccuacacgcaaccagccccaggccccgggggucgaggcuagcggagccggcgaagcuagagccucuaccggguccagcgauucuuccccuggaggccacgggacccaagugaauguuacauguaucgugaacgucugcagcuccucugaccacagcucccagugcucuagccaggcguccagcaccaugggagauacagacucuucccccagcgagucucccaaggacgaacaggugccuuucuccaaagaggagugugccuuucggagccaacuugaaacgccggagacccugcucggcucuacagaagagaagccccugccucuuggcguccccgaugcugggaugaagccuagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3147 - RNA, 895 nt, Artificial Sequence
  mRNA product Design2 comprising derived and/or modified sequence from Homo sapiens__NP_002623.2__HsPGF (opt5)
ggggcgcugccuacggagguggcagccaucuccuucucggcaucaagcuuaccaugcccgugaugagacuguucccuugcuuucuccagcugcuugccggccuggcucucccggccguucccccucaacagugggcgcugagcgcugggaacggauccucugaggucgaaguggugcccuuccaggaggucuggggccggagcuacugucgcgcccuugaaagacugguggacguuguguccgaguauccuucugaagucgagcacauguuuagccccuccugcgugucucuccugcgguguaccgggugcuguggagaugagaaucugcauugcguuccuguggaaacagccaacgucacgaugcagcuccugaagauccgcagcggcgacagaccguccuacguggagcuuaccuucagccaacacgugcggugugaaugccgcccccugagagagaaaaugaagccugagcggcgcagacccaaagggcggggaaagcgcagacgggaaaaacagcgcccuacagauugucaucucugcggcgacgcuguccccagacggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3148 - RNA, 1621 nt, Artificial Sequence
  mRNA product Design2 comprising derived and/or modified sequence from Homo sapiens__NP_001020537.2__HsVEGFA (opt5)
ggggcgcugccuacggagguggcagccaucuccuucucggcaucaagcuuaccaugaccgacagacagacagauacggcccccagcccuuccuaccaccuucucccgggccggcgcagaaccguggacgcugccgcgucucgggggcaaggacccgagccugcucccggcgggggagucgaaggcguuggggcccgcggaguggcccugaagcuguucgugcagcugcucggcugcagcagauuuggcggggcugucgugcgggccggagaggcugaaccuuccggcgccgcgcgcucugccagcuccgggagagaggaaccccagccugaggagggagaagaggaagaggagaaagaagaggaacggggcccgcaguggcgccugggggcuagaaagcccggaucuuggacaggcgaggccgcuguuugugccgauagcgcgccugccgcucgggcuccccaagcccuugcccgcgccuccggcagagggggacggguggcucgcagaggcgcggaagagagcgggccuccccauucuccgucccggagaggaagcgccucucgcgcuggcccugggcgggccuccgagaccaugaacuuccugcucagcuggguccacuggucucuggcccugcuccuguaucuucaucacgcuaaauggucccaggccgcgcccauggcugaaggaggcggccagaaucaucacgaggugguuaaguuuauggacguguaccagagaagcuauugccacccuaucgaaacacuggucgauauuuuccaagaguaccccgacgaaaucgaguauauuuuuaaacccuccugugugccucucaugcgcugcgggggauguugcaacgaugagggccuggaaugugugccgaccgaggaaucuaauaucacaaugcagauuaugcggaucaagccccaucaggggcagcacaucggagagaugagcuuccuucaacauaacaagugcgaauguagaccuaaaaaggaccgcgcccggcaggagaaaaaguccgucagaggcaaagggaagggccagaagcgcaaacggaagaaaagcagauacaagucuugguccguuuaugugggagcccgcugcugucugaugcccuggagccucccuggcccccacccgugcgggccuugcucugagcggagaaaacaccuguuugugcaagauccccagaccuguaagugcagcuguaaaaauacggacucccggugcaaggcucgccagcuggaacucaacgagagaaccugucggugcgauaagccuagacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3149 - RNA, 1081 nt, Artificial Sequence
  mRNA product Design2 comprising derived and/or modified sequence from Homo sapiens__NP_001165094.1__HsVEGFA (opt5)
ggggcgcugccuacggagguggcagccaucuccuucucggcaucaagcuuaccaugaacuuccugcucagcugggugcacuggucccuggcccuucugcucuaccugcaucacgcuaaguggucucaggccgcgcccauggcugagggcgggggacaaaaucaucacgaagucguuaaauuuauggacguguaucagagaagcuacugccauccuaucgagacccuuguggauauuuuccaggaauauccggacgagaucgaauacauuuuuaagcccuccugugucccucugaugcggugcggcggguguugcaacgaugagggacucgagugugugcccacagaagagucuaauaucacgaugcagauuaugcgcaucaaaccucaccaaggccagcacaucggggaaaugagcuuccugcagcauaacaagugcgaguguagacccaaaaaggaccgggcccgccaggagaagaaauccguuagaggaaagggcaaaggccaaaagcggaaacgcaagaagucuagauauaaaagcugguccguguacgucggggcccggugcugucugaugccuuggagccucccgggaccccacccuugcggccccuguucugaacgcagaaagcaucuguuugugcaggauccucagaccugcaaaugcuccuguaagaauacagacagccggugcaaagcucgccagcuugagcugaacgaaagaaccugucggugcgauaagccccgcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3150 - RNA, 1006 nt, Artificial Sequence
  mRNA product Design2 comprising derived and/or modified sequence from Homo sapiens__NP_003368.1__HsVEGFB (opt5)
ggggcgcugccuacggagguggcagccaucuccuucucggcaucaagcuuaccaugagcccccugcucagacggcugcuucuggccgcucuccugcagcuugccccugcgcaagcuccggugucccagcccgacgccccuggccaccagcgcaaggucguuucuuggaucgauguguacaccagagccacaugccagccccgggagguggucgugccucugacgguugaacucauggggaccguggcuaagcaacugguccccagcugugugacaguucagcgcugcggaggcuguugcccugacgaugggcuggagugugugccgaccggacagcaucaggucagaaugcaaauucucaugauccgguaucccuccucucagcugggcgaaaugagccuugaggaacacucccagugcgagugucgcccuaagaaaaaggacucugccgugaaacccgauagagcugccacaccucaucaccggccccagccgcgcagcgugccugggugggacuccgcgcccggagccccuagccccgcugauauuacccaucccaccccugccccgggccccucugcucacgccgcgccuuccacaacgagcgcccugacccccggcccugcugccgcugccgccgacgcugcggccucuuccgucgcuaaagggggagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3151 - RNA, 1642 nt, Artificial Sequence
  mRNA product Design2 comprising derived and/or modified sequence from Homo sapiens__NP_005420.1__HsVEGFC (opt5)
ggggcgcugccuacggagguggcagccaucuccuucucggcaucaagcuuaccaugcaucugcucggcuucuuuagcguggccugcucccugcuugcugccgcgcugcuccccgggccuagagaggcuccggccgccgcugccgcuuucgaaucuggacuggaccuuagcgaugccgagcccgacgcgggcgaagccaccgcuuacgccuccaaggaucuggaggaacagcuccggucugucagcuccguugacgagcugaugacagugcuguauccugaguacuggaaaauguauaagugucaacuccgcaaagggggauggcagcacaacagagaacaggcuaaucugaacucucggacggaggaaaccaucaaguuugccgcggcccacuacaauacagagauucuuaaaagcaucgauaacgaguggcgcaagacccagugcaugcccagagaaguguguauugacgucggcaaggaguucgggguggcuacaaauaccuuuuucaaaccucccugcguuuccguguaucgguguggaggcugcuguaacagcgaaggccugcaaugcaugaauacaucuaccuccuaccucagcaagacgcuguuugagaucaccgucccucuuucucaggggccgaaacccgugacaauuuccuucgccaaccauaccagcugucgcugcaugucuaagcuggauguuuauagacaggugcacuccaucauccggcgcagccucccugcuacacugccccagugucaagccgccaauaaaaccugcccuacgaacuacauguggaauaaccauauuugcagaugucuggcucaggaagacuuuauguucuccucugaugcgggagacgauagcacagacggcuuucacgauaucugcgggcccaauaaggagcucgacgaggaaaccugucagugcgucugucgggccggacugcgcccggcuuccugcggcccucacaaggagcuugacagaaacagcugucagugcguguguaaaaauaagcuguuccccucucaaugcggggccaaccgggaauuugaugagaacacaugucagugcgugugcaaacgcaccuguccuagaaaucagccccucaaccccggaaagugcgccugugaaugcaccgaguccccucaaaaaugucugcuuaagggcaaaaaguuccaucaccagacaugcagcuguuaccggagaccgugcacgaaucgccagaaggcuugugagcccggcuucucuuauagcgaagaggucugccgguguguuccuuccuacuggaaaagaccccagaugucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3152 - RNA, 1447 nt, Artificial Sequence
  mRNA product Design2 comprising derived and/or modified sequence from Homo sapiens__NP_004460.1__HsVEGFD (opt5)
ggggcgcugccuacggagguggcagccaucuccuucucggcaucaagcuuaccauguacagagaguggguggucguuaacguguucaugaugcuguaugugcagcucguccaaggcagcuccaaugaacacgggcccgugaagcggucuagccaguccacccuggagcgcucugaacagcagaucagagccgcuagcucccuugaggaacugcuccggauuacacauucugaggacuggaaacuguggcgcugcagacuucggcucaagagcuuuacguccauggauagccgcucugccucccacagaagcacccgguucgcggcuacauuuuacgacaucgagacccugaaaguuauugaugaagaguggcaacgcacacaguguucuccuagagaaaccugcguggaggucgccuccgagcugggaaagagcacaaacaccuucuuuaaaccgcccugugugaauguuuuccggugcggcggguguugcaacgaagagucucugaucuguaugaauacguccaccagcuauauuuccaagcagcucuuugaaaucucugugccucugacaagcguccccgagcuugugccugugaaggucgccaaccauaccggaugcaaaugucugcccacagcuccucgccacccguacuccaucauuagacggagcauccagauucccgaagaggaccgcugcucucauuccaagaaacucuguccuaucgauaugcugugggacagcaauaagugcaaaugcguucuucaagaggaaaacccccuggccggcaccgaggaucacucucaccuccaggaaccugcucugugugggccccauaugauguucgacgaggauagaugcgaaugugugugcaagacgccguguccuaaggaccugauucagcaccccaaaaauugcagcuguuuugagugcaaggagucccucgaaacauguugccagaaacauaagcuguuccacccugauaccuguucuugcgaggaccggugccccuuucacacaagacccugugccagcggaaaaaccgcgugcgccaagcauugucgcuucccuaaagaaaagcgggcugcccaaggcccgcacuccagaaagaaccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3153 - RNA, 1012 nt, Artificial Sequence
  mRNA product Design2 comprising derived and/or modified sequence from Homo sapiens__NP_061986.1__HsFGF21 (opt6)
ggggcgcugccuacggagguggcagccaucuccuucucggcaucaagcuuaccauggacucagacgaaacaggauuugaacacucaggauuauggguaucaguauuagcaggauuacuacucggagcaugccaagcacacccaaucccagacucaucaccauuauuacaauucggaggacaagucagacaacgauacuuauacacagacgacgcacaacaaacagaagcacauuuagaaauaagagaagacggaacaguaggcggagcagcagaucaaucaccagaaucacuacuacaacuaaaagcacuaaaaccaggaguaauacaaauauuaggaguaaaaacaucaagauucuuaugccaaagaccagacggagcacuauacggaucauuacacuuugauccagaagcaugcucuuucagagaacuacuacuagaagacggauacaacguauaccaaucagaagcucauggacuaccuuuacaccuaccaggaaacaaaucaccacacagagauccagcucccagaggacccgcaagauuccuaccauuaccaggauuaccaccagcauuaccagaaccaccaggaauacuagcaccacaaccaccagacguaggaucaucagacccauuaucaaugguaggaccaucacaaggaagaucaccaucauacgcaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3154 - RNA, 1792 nt, Artificial Sequence
  mRNA product Design2 comprising derived and/or modified sequence from Homo sapiens__NP_002412.1__HsMMP1 (opt6)
ggggcgcugccuacggagguggcagccaucuccuucucggcaucaagcuuaccaugcacucauuuccaccacuauuauuacuacuauuuuggggagucguaucacauagcuuucccgcaacacuagaaacccaagaacaagacguagacuuaguacaaaaauaucuagaaaaauacuauaaccucaaaaacgacggaagacaagucgaaaaaagaagaaacagcggaccaguuguagaaaaacuaaaacaaaugcaagaauuuuucggauuaaaaguuacuggaaaaccagacgcagaaacacuaaaaguaaugaaacaaccaagaugcggaguaccagauguagcacaguucguauuaacagaaggaaacccacguugggaacaaacacaucuuacauacagaauugaaaauuacacaccugaccuaccaagagcagacguagaccacgcaauagaaaaagccuuucaauuauggucaaacguaacaccauuaacauucacaaaaguuucugaagggcaagcagacauaaugaucucauuuguuagaggagaccaccgagacaauagcccauucgacgggccaggaggaaaccuagcacaugcuuuccaaccaggaccuggaauaggaggcgacgcacauuucgacgaagacgaacgauggacaaacaauuucagagaauacaaccuacauagaguagcagcccacgaauuaggccacagccuaggcuuaucacacucaacagacauuggagcucuaauguacccuuccuacacauuuucaggagacguacaauuagcccaagacgauauagacggaauacaagcaauauacggacgaucacaaaacccaguacaaccaauaggaccacaaacaccaaaagcaugcgacucaaaauuaacauuugacgccauaacaacaauaagaggagaaguaauguuuuucaaagaccgauuuuauaugagaacaaauccauucuacccagaaguagaauuaaacuuuauaaguguauucuggccucaauuaccaaacggauuagaagcagcauaugaauuugcagacagagacgaaguacgauucuuuaaaggaaauaaauacugggccguacaaggacaaaacguauuacauggauacccaaaagacauauacagcucauucggguuuccaagaacaguaaaacacauagacgccgcauuaucagaagaaaacacaggcaaaacauauuuuuucguagcaaacaaauacuggagauacgacgaauacaaaagaucaauggacccaggauauccaaaaaugauagcacacgauuucccuggcauugggcacaaaguagaugcaguauucaugaaagauggcuuuuucuacuucuuucacggaacucgacaauacaaauucgacccaaaaacaaaaagaauacucacacuacaaaaagcaaacaguugguucaauuguagaaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3155 - RNA, 1552 nt, Artificial Sequence
  mRNA product Design2 comprising derived and/or modified sequence from Homo sapiens__NP_002412.1__HsMMP1(1-19,100-469) (opt6)
ggggcgcugccuacggagguggcagccaucuccuucucggcaucaagcuuaccaugcauucauucccaccacuacuauuauuauuauucuggggaguaguaucacauucauuuguacuaacugaaggaaauccuagaugggaacaaacucacuuaaccuauagaauagaaaacuauacaccagaccuaccaagagccgacgucgaccacgcaauugaaaaagcauuccaauuauggaguaacguaacaccacuaacauucacaaaaguaucagaaggacaagcagacauaaugauaucauuugucagaggagaccaccgagacaacucaccauuugacggaccuggaggaaaucucgcacacgcauuccaaccaggaccaggaauaggaggagacgcacauuuugaugaagaugaacgauggaccaacaauuuuagagaauacaaccuacaccgaguagccgcacacgaacucggacacagccuaggacuaucacacucaaccgacaucggagcacuaauguacccaucauacacauucuccggagacguccaacuagcucaagacgacauagacggaauacaagcaauauacggaagaucacaaaauccuguacaaccaauaggaccacaaaccccaaaagcaugcgacucaaaauuaacauuugacgcaauaaccacaauuagaggugaaguaauguuuuucaaagauagauuuuacaugagaacaaaucccuucuauccagaaguagaauuaaauuucauaucaguauucuggccacaacuaccaaauggauuagaagcagcauacgaauuugcagauagagacgaaguaagauucuucaaaggcaacaaauacugggcaguacaaggccaaaacguacuacacggauauccuaaagacauauacucuuccuuuggauuuccuagaacaguaaaacacauagaugccgcacuaucagaagaaaacaccggaaaaacauacuucuucgucgccaauaaauacuggagauacgacgaauauaaacgaucaauggacccagguuacccaaaaaugauagcacacgauuucccaggaauaggacacaaaguugacgcagucuuuaugaaagacggauuuuucuacuucuuucacggaacacgacaauacaaauucgaucccaaaacuaaaagaauccuaacuuuacaaaaagccaauucuugguuuaauuguagaaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3156 - RNA, 3739 nt, Artificial Sequence
  mRNA product Design2 comprising derived and/or modified sequence from Clostridium histolyticum__BAA77453.1__ColG (opt6)
ggggcgcugccuacggagguggcagccaucuccuucucggcaucaagcuuaccaugaaaaaaaacauacucaaaauucuaauggacucauacucgaaagaaucaaaaauacaaacaguccgcagaguuacaucagucucguuacuagcaguauaccugacgaugaacacauccucguuaguacucgcuaaaccuauagaaaauaccaacgauaccaguauaaaaaacguagaaaaauuaagaaaugcaccaaacgaagaaaacaguaaaaaaguagaagacaguaaaaaugacaaaguagaacauguaaaaaacauagaagaagcaaaaguugaacaaguagcaccagagguaaaauccaaaagcacauuaagaagcgcgucaaucgccaacacaaauucagagaaguacgacuucgaauacuuaaacggauuaaguuauacagaacuaacaaaucucauuaaaaauaucaaauggaaccagauaaauggacuauuuaauuacucaacaggaucacaaaaauuuuucggagacaaaaauagaguacaagcaauuauaaacgcuuuacaagaaagcggacgaacguauacagcaaacgauaugaaaggaauugaaacauucacagaaguacuacgcgcugguuuuuaucugggcuauuauaacgacggacuaucauaccucaacgaccgaaacuuccaagauaaaugcauaccagcgaugauugcaauucaaaaaaacccaaacuuuaaacuaggaaccgcaguccaagaugaaguaauaacgucgcucggaaaacuaauaggaaaugcaagcgcuaaugcagaaguuguaaauaacuguguucccguacuaaaacaauuccgagaaaauuuaaaucaauacgcaccagauuacgucaaaggaacggccguuaaugaacuuaucaaaggaauagaauuugauuucucaggagcagcuuaugaaaaagacguaaagacuaugccaugguacggaaaaauagaucccuuuauaaaugagcugaaggcacuaggccuuuacggaaacaucacaucagcuacagaaugggcgucagaugucgggauauacuaucuaucaaaauucggacuuuacucaaccaaccgaaaugauauaguacaauccuuagaaaaagcaguagauauguauaaauacggaaaaauagcuuucgucgcaauggaacgaaucacaugggauuaugacgguauaggaagcaauggaaaaaaaguagaucaugacaaauuccuagaugacgcagaaaaacauuaccuccccaaaacauacaccuucgauaacggcacauucauaauaagagcuggagacaaaguaucagaagaaaaaaucaaacguuuauacugggcaucacgagagguuaaaucacaauuccauagaguagucgguaaugacaaagcauuagaaguaggcaaugcagacgacguacucacaaugaaaauauucaauucuccugaagaauauaaauuuaauaccaacauuaacggaguaucuacagacaauggaggccuuuacauagaaccaagaggaacguucuauaccuacgaaagaacaccacaacaaucaaucuuuucauuagaagaacuauuuagacacgaauacacacacuaucugcaagcacgauaccugguggauggacuauggggacaagggccauuuuaugaaaaaaaccgcuuaacaugguuugaugaaggcacagccgaauuuuucgcaggaucaaccagaacaucgggugucuuaccacggaaaucaauacucggguacuuagcaaaagacaaaguagaucauagauauucauuaaaaaaaacacuaaauaguggauaugaugacucggauuggauguuuuacaacuaugguuuugcgguagcacauuauuuauaugaaaaagauaugcccacauucauaaaaaugaacaaagcuauauuaaauaccgauguaaagagcuaugaugaaauaauaaaaaaacucagugaugaugcaaauaaaaacacugaauaucaaaaccacauacaagaacuagcagacaaauaccaaggagcagguauuccguuaguuucagaugauuacuuaaaagaccacggauauaaaaaagcaucagaaguauacagugaaauaucgaaagcagccagccuuacaaacaccucaguaacagcagagaaaagucaauauuucaacacauuuacacuaagaggaacauacacgggggaaaccucaaaaggagaauuuaaagauugggaugaaauguccaaaaaacuagacggaacacuagagagcuuagcuaaaaacaguuggagcggauacaaaacuuuaacggcauacuuuacuaacuaccgaguuacaagugacaauaagguucaauacgacguaguauuucacggaguacuaacagacaacgcugauauuaguaacaacaaagcgccuaucgcuaaaguaacaggaccaucgacuggggcagucggaaggaacauagaauuuucugggaaagacaguaaagaugaagacggaaaaauaguuaguuacgauugggauuuuggcgauggagcuaccucucguggaaagaacucugugcaugcauacaaaaaagcaggaacauauaacguaacccuaaaaguaacagacgacaaaggagcaacagcuacagagagcuuuaccauagaaauaaaaaacgaagauacaacgacaccaauaacaaaagagauggaaccuaaugaugacauaaaagaagcuaacggacccauaguggaaggaguaacagugaaaggagaccugaauggcagcgaugacgcugauacuuuuuauuucgaugucaaagaagacggugacguaaccauugaacuaccguacagcggcaguucaaauuuuacaugguugguauauaaagaaggagacgaccaaaaccacauagcaucuggaauagauaaaaauaacucaaaaguugguacauuuaaaaguacaaaagguagacacuauguauucaucuauaaacacgacagcgcaucaaacauauccuauucccucaauauaaagggacuaggaaaugaaaaacugaaagaaaaagaaaauaacgauuccagugacaaagcaacuguaaucccaaauuuuaauacaacaaugcaaggaucuuuauuaggagacgauagucgcgacuauuacucauuugaagugaaagaagaaggagaaguaaauauagaacuugacaaaaaagacgaguucggaguaaccuggacucuccacccagaaucaaauauaaacgauagaaucacauacggacaaguagacgguaacaaagucucaaauaagguaaaacuuagaccagggaaauacuauuuacucguauauaaauacucuggcagcggcaacuacgaguuacggguuaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3157 - RNA, 3463 nt, Artificial Sequence
  mRNA product Design2 comprising derived and/or modified sequence from Clostridium histolyticum__BAA77453.1__HsALB(1-18)_ColG(111-1118) (opt6)
ggggcgcugccuacggagguggcagccaucuccuucucggcaucaagcuuaccaugaaaugggucaccuuuauaagucuacuuuucuuauuuuccucagcauauagcauagcaaauacaaauuccgaaaaauaugacuucgaauaccuaaacggucuuaguuacacagaauuaacuaaccuaauuaaaaacauaaaauggaaucaaauaaauggcuuauuuaauuauucaacagguagucaaaaauucuucggagauaaaaacagagugcaagcaauaauaaacgcccuacaagagucaggacgaacauauacagcaaaugacaugaaaggaauagagacauucacagagguauuacgugccggauucuaccuaggauacuacaacgacgguuuaucuuacuuaaaugacagaaacuuccaggauaaauguauaccagcaaugauagcaauacagaaaaacccuaauuucaaacucggaacggcgguucaagacgaaguaauuacaucuuuagguaaauugauaggaaacgcaucagcgaacgccgagguaguaaacaauugcguaccgguccuuaaacaauuuagagaaaaucuaaaccaauaugcaccagacuacgugaaaggaacagcagugaaugaauuaauaaaaggcauugaguucgacuucucaggagcagcauaugaaaaagauguaaaaacaaugccaugguacggaaaaauagauccauucauaaaugaacuaaaagcauuaggauuauacggcaacaucaccagugcaacugaaugggcaucagaugucgggauauacuauuuaucaaaauucggacucuauagcacaaaccgaaacgacauaguacaaucacuagagaaagcaguagacauguacaaauacgggaaaauagcauuuguagccauggaacgaauuacaugggacuacgauggcauagguagcaauggaaagaaaguagaucacgauaaauuccuugacgacgcagaaaaacacuaucuuccuaaaacauacacuuuugauaacgguaccuucauaauacgagccggugauaaaguaagcgaagagaaaauaaaaaggcuauauugggcaagcagagaagucaaaagccaauuucauagaguaguaggaaaugacaaagcacuagaaguuggaaacgcugacgauguucuaacaaugaaaaucuucaacucaccugaagaauacaaauucaacacaaacauaaauggaguaaguaccgacaacggaggauuauauauagaacccagggggacguuuuauaccuacgagagaaccccucaacaaucuauauuuuccuuagaagaauuauuucgacaugaauacacacacuauuuacaagcacgauauuugguagauggacuauggggacaaggaccauuuuaugagaaaaacagacuuacgugguucgacgaaggaacggcagaguucuuugcaggaaguacaagaacaaguggaguauuaccaagaaaaucaauacuagguuacuuagcaaaagacaaaguagaucacagauacagccuaaagaaaacacugaauagcgguuaugaugacagugauuggauguucuauaauuacggauucgcaguagcucacuaucuauaugaaaaagauaugccaacauucaucaaaaugaauaaagcaauacuuaacaccgacguuaaaucauaugacgaaauaauaaagaaauuaagugacgacgcaaacaaaaauaccgaauaccaaaaccacauccaagaacuagcagacaaauaucaaggugcaggaauaccauuaguaucagacgacuaccucaaagaccauggauacaagaaagcguccgaaguauacucagaaauaaguaaagcagcaucauugacuaauacuucaguaacagcagaaaaaucacaauacuuuaacacauucacacuucgcggaacauauacgggagaaaccucaaaaggugaauuuaaagauugggacgaaaugaguaaaaagcucgacggcacucuagaaucauuggcuaaaaacuccuggucaggauauaaaacacuaacagccuacuucaccaauuacagagucaccucagauaauaaaguacaauaugacguaguauuucauggagucuuaacagacaacgcugauauaaguaacaauaaagcgccuauagcgaaaguaacaggaccaucaacgggagcaguaggaagaaauauugaguucucaggaaaggauagcaaagacgaagacggaaaaauuguaucuuaugauugggauuucggagauggagcaaccucaagagggaaaaacagugugcaugccuacaagaaagcaggaacuuauaauguaacacuaaaagugacagaugacaaaggagcgacagcaacagagagcuucacgauugaaauuaaaaacgaagauacuacaacacccauaacaaaagaaauggaaccaaaugaugacauaaaagaagcaaacggaccgauaguggaaggcguaacgguaaaaggagacuuaaauggaagugaugacgccgacacauuuuacuuugauguuaaagaagacggugaugucacaauagaauuacccuacucugguaguuccaacuucacuugguuaguauacaaagaaggagaugaucaaaaucauauagcauccggaauagacaaaaacaauagcaaaguaggcacauuuaaauccacaaaaggacgucauuauguuuucauuuacaaacacgauagugcaaguaacauaaguuauucucuaaauauaaaaggacuagguaaugaaaaacuaaaagaaaaagaaaacaacgauagcagugacaaagcuacuguuaucccaaacuucaacaccacaaugcaaggcagcuuacucggagacgauucacgagauuauuacagcuucgaaguaaaagaagagggggaaguaaacauagaacuagauaagaaagacgaauuuggaguaacauggacacuacacccggaaucgaacauaaaugacagaaucacauauggacaaguagacggaaacaaaguaucaaauaaagucaaacuaagaccuggcaaauauuaccuauuaguguauaaauauucaggaucagguaauuacgaacugagagucaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3158 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt6)
ggggcgcugccuacggagguggcagccaucuccuucucggcaucaagcuuaccaugaaguggguaacuuucauaagucuucuuuuccuuuucucuucagcauacucgaugaagaaaaacauacuaaaaauacucauggauuccuauagcaaagaaaguaaaauacaaacaguacggagaguuacaucaguaagucuauuagcaguauaccuaacaaugaauacaagcuccuuaguauuagcaaagccaaucgaaaacacaaacgauacgucaauuaaaaacguagaaaaauuacgaaacgcaccuaaugaagaaaacucaaagaaagucgaagacagcaaaaacgauaaagucgagcacgugaaaaauauagaagaagcaaaaguagaacaaguagccccagaaguaaaaaguaaaucaacucuaagaucugcuucacgcagacgacguaaacgaauagccaacacaaauucagaaaaauaugauuucgaauaccuaaacggguuaucauacacagagcuaacgaaucuaaucaaaaacauaaaauggaaccaaauaaauggccuauuuaauuauagcacaggaucccaaaaauucuucggcgacaaaaaucgaguacaagcaauaauuaaugcacuacaggaaucuggcagaacauauacugcuaaugacaugaaaggaauagaaacauuuacagaaguacucagagcaggauuuuauuuagguuauuauaaugacggcuuaaguuaccuaaaugauagaaacuuucaagauaaaugcauaccugcaaugaucgcaauacagaaaaacccaaacuuuaaacuagggacagcgguacaagacgaaguaauaaccagcuuaggaaaacucaucggaaacgcuucugcaaacgcggaaguuguaaacaacugcguaccaguacuaaaacaauuccgagaaaaccuaaaucaauacgcuccagauuauguaaaaggaacggcuguaaacgaauuaauaaaagguaucgaauuugauuucagcggcgcagccuaugaaaaggacgucaaaacgaugccaugguauggaaaaauagacccauucauaaaugaacugaaagcacucggacuuuacgguaauauaacaagugcuacagaaugggcaucagacguaggaauauauuauuuaucaaaauucggauuauacucaacaaauagaaaugacauaguacaaagucuagaaaaagcggucgacauguacaaauauggcaaaauagcauuuguagcuauggaacgcauaacaugggacuaugauggaauagguucuaacgguaagaaaguugaucaugauaaauucuuagaugacgcagaaaaacacuacuuaccaaaaacauauacauucgacaacggcaccuuuauaauacgugccggagacaaaguuagugaagagaaaauuaaacgacuauacugggcuucgagagaaguaaaaucucaauuucacagagucgugggaaacgauaaagcacuagaaguuggaaacgcagaugauguccucacaaugaaaaucuuuaauuccccggaagaauacaaauuuaauacgaauaucaacggcgugucaacugauaauggaggacuguauauagaaccacgaggaacauucuacacuuaugaaagaaccccgcaacaaagcauuuucucccuagaagaacuauucaggcaugaauauacacauuaccuccaagccagauaccuaguugauggacuauggggacaaggaccguuuuacgagaaaaaucgauuaaccugguuugaugaaggaacggcagaguucuuugcaggaucaacaagaacaagcggaguacuaccaagaaaauccauacuagguuacuuagcaaaagauaaaguugaccacagauauaguuuaaagaaaacccucaacagugguuacgaugauucggauuggauguuuuacaacuacggauucgcaguugcgcacuacuuauacgaaaaagauaugccaacguucauaaaaaugaacaaagcaauacuaaauacugaugucaaaagcuacgaugaaauaauaaagaaacuaagugacgacgccaauaaaaauacagaauaccaaaaccauauacaagaacuagcugacaaauaccaaggugcgggaauaccucuaguaagugacgacuaucuaaaagaucauggauauaagaaagcaucagaaguuuacucugaaaucagcaaagccgcaucauuaacaaacaccucaguaacagcugaaaaaucacaauauuucaacacauucacacuaagggguacauauacaggcgaaaccaguaaaggagaauuuaaagauugggacgaaaugagcaagaaauuagauggaacucuagaaucuuuagccaaaaacucuuggucaggauacaaaacauuaacggcauauuucacgaacuauagaguuacaagugauaauaaagugcaauaugacguaguauuucacggaguccucacagauaacgccgauauuucaaauaauaaagcuccgauagcuaaaguaaccgguccauccacaggagcaguaggcagaaacauugaguucucugguaaagauaguaaagaugaagauggaaaaauagucucauacgacugggauuucggagauggagcaacaucaagagggaaaaacucaguacaugccuauaagaaagcgggaaccuauaacguaacccuaaaagucacagaugacaagggagcaacggcuacagaaaguuuuacaaucgaaauuaaaaaugaagacacaacaacaccaauaacgaaggaaauggaaccaaacgacgacaucaaagaagcuaacggaccaauaguugaaggaguaacaguuaaaggagauuuaaacggaucagaugaugcggacacuuuuuacuucgaugucaaagaagauggagacgucaccauugaauuaccuuauucaggaagcaguaacuucaccugguuaguauauaaagaaggagacgaucaaaaccacaucgcuagcggcauagauaaaaauaauucaaagguuggaaccuuuaagucaacaaaaggaagacacuauguauuuaucuacaaacaugauuccgccucaaacauauccuauagccugaauaucaaaggccuaggaaacgaaaaauuaaaagaaaaagaaaauaacgacagcucagauaaagcaacaguaauuccuaacuuuaacacuacaaugcaagguagccuauugggugacgauaguagagacuauuacagcuuugaagucaaagaagaaggagaaguuaauauagaacuagacaagaaagaugaguuuggaguaaccuggacauugcacccugaauccaauauaaaugacagaauuacuuauggccaagucgacggaaauaaagucucaaacaaagugaaacuaagaccggguaaauauuaccuuuugguguacaaauauaguggcucaggaaacuaugaauuaagggucaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3159 - RNA, 3487 nt, Artificial Sequence
  mRNA product Design2 comprising derived and/or modified sequence from Clostridium histolyticum__BAA34542.1__ColH (opt6)
ggggcgcugccuacggagguggcagccaucuccuucucggcaucaagcuuaccaugaacuuucucaaaauaauacugaaccguggcaaaacaaugaaaagaaaaugccuaaguaaaagacucaugcuggccaucacaauggcuacaauauucaccgucaacagcaccuuaccuauuuaugcagccguagacaaaaauaacgcuacugccgccguacaaaaugaaagcaaaagauacacugucucguaucuuaaaacacuaaauuacuacgaccuaguagauuuauuaguaaaaacagaaauagaaaaccuaccugaucucuuucaauacucaucagaugccaaagaauuuuacggaaacaaaacacgaaugucuuuuauaauggaugaaauaggccgcagagcuccacaauacaccgaaaucgaccacaaaggaauaccaacauuaguggaagugguaagagcaggauuuuauuuaggcuuccacaacaaagaacuaaacgaaauaaauaaaagauccuucaaggaaaggguaauacccucaauauuagcaauacagaaaaaccccaauuucaaacuaggaacagaagugcaagacaaaaucgucagcgcaacgggacuucuagccgguaacgaaacugcuccaccagaaguaguaaacaacuucaccccaauccuacaagacuguauuaaaaacauagacagauaugcauuagacgaucuaaagucaaaggcuuuauuuaacgucuuagcugcaccuacuuacgacauaacagaauaccucagggcaacaaaagaaaaaccggaaaauacaccuugguacggaaaaauagauggcuucauaaacgaacuaaagaaauuagccuuauacggaaaaauuaacgauaauaacucuuggauaauagauaaugguauuuaccacauagcuccguuagggaaacugcauaguaacaauaaaaucggaauagaaacauuaaccgaagucaugaaaguauacccauauuuaucaaugcaacacuuacaauccgccgaccaaaucaaaagacacuacgacagcaaagaugcagaaggaaauaaaauaccauuagauaaauucaagaaagaaggaaaagaaaaauacugcccaaaaaccuauacuuucgacgauggaaaaguaauaauaaaagcuggagcaagagucgaagaagaaaaaguaaaacgacucuacugggcaucaaaagaagucaacucacaauucuucagagucuauggcauagauaaaccgcuagaagagggaaaccccgaugacauccuaacaaugguaauauacaauucaccagaagaguauaaacuaaauagcguauuauacggauacgacacaaauaacggcggaauguacaucgaaccugaaggaaccuucuucaccuaugagcgagaagcccaagaaaguacauacacccuggaagaacuauucagacaugaauacacacauuaccuacaaggacgauacgccgugccaggacaaugggggcgaacgaaauuauacgacaacgacagacucacaugguaugaagaagguggagcagaauuauucgcaggcaguacccguacaucagguauccuaccaagaaaaucuaucgucaguaacauacacaacacaacuaggaauaaucgauacaaauuaucagacacaguacauuccaaauacggggccuccuucgaauuuuacaacuacgcgugcauguuuauggauuauauguauaacaaagauauggguauucuaaacaaauuaaacgaccuagccaagaauaaugacguggacggauacgacaacuauauuagggaccuaucaucaaauuaugcauuaaacgacaaauaccaagaccacaugcaagagaggauagauaauuacgaaaaccuaacaguaccauuugucgcagacgauuauuuagugcgacaugcauacaaaaauccaaacgaaaucuacagugagauuucagagguagcaaaacucaaggaugcgaaauccgaagucaagaaaagucaauacuucaguacauucacgcuaagaggaucauauacaggaggagccucaaaaggaaaauuagaagaccaaaaagcaaugaauaaauucauagacgauucauuaaagaaacuagauaccuacaguuggaguggcuauaaaacacucacugcauauuucacaaauuacaaaguagacucaucuaauaggguaaccuacgauguaguauuccacggauaccucccaaaugaaggcgacagcaaaaacucucucccauacggaaaaauaaacgggacauacaaagguacugaaaaagagaaaaucaaauucagcagcgaaggauccuucgacccagacggaaaaauuguuaguuaugaaugggacuucggagauggaaacaaaaguaaugaagaaaacccagaacauuccuaugacaaagucgggacuuacaccguaaaauuaaaaguuacagaugauaaaggcgaauccaguguaucaacaacaacagccgaaaucaaagacuuaagcgaaaauaaacuuccaguaauauauaugcacguaccaaaaucuggagcacuuaaccaaaaaguaguauucuacgguaaagguacauacgauccagacggaucaauagcuggguaucaaugggacuuuggagacgguucagauuucucaucagaacaaaaucccucccacguauacacaaagaaaggugaauacacagugacacuaagagucauggauagcagcggccaaaugucagagaaaacaaugaaaaucaaaauaacugaucccguauauccaauaggcacagaaaaagaaccaaacaacagcaaagaaacagccagcggaccaauaguaccaggcauacccgucaguggaacuauagaaaauacauccgaccaagacuacuuuuacuucgauguaauaaccccuggagaaguaaaaauagacauaaacaaauuagguuaugggggcgcaacauggguaguguacgaugaaaauaauaacgcaguaaguuaugcuacagacgacggccaaaaucuauccggaaaauucaaagcagacaaaccaggcagauacuauauucaucuauauauguuuaacgguagcuacaugccuuacaggaucaacauagaaggaagcguagguagauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3160 - RNA, 3448 nt, Artificial Sequence
  mRNA product Design2 comprising derived and/or modified sequence from Clostridium histolyticum__BAA34542.1__ColH (opt6)
ggggcgcugccuacggagguggcagccaucuccuucucggcaucaagcuuaccaugaaacguaaaugccuuucaaaacgucuaauguuggcaauuacuauggcaacaauauuuacaguuaauuccacacuaccaauauaugcagcuguagacaaaaacaaugccacagccgcaguacaaaaugaauccaaaagguacacugucaguuaucuaaaaacucuuaacuauuacgaccuaguugaccuauuaguaaaaacagaaauagaaaaccuaccagacuuauuccaauacucaucugaugcuaaagaauuuuacggaaauaaaacccgcaugaguuuuaucauggaugaaauaggaagacgagcgccucaauauacugaaaucgaucacaaaggaauaccgacgcuaguagaaguuguaagagccgguuuuuacuuaggcuuucacaacaaagaacuaaacgaaauaaauaaacgaucauuuaaagagagaguaauacccagcauccuugccauacaaaagaauccaaacuucaaauuaggaacagagguacaagacaaaauaguauccgccacaggccuauuagcaggaaaugagacagcacccccugagguagugaacaauuucacaccaauauuacaagauugcauuaaaaauauagauagauaugcucuagaugaucuaaaaucaaaagcacuauucaacguacuagcagcacccacauacgauauaacagaauacuuacgagcgaccaaagaaaaaccagaaaacacaccaugguacggaaaaauagacggcuuuauaaaugaguuaaagaaauuagcauuauaugguaaaauaaaugauaauaacagcuggauuauagacaacgggauauaucauauagcaccccuaggaaaacuacacucaaacaauaaaauaggaauagaaacauuaaccgaagucaugaaaguuuauccuuacuuauccaugcaacacuuacaaucagcagaucaaauaaaaagacauuaugauucaaaagacgcagaagguaacaaaauaccccuagacaaauuuaagaaagaaggaaaagaaaaauauugcccaaaaacauacacauuugacgacgggaaaguaaucauaaaagcaggagcgagagucgaagaagaaaaaguaaaaagacucuacugggcaucuaaagaaguaaacucccaauucuucaggguauauggaauagacaaaccauuagaagaaggaaaucccgaugacauuuugacaaugguaaucuauaauaguccggaagaauauaaacugaacagugucuuauacggauaugauaccaacaacgguggaauguauauagaaccagagggaaccuucuucaccuaugaaagggaagcccaagaaucaacauacacucucgaggaacuauuuaggcacgaauauacacacuauuuacaaggacgauacgcaguaccaggacaauggggcaggacaaaacuuuacgauaacgacagacuaacuugguaugaagaagguggcgccgaacuauucgccgguucaacucgcacaagcggaauauugccacgaaaaucaaucguaucuaacauacacaacacaacaagaaauaaccguuacaaacuaucagauacaguucacuccaaauacggagcaaguuuugaauuuuacaacuacgccuguauguuuauggacuacauguauaauaaagauaugggcauacuaaauaaacugaacgauuuagcuaaaaacaaugacguagacggcuacgacaacuacauaagagauuuaaguuccaacuaugcacuaaaugauaaauaucaagaucacaugcaagaaagaauagauaacuaugaaaauuuaacaguaccuuuuguggcagacgauuaccuuguucgacacgcauauaaaaaccccaaugagauauauucagaaauuucagaaguagcaaaauuaaaagaugcaaaaagcgaaguaaagaaaagccaauacuucuccacauuuacccuccgaggaucauacaccggcggagccuccaaaggaaaacuagaagaccaaaaagcuaugaacaaauucauagaugacucccuaaagaaauuagacacauauucaugguccggauacaaaacccuaacggcuuacuucacaaauuacaaagucgacuccucaaauaggguuacauacgacgucguauuucacggauaucuccccaaugagggagacaguaaaaauucccuaccauacgggaaaauaaacggaacauauaaagggacagaaaaagagaaaauaaaauucucgucugaaggaucuuuugaccccgacgggaaaauugugucauaugaaugggauuuuggagauggaaauaaaucaaaugaagaaaacccagaacacagcuaugacaaaguaggcacauacaccguaaaauuaaaaguaacagacgacaaaggagaaucaucaguauccaccaccacagcagaaauuaaagaucuaucugaaaacaaacucccaguaaucuauaugcacguaccuaaaaguggcgcucucaaucaaaaaguaguauuuuacggaaaaggaacauaugacccagacggaagcauagcaggguaucaaugggauuucggagauggaucugauuuuucuucagaacaaaacccaucgcacguauacaccaagaaaggagaauauacaguaacacuaagaguuauggauucaucuggacaaaugucugagaaaacuaugaaaauaaaaauaacagacccaguuuauccaauaggcacagaaaaagaaccaaacaacaguaaagaaacagcaucaggaccaaucgucccgggcauaccaguaaguggaacaauagaaaauacaagcgaccaagauuacuucuacuucgauguaauaacaccaggcgaaguuaaaauugacauaaacaaacucggauauggaggagcaacauggguaguauaugaugaaaacaauaaugccguaucuuacgccacagacgauggacaaaaccuaaguggaaaauuuaaagcugauaaacccggacgcuacuacauacaccuguauauguuuaacgguucauacaugccauacaggauaaacauagaagggagugugggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3161 - RNA, 3382 nt, Artificial Sequence
  mRNA product Design2 comprising derived and/or modified sequence from Clostridium histolyticum__BAA34542.1__HsALB(1-18)_ColH(41-1021) (opt6)
ggggcgcugccuacggagguggcagccaucuccuucucggcaucaagcuuaccaugaaauggguuacuuuuauaucauuacuauuccuauucucaucagcauacagcguacagaacgaaucaaaaagauacacaguaaguuacuuaaaaacguuaaacuacuacgaccuaguagauuuauuagucaaaaccgaaauugaaaauuuacccgaccuuuuccaauacucuuccgaugcaaaagaauuuuacggcaauaaaacacgaaugagcuucauaauggaugaaaucgguagacgagcuccccaauacacagaaauagaccacaaaggaaucccuacauuaguugaaguaguuagagcaggauucuaccuagguuuucauaacaaggaauuaaaugaaauaaauaaacgaucauucaaagaacgaguaauaccaucaauacuugcaauacagaaaaacccaaacuuuaaacuuggaacugaaguucaagacaaaauagugucagcaacaggacuccuagcuggcaaugaaacagcuccaccagaaguaguaaacaacuuuacaccaauauuacaagauugcauuaaaaauauagaccgcuacgcuuuagaugaucuaaaaaguaaagcacuauuuaacguacuggcagcaccuacuuacgacauaaccgaauaccuacgagcaacaaaagaaaaaccugaaaacacccccugguacggaaaaauagacggauuuaucaacgaacuaaagaaauuagcacuuuauggaaaaauuaacgauaauaauuccuggaucaucgacaauggcauauaccauauagcuccacuaggaaaauuacacucaaacaacaaaauaggaauagaaacacuaacggagguaaugaaaguauacccauaucuaucaaugcaacaccuacaaucagccgaucaaauaaaaagacauuaugacucaaaagaugcagaaggcaacaaaauaccacuagacaaauucaagaaagaaggaaaagaaaaauauuguccgaaaacauacaccuuugaugauggaaaaguaauuauaaaagcuggagcaagagucgaagaagaaaaaguuaaacgauuauauugggcaucaaaagaaguaaauagucaauuuuuccgcgucuauggaauagauaaaccccuugaggaaggaaauccagacgacauccuaacaaugguaauauauaauucaccugaagaauacaaauuaaauucaguacuauauggauacgacacaaacaacggaggaauguacauagaaccagaagguacauucuuuacauaugagagagaagcacaagaaagcacauacacucuagaagaacuauucagacacgaguacacccacuaccuacaaggucgauaugcuguaccaggacaauggggaaggacaaaacuauacgauaaugacagacuaaccugguacgaagaaggaggagccgaacuauucgcaggaagcacacguacaucagguauacuaccaagaaaauccauagucagcaacauacauaacacgacacguaacaacagauacaaauuaagugacacaguucauagcaaauauggagcuucauuugaguuuuauaacuacgcauguauguucauggauuacauguacaacaaagacaugggaaucuuaaauaaacuaaacgauuuagcuaaaaauaaugauguagauggauacgacaacuauauacgcgauuuaagcaguaacuacgcacuaaacgauaaauaccaagaucacaugcaagaaaggauagacaacuacgaaaauuuaacagucccauucgucgcagacgauuaccuagucagacacgccuauaaaaauccuaacgaaauauacucagagauuagcgaggucgcaaaauuaaaagacgcaaaaagugaaguaaagaaaagucaauauuucaguacauuuaccuuaagaggcucauauacaggcggagcaaguaaaggaaaauuagaagaucaaaaagcaaugaauaaauucauugaugacagccuaaagaaauuagacacauacucauggucgggcuacaaaacccuuaccgcuuacuuuacaaacuauaaagucgacaguucaaacagggucacauacgacguuguauuccacggcuacuuaccaaaugaaggagacaguaaaaacucccuaccauacggaaaaauaaauggaacguauaaaggaacagaaaaagagaaaauaaaauucucaucagaaggaucauucgacccggacggaaaaauuguuuccuacgaaugggacuucggggacgguaacaaaucgaacgaagaaaauccugaacauucauaugauaaaguaggaacauacacaguaaaacuaaaagucacagaugacaaaggagaaucguccguaucuaccacaacagcggaaauaaaagauuuaucagaaaauaaacuacccguuauuuacaugcaugucccaaaaagcggagcauuaaaccaaaaaguaguauuuuacggaaaaggcacauaugauccagacggaucaauugccgguuaucaaugggacuucggagacggaagcgacuucaguagugaacaaaaccccucccauguauacacaaagaaaggugaauacacagucaccuuaagaguaauggacucaucaggacagaugagugagaaaacaaugaaaauaaaaauaaccgaccccgucuauccaauaggaaccgaaaaagaaccaaauaauucaaaagaaacagcaucaggaccaauaguacccggcaucccaguaucuggcaccaucgaaaacaccucugaucaagacuacuucuacuucgacguaauaacaccaggugaaguaaaaauugauaucaauaaacuaggauacggcggagcaacauggguaguuuacgacgaaaacaacaacgcaguuagcuacgcuacagaugacggacaaaaccuaagugggaaauuuaaagcagacaaaccuggaagauauuauauccaucucuacauguucaacgguucuuauaugccauauagaauaaacauagaaggcucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3162 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt6)
ggggcgcugccuacggagguggcagccaucuccuucucggcaucaagcuuaccaugaaauggguuacauucaucagcuuacuauuccuauucaguagcgccuacagcaugaaaagaaaauguuuauccaaaagacuaaugcuagcuaucacaauggcuacaauuuucacagugaacucuacauuaccaauauacgcugcaguugauaaaaacaacgcaacagccgcuagaagaagaagaaaacgaguacaaaacgaaagcaaaagauacaccgucucuuacuuaaaaacacuaaauuacuacgaucugguagaccuucuaguaaaaacugaaauagaaaaucuaccagacuuauuccaauauucaagcgacgcaaaagaauuuuacggaaacaagacaagaaugaguuuuauuauggaugaaauuggacguagagcaccccaauacaccgaaauagaucacaaaggcauacccaccuuaguggaaguuguaagagccggguucuacuuaggauuucauaauaaagaauuaaaugaaauaaauaaacgauccuucaaagaaagagucauaccaagcauucucgcaauucagaaaaacccaaauuucaaacuaggaaccgaaguacaagauaaaauuguaucagcaaccggauuauuagcugguaacgaaacagcucccccugaaguaguaaauaacuuuacccccauauuacaagauugcauuaaaaauauagacagauacgccuuagacgaccuaaaaucaaaagcacuauucaauguccucgcugcuccaacauaugacauaacagaauaccuuagagcgacuaaggaaaaacccgaaaacaccccaugguaugguaaaauagaugguuucauaaacgaacuaaagaaacucgcacuauacggaaaaauaaacgacaacaauagcuggauaauagacaauggaauauaucauauagcaccauuaggaaaacuacauucaaacaauaaaaucggaauagaaacauuaacagaaguaaugaaaguauaucccuauuuaagcaugcaacaucuacagucugcggaccaaauaaaacgucauuacgacucuaaagacgcagaaggaaacaaaauuccacuagacaaauuuaagaaagaagggaaagaaaaauacugcccaaaaaccuacacuuuugaugauggaaaaguaauuauaaaagcuggagcacgcguagaagaagaaaaaguaaaacgauuauacugggccaguaaagaagugaauagucaauucuucagagucuauggaauugacaaaccucuagaagaaggcaacccagacgauauacuaaccaugguuauauauaauucuccagaagaauacaaacuaaauucaguauuauacggauaugauaccaacaacggagggauguacauagaaccugaagguacuuucuuuacauacgaaagagaagcacaagaaagcacauauaccuuagaggaacuauuuagacacgaauauacacacuaccugcaaggaagauaugcugugccaggacaauggggacguacuaaacuauacgacaacgauagacuaacaugguaugaagaaggaggagcagaacucuuugcuggcuccaccagaacaaguggaaucuuaccaagaaaaaguauaguaucaaacauacauaacacaacaagaaauaacagauacaaacucagcgacacaguacacucaaaauacggagcuagcuucgaauuuuauaauuacgcaugcauguucauggacuacauguacaacaaagauaugggaaucuuaaacaaacuaaaugaucuagcgaaaaauaaugauguugaugguuacgacaacuauauccgugaucucucaucaaacuacgcacugaacgacaaauaccaagaucauaugcaagaacguauagauaauuaugaaaauuuaacuguacccuucguagcagaugauuacuugguuaggcaugcauacaaaaauccuaaugaaauauacucagaaauaucugaaguagccaaacuaaaagaugcaaaaagugaaguuaagaaaagccaauauuuuuccacauuuacauuacgaggauccuauacuggaggggccaguaaagguaaacuagaagaccaaaaagcaaugaacaaauucaucgaugauucccuaaagaaauuagauacauauaguuggucaggcuacaaaacacuaacagccuauuuuacaaauuacaaaguagauucaagcaauagaguuacauacgacguaguauuccaugguuauuuaccaaaugaaggcgacaguaaaaauucauuaccauacggaaaaauaaauggaacauauaaaggaacggaaaaagagaaaauaaaauucuccucugaaggauccuuugacccagacggaaaaaucguuagcuacgaaugggacuucggugaugguaacaaaucaaacgaagaaaacccugaacacagcuacgacaaaguaggaaccuacacagucaaacucaaaguaacagaugauaaaggugaaucuucuguuucuacgacaacagcagaaaucaaagauuuauccgaaaacaaacucccagucauauauaugcacguaccaaaaucaggugcacuuaaucaaaagguuguauuuuauggaaaagguacauaugaucccgacggaucaaucgcaggauaccaaugggacuucggagacgggucagauuucuccucugaacaaaacccaagccacguauacaccaagaaaggagaauauaccguaaccuuacgagucauggauaguucaggucaaaugucagagaaaacaaugaaaaucaaaauaacugauccaguauacccaaucggaacagaaaaagaaccaaauaauagcaaagaaacagcaaguggacccaucgugccaggcaucccaguaucgggcacaauagaaaauacgagcgaccaagacuauuucuacuuugacgucauaacaccaggagaaguaaaaaucgauauaaauaaacuaggauacggaggagccacaugggucgucuacgaugaaaacaacaaugccgugagcuaugcaacagacgauggacagaaucuuucugggaaauucaaagcagauaaaccaggacgauacuauauacacuuauacauguuuaaugguaguuacaugccauaccgaauaaacauugaaggaagcguuggaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3163 - RNA, 958 nt, Artificial Sequence
  mRNA product Design2 comprising derived and/or modified sequence from Homo sapiens__NP_001133.1__HsAMELX (opt6)
ggggcgcugccuacggagguggcagccaucuccuucucggcaucaagcuuaccauggguaccuggauauuauucgcaugccuacuaggcgcagcauucgccaugccauuaccaccacacccaggacacccaggauacaucaacuucucauacgaaguacuaacaccacuaaaaugguaccaaucaauaagaccaccauacccaucauacggauacgaaccaauggguggauggcuacaccaccaaauaauaccaguacuaucacaacaacacccaccaacacacacacuacaaccacaccaucacauaccaguaguaccagcacaacaaccaguaauaccacaacaaccaaugaugccaguaccaggacaacacuccaugacaccaauacaacaucaccaaccaaaccuaccacccccagcacaacaaccauaccaaccacaaccaguacaaccacaaccacaccaaccaaugcaaccacaaccaccaguacaccccaugcaaccacucccaccacaaccaccacuaccaccaauguucccaaugcaacccuuaccaccaaugcuaccagaccuaacacuagaagcauggcccucaacagacaaaacaaaaagagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3164 - RNA, 517 nt, Artificial Sequence
  mRNA product Design2 comprising derived and/or modified sequence from Homo sapiens__NP_001133.1__HsAMELX-TRAP (opt6)
ggggcgcugccuacggagguggcagccaucuccuucucggcaucaagcuuaccaugccacuaccaccacacccaggacacccaggauacauaaacuucucauacgaaguacuaacaccacuaaaaugguaccaaucaauaagaccaccauacccaucauacggauacgaaccaaugggaggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3165 - RNA, 550 nt, Artificial Sequence
  mRNA product Design2 comprising derived and/or modified sequence from Homo sapiens__NP_001133.1__HsAMELX-LRAP (opt6)
ggggcgcugccuacggagguggcagccaucuccuucucggcaucaagcuuaccaugccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3166 - RNA, 589 nt, Artificial Sequence
  mRNA product Design2 comprising derived and/or modified sequence from Homo sapiens__NP_001133.1__HLA-A2-SP_HsAMELX(17-60) (opt6)
ggggcgcugccuacggagguggcagccaucuccuucucggcaucaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccauacccaucauacggauacgaaccaaugggaggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3167 - RNA, 622 nt, Artificial Sequence
  mRNA product Design2 comprising derived and/or modified sequence from Homo sapiens__NP_001133.1__HLA-A2-SP_HsAMELX(17-47,168-191) (opt6)
ggggcgcugccuacggagguggcagccaucuccuucucggcaucaagcuuaccauggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3168 - RNA, 961 nt, Artificial Sequence
  mRNA product Design2 comprising derived and/or modified sequence from Homo sapiens__NP_001134.1__HsAMELY (opt6)
ggggcgcugccuacggagguggcagccaucuccuucucggcaucaagcuuaccaugggaacauggauacuauucgcaugcuuaguaggagcagcauucgccaugccacuaccaccacaccccggccacccaggauacauaaacuucucauacgaaguauuaacaccacuaaaaugguaccaaucaaugauacgcccaccauacuccucauacggauacgaaccaaugggcggcugguuacaccaucaaauaauaccaguaguaucccaacaacacccacuaacacacacacuacaaucacaccaccacauaccaguaguaccagcacaacaaccacgaguacgccaacaagcacuaaugccaguaccaggacaacaaucaaugacaccaacacaacaccaccaaccaaaccuaccauuaccagcacaacaaccauuccaaccacaaccaguacaaccccaaccacaccaaccaaugcaaccacaaccaccaguacaaccaaugcaaccacuccuaccccaaccaccacuaccaccaauguucccacuaagaccacuaccaccaauacuaccagaccuacaccuagaagcauggccagcaacagacaaaacaaaacaagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3169 - RNA, 520 nt, Artificial Sequence
  mRNA product Design2 comprising derived and/or modified sequence from Homo sapiens__NP_001134.1__HsAMELY-TRAP (opt6)
ggggcgcugccuacggagguggcagccaucuccuucucggcaucaagcuuaccaugccacuaccaccacacccaggacacccaggauacauaaacuucucauacgaaguacuaacaccacuaaaaugguaccaaucaaugauaagaccaccauacucaucauacggauacgaaccaaugggaggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3170 - RNA, 553 nt, Artificial Sequence
  mRNA product Design2 comprising derived and/or modified sequence from Homo sapiens__NP_001134.1__HsAMELY-LRAP (opt6)
ggggcgcugccuacggagguggcagccaucuccuucucggcaucaagcuuaccaugccacuaccaccacacccaggacacccaggauacauaaacuucucauacgaaguauuaacaccacuaaaaugguaccaaucaaugauaagaccaccaccaauacuaccagaccuacaccuagaagcauggccagcaacagacaaaacaaaacaagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3171 - RNA, 592 nt, Artificial Sequence
  mRNA product Design2 comprising derived and/or modified sequence from Homo sapiens__NP_001134.1__HLA-A2-SP_HsAMELY(17-61) (opt6)
ggggcgcugccuacggagguggcagccaucuccuucucggcaucaagcuuaccauggcaguaauggcaccaagaacauuaguacuacuacuaucaggagcacuagcacuaacacaaacaugggcaaugccacuaccaccacauccaggacacccaggauauauaaauuucucauacgaaguauuaacaccacuaaaaugguaucaaucaaugauaagaccaccauacagcucauacggauacgaaccaaugggaggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3172 - RNA, 625 nt, Artificial Sequence
  mRNA product Design2 comprising derived and/or modified sequence from Homo sapiens__NP_001134.1__HLA-A2-SP_HsAMELY(17-48,169-192) (opt6)
ggggcgcugccuacggagguggcagccaucuccuucucggcaucaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaucaaucaaugauaagaccaccaccaauacuaccagaccuacaccuagaagcauggccagcaacagacaaaacaaaacaagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3173 - RNA, 952 nt, Artificial Sequence
  mRNA product Design2 comprising derived and/or modified sequence from Sus scrofa__NP_999071.1__SsAMELX-001-1 (opt6)
ggggcgcugccuacggagguggcagccaucuccuucucggcaucaagcuuaccaugggaaccuggauauuauucgcaugccuacuaggagccgcauucuccaugccacuaccaccacacccaggacacccaggauacauaaacuucucauacgaaguauuaaccccauuaaaaugguaucaaaacaugauaagacacccauacacaucauacggauacgaaccaaugggaggauggcuacaccaccaaauaauaccaguaguaucccaacaaacaccacaaucacacgcacuacaaccacaccaccauauaccaaugguaccagcacaacaaccaggaauaccacaacaaccaaugaugccacuaccaggacaacacucaaugacaccaacacaacaccaccaaccaaaccuaccacuaccagcccaacaaccauuccaaccacaaccaguacaaccacaaccacaccaaccacuacaaccccaauccccaaugcacccaauacaaccacuacuaccacaaccaccacuacccccaauguucucaaugcaaucacuacuaccagaccuaccacuagaagcauggccagccacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3174 - RNA, 520 nt, Artificial Sequence
  mRNA product Design2 comprising derived and/or modified sequence from Sus scrofa__NP_999071.1__SsAMELX-TRAP (opt6)
ggggcgcugccuacggagguggcagccaucuccuucucggcaucaagcuuaccaugccacuaccaccacacccaggacacccaggauacauaaacuucucauacgaaguacuaacaccacuaaaaugguaccaaaauaugauaagacacccauacacaucauacggauacgaaccaaugggaggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3175 - RNA, 553 nt, Artificial Sequence
  mRNA product Design2 comprising derived and/or modified sequence from Sus scrofa__NP_999071.1__SsAMELX-LRAP (opt6)
ggggcgcugccuacggagguggcagccaucuccuucucggcaucaagcuuaccaugccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3176 - RNA, 592 nt, Artificial Sequence
  mRNA product Design2 comprising derived and/or modified sequence from Sus scrofa__NP_999071.1__HLA-A2-SP_SsAMEL(17-61) (opt6)
ggggcgcugccuacggagguggcagccaucuccuucucggcaucaagcuuaccauggcaguaauggcaccaagaacauuaguacuacuacuaucaggagcacuagcacuaacacaaacaugggcaaugccacuaccaccacauccaggacacccaggauauauaaauuucucauacgaaguauuaacaccacuaaaaugguaucaaaauaugauaagacauccauauacaucauacggauacgaaccaaugggaggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3177 - RNA, 625 nt, Artificial Sequence
  mRNA product Design2 comprising derived and/or modified sequence from Sus scrofa__NP_999071.1__HLA-A2-SP_SsAMEL(17-49,167-189) (opt6)
ggggcgcugccuacggagguggcagccaucuccuucucggcaucaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3178 - RNA, 916 nt, Artificial Sequence
  mRNA product Design2 comprising derived and/or modified sequence from Sus scrofa__P45561-2__SsAMELX-001-2 (opt6)
ggggcgcugccuacggagguggcagccaucuccuucucggcaucaagcuuaccaugggaacauggauacuauucgcaugccuacucggugcagcauucucaaugccacuaccaccacacccaggacacccaggauacauaaacuucucauacauacgacacccauacacaucauacggauacgaaccaaugggaggauggcuacaccaccaaauaauacccguaguaucucaacaaacaccacaaucacacgcacuacaaccacaccaccacauaccaaugguaccagcacaacaaccaggaauaccacaacaaccaaugaugccauuaccaggacaacacucaaugacaccaacacaacaccaccaaccaaaccuaccacuaccagcacaacaaccuuuccaaccacaaccaguacaaccacaaccacaccaaccacuacaaccacaaucaccaaugcacccaauacaaccauuacuaccacaaccaccacuaccaccaauguucucaaugcaaucacuacuaccagaccuaccacuagaagcauggccagcaacagacaaaaccaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3179 - RNA, 952 nt, Artificial Sequence
  mRNA product Design2 comprising derived and/or modified sequence from Sus scrofa__NP_998965.1__SsAMELX-001-3 (opt6)
ggggcgcugccuacggagguggcagccaucuccuucucggcaucaagcuuaccaugggaacauggauauucuucgccugccuacuaggcgcaucacuagcaaugccacuaccaccacacccaggacacccaggauauauaaacuucucauacgaaguacuaacaccucuaaaaugguaccaaaacaugauaagacauccauacacaucauacggauacgaaccaaugggcggaugguuacaccaccaaauaauaccaguagucucccaacaaacaccacaaucacacgcauuacaaccccaccaccacauacccaugguaccagcccaacaaccaggaauaccacaacaaccaaugaugccacuaccaggacaacacucaaugacaccaacacaacaccaccaaccaaaccucccauuaccagcacaacaacccuuccaaccacaacccguacaaccacaaccacaccaaccacuacaaccacaaucaccaaugcacccaauacaaccacuacuaccccaaccaccacuaccaccaauguucucaaugcaaucacuacuacccgaccuaccauuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3180 - RNA, 601 nt, Artificial Sequence
  mRNA product Design2 comprising derived and/or modified sequence from Sus scrofa__K7GPB2__SsAMELX-002 (opt6)
ggggcgcugccuacggagguggcagccaucuccuucucggcaucaagcuuaccaugggaacauggauacuauucgcaugccuacuaggagcagcauucucaaugccacuaccaccacacccaggacacccaggauacauaaacuucucauacgaaguacuaacaccacuaaaaugguaucaaaacaugauaagacacccaucacuauuaccagaccuaccacuagaagcauggccagcaacagacaaaacaaaaagagaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3181 - RNA, 994 nt, Artificial Sequence
  mRNA product Design2 comprising derived and/or modified sequence from Sus scrofa__K7GLD0__SsAMELX-003 (opt6)
ggggcgcugccuacggagguggcagccaucuccuucucggcaucaagcuuaccaugggaacauggauacuauucgcaugccuacuaggagccgcauucucaaugccccuaccaccacacccaggacacccaggcuacauaaacuucucauacgaagaccuauaccuagaagcaauaagaauagacagaacagcauucguccuaacaccauuaaaaugguaccaaaacaugauaagacacccauacacaucauacggauacgaaccaaugggaggcuggcuacaccaccaaauaauacccguaguaucccaacaaacaccacaaucacacgcacuccaaccacaccaucacauaccuaugguaccagcacaacaacccggaauaccacaacaaccaaugaugccacuaccaggacaacacucaaugacaccuacacaacaccaccaaccaaaccuaccauuaccagcacaacaaccauuccaaccacaaccaguacaaccacaaccacaccaaccccuacaaccacaaucaccaaugcacccaauacaaccacuacucccacaaccaccccuaccacccauguucucaaugcaaucuuuacuaccagauuuaccauuagaagcauggccagcaacagacaaaacaaaaagagaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3182 - RNA, 880 nt, Artificial Sequence
  mRNA product Design2 comprising derived and/or modified sequence from Sus scrofa__K7GPE9__SsAMELX-004 (opt6)
ggggcgcugccuacggagguggcagccaucuccuucucggcaucaagcuuaccaugggcacauggauacuauucgcaugccuacuaggagcagcauucuccaugccacuaccaccacacccaggacacccaggauacauaaacuucucauacgaaguacucaccccacuaaaaugguaccaaaacaugauaagacacccaacaccacaaucccacgcacuccaaccacaccaccacauaccaaugguaccagcacaacaaccaggaauaccacaacaaccaaugaugccacuaccaggacaacacucaaugacaccaacacaacaccaccaacccaaccuaccacuaccagcacaacaaccauuucaaccacaaccaguacaaccacaaccacaccaaccacuacaaccacaaucaccaaugcacccaauacaaccacuacucccacaaccaccacuacccccaauguucucaaugcaaucacuauuaccagaccuaccacuagaagcauggccagcaacagacaaaacaaaacgagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3183 - RNA, 904 nt, Artificial Sequence
  mRNA product Design2 comprising derived and/or modified sequence from Sus scrofa__J9JIM4__SsAMELX-201 (opt6)
ggggcgcugccuacggagguggcagccaucuccuucucggcaucaagcuuaccaugccacuaccaccacacccaggacacccaggauacauaaacuuuucauacgaaguacuaaccccacuaaaaugguaccaaaacaugauaagacaccccuacacaucauacggcuacgaaccaaugggaggauggcuacaccaccaaauaauaccaguaguaucacaacaaacaccacaaucacacgcacuccaaccacaccaccacauaccaaugguaccagcacaacaacccggaauaccacaacaaccaaugaugccacucccaggacaacacucaaugacaccaacacaacaccaccaaccaaaccuaccacuaccagcccaacaaccauuccaaccacaaccaguacaaccacaaccacaccaaccacuacaaccacaaucaccaaugcacccaauacaaccacuacuaccacaacccccacuacccccaauguucucaaugcaaucacuacuaccagaccuaccacuagaagcauggccagcaaccgacaaaacaaaaagagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3184 - RNA, 3343 nt, Artificial Sequence
  mRNA product Design2 comprising derived and/or modified sequence from Homo sapiens__NP_006120.1__HsBMP1 (opt6)
ggggcgcugccuacggagguggcagccaucuccuucucggcaucaagcuuaccaugccagggguagcuagacuaccucuacucuuaggacuccuauuguuaccacggccaggaagaccguuagaucuagcggacuacacauaugaucucgcagaagaagacgacagugaaccgcuaaauuacaaagauccauguaaagcggccgcauuuuugggagauauagcauuagaugaagaagacuuaagagcauuucaaguacaacaagcuguugaucuaagaagacacacggcccgaaaaagcaguauaaaagcagcgguaccaggcaacacaagcacgccaucaugccaaaguacaaacggacaaccacaaagaggggcuugcgggagauggagaggaagaagcagaagcagacgcgcagcuacuucaagaccugaaagaguuuggccugacggcguaauaccauucguaauaggaggcaauuuuacaggaagucagcgcgcaguuuuucggcaagcaaugcgccacugggaaaaacauacuuguguaacauucuuagagcgaacagaugaagauuccuauauaguuuucacauacaggcccugcggauguuguucauauguaggaagacgcgggggaggaccacaagcgauaaguauaggaaaaaauugugacaaauucggaauaguuguccaugaauuaggucacguugugggauucuggcacgaacacacacgaccagauagagacagacauguaaguauaguaagggaaaauauacaaccagggcaggaauacaacuuuuuaaaaauggaaccccaagagguagaaucacuuggcgaaacuuacgauuucgauaguauaaugcauuaugcuagaaauacauuuucgagaggaauauuccuagacacuauaguaccgaaauacgaaguaaauggagugaaacccccaauaggccaaagaacuagacuaucaaaaggagacauagcacaggcaagaaaauuauauaaaugucccgcguguggugaaacauuacaagauucuacaggaaauuuuucaucuccugaauauccuaauggcuauagugcacacaugcauuguguauggcgcauuucaguaacaccaggagaaaaaauuauuuugaauuucacaagucuagacuuauacagaaguagauuauguugguaugacuauguagaagucagggauggauucuggagaaaagcuccucuaaggggaagauuuuguggaagcaaauuaccugaaccaauaguuagcacagauucaagacuuuggguagaauuuagaaguaguucaaauuggguaggaaaaggauuuuucgcaguguaugaagcaauuugcgguggagauguaaaaaaagacuaugggcacauacaaagcccaaacuauccugaugauuauagaccaucaaaaguauguauauggcgaauacaaguuagugaaggguuucacguaggauuaacuuuucaauccuucgaaauagaaagacaugacucuugcgcauaugauuauuuagaaguuagagacggacauagugagaguaguacucuaaucggaagauacugcggcuaugaaaaaccugaugacauuaaaagcacuagcucuagauuauggcuaaaauuuguaagugaugguagcauaaauaaggcagguuuugcaguaaacuuuuuuaaagagguugaugaauguucgaggccuaauagaggugguugugaacaacggugcuugaauacacuaggaagcuacaaaugcucaugcgauccaggcuacgaauuagcgccagauaaaagaagaugugaagcagcauguggaggauuuuugacuaaacuaaauggaucaauaacaaguccagguuggccgaaagaauacccuccuaauaaaaacuguauuuggcaacuuguagcaccuacucaauauagaauaucauugcaauucgauuuuuucgagacagaaggaaacgacguauguaaauaugacuuuguggaaguaagaaguggucuaaccgcugauaguaagcuacacggaaaauucugcgguagugagaaaccagaaguaauaacgucacaauacaauaauaugagaguugaauuuaagagugacaauacaguuucaaaaaaaggauuuaaagcacauuuuuucucagacaaagaugaguguaguaaagauaauggaggaugccagcaagacugcguaaauacauucggaagcuaugaaugucaaugucgauccggcuuuguauuacacgauaauaaacacgauuguaaagaagcuggaugcgaucacaaaguaacgaguacuagcggaacaauuacaagcccaaauuggccggacaaauaucccucaaaaaaagaauguacuugggcaauaucuucuacaccgggucauagagugaaauuaacauucauggaaauggacauagaaucacaaccagaaugugcauaugaucaccuugaaguauucgaugguagagaugcuaaagcuccaguacugggucgcuuuuguggaaguaaaaaacccgagccuguauuagcaacaggaucaagaauguuccuuagauucuacuccgacaauucaguacagagaaaagguuuccaagcuucucacgcaacagaauguggaggccaagugcgagcggauguaaaaacaaaagacuuauauucucacgcacaguuuggagacaauaauuauccaggagguguggauugugaauggguuauagucgcagaagaaggauacggaguagagcuagucuuucaaacauuugagguagaagaagaaacugauuguggauacgacuauauggaacucuuugauggauacgacucaacagcaccccgauuagguagauauuguggaucuggaccacccgaagaaguauauuccgcaggagacagcguauuagucaaguuccacuccgaugauaccaucacuaaaaaaggauuucaucuuagauauacaagcacaaaauuucaagacacucuucacagccgaaaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3185 - RNA, 1573 nt, Artificial Sequence
  mRNA product Design2 comprising derived and/or modified sequence from Homo sapiens__NP_001191.1__HsBMP2 (opt6)
ggggcgcugccuacggagguggcagccaucuccuucucggcaucaagcuuaccaugguagcugguacuagaugccuacuagcauuacucuuaccacaaguauuacuaggaggagcagcaggauuagucccagaacuagguagaagaaaauucgcagcugccucaucaggaagacccagcucacaaccuucagacgaaguccuaucagaauuugaauugagauuacuaucaauguucggacuuaaacaaagaccaacaccaucaagagaugcaguaguaccaccauauaugcuagauuuauauagaagacacucaggacaaccaggaaguccagcuccagaccauagauuagaaagagcagcaaguagagcaaacacagucaggagcuuucaucacgaagaaucacuagaagaauuaccagaaacaucaggaaaaaccacaagaagauuuuucuuuaaccuuaguucaauaccaacagaagaauucaucacaagugcagaacuacaagucuucagggaacaaaugcaggacgcacuaggaaauaauucaucauuccaucauagaauaaauaucuaugaaauaauaaaaccagcaacagccaacucaaaauucccaguaacaagacuacuagacacaagacuaguaaaccaaaacgcaagcagaugggaaagcuuugauguaacaccagcaguaaugcgauggacagcacaaggucacgcaaaucacggauucguagucgaagucgcgcaucuagaagaaaaacaagguguaagcaaacgacauguaagaauaaguagaaguuuacaccaagaugaacauucauggucacaaauaagaccacuccuaguaacauucggacaugacgguaaaggacacccacuacacaaacgagaaaaaagacaagcaaaacauaaacaaagaaaaagacuaaaaucaucaugcaaaagacauccguuauauguugacuuuucagauguaggauggaacgacuggaucguagcacccccaggauaucacgcauucuauugucauggagaauguccauuuccauuagcagaucacuuaaauagcacaaaccacgccauuguacaaacucuagucaauucagucaauucaaaaaucccaaaagcaugcugcguaccuacagaacuaucagcaauuucaaugcuauaccuagacgaaaaugaaaaaguaguacuuaaaaacuaucaagacaugguuguagaaggauguggaugcagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3186 - RNA, 1609 nt, Artificial Sequence
  mRNA product Design2 comprising derived and/or modified sequence from Homo sapiens__NP_001193.2__HsBMP4 (opt6)
ggggcgcugccuacggagguggcagccaucuccuucucggcaucaagcuuaccaugauacccggaaacagaaugcuaaugguaguauuacuaugccaaguauuacuaggaggagcuagccaugccagcuuaauuccugaaacaggcaaaaagaaaguagcagaaauacaaggacacgcaggaggaagaagaucaggacaaagccaugaacuacuaagagacuucgaagcaacauuacuacaaauguuuggacuacgacgaagaccacaaccuaguaaaagcgcagucauaccagacuauaugagagaucuauaucgcuuacaaagcggagaagaagaagaagaacaaauacauucaacaggauuagaauacccagaaagacccgcaucaagagcaaauacagugaggucauuccaucaugaagaacaucuagaaaauauaccaggaacaucagaaaauucagcauucagauuuuuauucaauuuaaguucuauaccagaaaacgaaguaauaucaucugcagaacuaagauuauucagagaacaaguugaucaaggaccagacugggaaagagguuuucacagaauaaauaucuaugaaguaaugaaaccuccagcagaaguaguuccagggcaucuaaucacaagauuacucgauacaagauuaguacaccauaacguaacacgaugggaaacauuugauguaucaccagcaguucuaagauggacaagagaaaaacaaccgaauuacggauuagcaauagaaguuacucacuuacaucaaacaagaacccaccaaggacaacauguaagaauaucccgaucauuaccacaaggcucaggaaauugggcacaacuaagaccacuccucguaacauuuggacaugacggaagaggacaugcucucaccagaagaagacgagcaaaaagaucaccaaaacaccauagccaaagagcuagaaagaaaaauaaaaauugcagaagacauaguuuauacguugacuucucagauguaggauggaaugauuggauaguagcaccaccugguuaccaagcauuuuauugucacggagacuguccauuuccuuuagcagaucacuuaaacaguacaaaucacgcaauaguacaaacucuaguuaacucaguaaacagcucuauaccaaaagcaugcugugucccaacagaacuaucggcaauuucaauguuauauuuagaugaauaugauaaaguaguacuuaaaaauuaucaagaaaugguaguagaaggaugcggauguagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3187 - RNA, 1924 nt, Artificial Sequence
  mRNA product Design2 comprising derived and/or modified sequence from Homo sapiens__NP_001709.1__HsBMP6 (opt6)
ggggcgcugccuacggagguggcagccaucuccuucucggcaucaagcuuaccaugccaggauuaggucguagagcacaaugguuaugcugguggugggguuuacuauguucauguuguggcccaccaccccuaagaccaccauuacccgcagcagcggcugcagccgcaggaggacaacuauuaggagauggaggaaguccaggcagaacagaacaaccaccgccaagcccccaaagcucaucuggauuucuauacagaagauuaaaaacacaagaaaagagagaaaugcaaaaagaaauacuaucgguauuaggacugccacaucgacccagaccacuacacggauuacaacaaccccaaccacccgcacuucgacaacaagaagaacaacaacaacaacaacaacuaccaagaggcgaaccuccaccaggaagauuaaaaucagcaccacuauuuauguuagauuuauauaacgcauuaucagcagacaaugacgaagacggagcaucagaaggagaaagacaacaaucauggccccaugaagcagcaucaaguucacaacgaagacaaccaccuccaggagcugcucauccauuaaacagaaaaucacuucucgccccaggaaguggcucuggaggugcaaguccauuaacaucagcacaagauagcgcuuucuuaaaugaugcagauaugguaaugucauuuguaaaucuagucgaauacgauaaagaauuuucaccaagacaacgacaucauaaagaauuuaaauucaauuuaagucaaauaccugaaggugaaguaguuacagcugcugaauuucgaauauauaaagacuguguaaugggaucauuuaaaaaccaaacauucuuaauaucaauauaucaaguuuuacaagaacaucaacauagagauagugaucucuuuuuacuagauacaagaguaguaugggcuagugaagaagguugguuagaauuugacauaacagcuacgaguaauuuauggguuguaacaccacaacauaauaugggucuacaacuuagcguaguuacacgagaugguguacauguacacccaagagcagcaggucuaguaggaagggauggaccuuaugacaagcaaccauucaugguagcauucuuuaaaguaagcgaaguucauguaagaacuacaagaucagcuucaucaagaagaagacaacaaagucgaaacagaaguacacaaagucaagauguugcaagaguauccagugcaucugauuauaacaguagcgaacuaaaaaccgcauguagaaaacacgaauuauacgucagcuuucaagaucuaggauggcaagauuggauaaucgcaccaaaaggauaugcagccaauuauugugauggagaaugcaguuuuccuuuaaaugcacacaugaaugcaacaaaucacgcuauaguucaaacacuuguucacuuaaugaauccugaauacguaccaaaaccauguugcgcaccuacaaaauuaaacgcaauaucaguacuauacuuugaugauaauucaaacguaauacuuaaaaaguauagaaauaugguaguaagagcaugugguugucacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3188 - RNA, 1678 nt, Artificial Sequence
  mRNA product Design2 comprising derived and/or modified sequence from Homo sapiens__NP_001710.1__HsBMP7 (opt6)
ggggcgcugccuacggagguggcagccaucuccuucucggcaucaagcuuaccaugcauguaagaucacuccgagcagcagcaccacacucauuuguagcauuaugggcaccacuauucuuauuaagauccgcacucgcagacuucaguuuagacaaugaaguacacucaucauuuauacaucgaagauuacgaucccaagaaaggagagaaaugcaaagagaaauacucucaauacuagguuuaccccacagaccaagaccacaccuacaaggaaaacauaauuccgcaccaauguucaugcuagaucuauacaacgcaauggcaguagaagaaggaggaggaccaggaggccaagguuucucauacccauauaaagcaguauucaguacacaaggaccuccacuagcaucccuacaagauucucacuucuuaacugaugcagauauggucaugucauucguuaacuuaguagaacaugauaaagaauuuuuucacccaagauaucaccaucgugaauuuagauucgaccuaucaaaaauuccagaaggagaagccguaacagcagcagaauucaggauuuauaaagacuauauccgagaacgauucgacaacgaaacauucagaauaucaguauaucaagucuuacaagaacaucucggccgagaaucagacuuauucuuauuagauucgagaacucuaugggcaucugaagaaggaugguuaguauuugauauaacagcaacaagcaaucauuggguaguaaacccccgacauaaucuaggauuacaauuaucaguagaaacacuugauggccaaagcauuaacccaaaauuagcaggacuaauaggcagacaugguccacaaaacaaacaaccauucaugguagcauuuuucaaagcaacagaaguccauuucagaaguauaagaucaacaggaaguaaacaaagaucacaaaacagaucaaaaacaccaaaaaaucaagaagcacuaagaauggcuaacguagcagaaaauagcucuagugaccaaaggcaagccuguaaaaaacacgaauuauauguaucauucagagauuuaggauggcaagauuggaucauagcaccagaaggauaugcagcauauuacugugaaggagaaugugcuuucccauuaaacucauacaugaacgcaacaaaucacgcaaucguacaaacacucguacacuuuauuaauccagaaacaguaccaaaacccugcugcgcacccacacaauuaaacgcaauaucaguacuauacuuugacgauucaucaaacguaauauuaaaaaaauacagaaacauggucguaagagcaugugguugccauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3189 - RNA, 682 nt, Artificial Sequence
  mRNA product Design2 comprising derived and/or modified sequence from Homo sapiens__NP_006264.2__HsCCL7 (opt6)
ggggcgcugccuacggagguggcagccaucuccuucucggcaucaagcuuaccaugaaagcaucagcagcacuacuaugccuacuacuaacagcagcagcauucucaccacaaggacuagcacaaccaguaggaauaaacacaucaacaacaugcugcuacagauucauaaacaaaaaaauaccaaaacaaagacuagaaucauacagaagaacaacaucaucacacugcccaagagaagcaguaauauucaaaacaaaacuagacaaagaaauaugcgcagacccaacacaaaaauggguacaagacuucaugaaacaccuagacaaaaaaacacaaacaccaaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3190 - RNA, 4006 nt, Artificial Sequence
  mRNA product Design2 comprising derived and/or modified sequence from Homo sapiens__NP_001954.2__HsEGF (opt6)
ggggcgcugccuacggagguggcagccaucuccuucucggcaucaagcuuaccauguuacuaacuuugauaauauuauuaccaguuguuucaaaauuuucuuuugugucauuaucugcaccgcaacacuggaguuguccagaaggaacucuagcuggaaauggaaauucuacauguguugggccugcaccauuucuaauauucagccauggaaacucaauuuucagaauagauacugagggaaccaacuaugagcaacucguugucgacgcuggaguaucuguaauaauggauuuucauuacaaugagaaacgcauauacuggguugacuuagaacgacaauuauuacaaagaguauuucuaaauggaagcagacaagaaaggguaugcaauauagagaaaaaugugaguggaauggcaaucaauuggauaaaugaagaagugauauggucaaaccaacaagaaggaauuauaacaguaacagauaugaaaggcaauaauagccauauacuguugagcgcccuuaaauauccagcuaacguagcaguagauccaguagaaagauuuauauuuuggaguucugaagucgcaggaucacuauaccgagcugaccuugauggaguagguguaaaggcuuuacuagaaacaucagagaaaaucacagcaguaagucuugacguacuagauaaaagauuauucuggauccaauauaaccgcgaagggucuaauucccuuauauguucaugugacuacgacggaggcucaguacauauaucaaaacauccgacccaacauaaucuauuugcuaugagccuuuucggggacagaaucuuuuauucgacauggaaaaugaaaacaauuuggauagcaaauaaacacacaggaaaagacaugguaagaauuaauuuacauagcucuuucguaccuuugggagaauuaaaaguaguacauccguuggcacagccuaaagcagaagacgauacaugggaaccugaacaaaaauugugcaaauugcgaaaaggaaacuguucaucgaccguuuguggacaagacuuacaaagucacuugugcaugugugcggaaggauaugcucuauccagagauagaaaauauugugaagaugucaacgaaugugcuuuuuggaaucauggaugcacacuaggaugcaaaaacacaccagguucuuauuacuguaccuguccaguagguuuuguuuuacuaccagacgguaaaagaugucaccagcuaguaucguguccacgcaacguaucugaauguucucacgauuguguacuuaccagcgaaggaccauuauguuuuuguccggagggaaguguacuagaacgugacgguaaaacauguucaggaugcucaucaccugauaacggugguuguagucaauuaugcgucccacuuaguccuguaaguugggaaugugacugcuucccaggauaugauuugcaauuagaugagaaaagcugugcagccagcggaccucaacccuuucuccuuuucgcaaacagccaagauauaagacauaugcauuuugauggaacugauuauggaacgcuauuaagucaacaaaugggaaugguuuacgcacuagaucaugauccuguagaaaauaaaauauauuuugcucacacagccuuaaaauggauagaacgggcaaauauggacgguagccaaagagaacgacuaaucgaagaaggaguagauguuccugaaggauuagcaguagauuggaucggaagacgauuuuauuggacggauaggggaaaaagccuaauugguagauccgaccuuaauggaaaaagaucaaaaauaauaacaaaagaaaacauaagccaaccacgcggaauugcgguacauccaauggcaaaacggcuauuuuggacagauacaggaauaaacccaagaauagaaaguucuucuuuacagggacuaggacgucuaguaauagcaagcuccgauuuaauuuggcccagugguauaacgauagacuuuuuaacugauaaacuauacuggugugaugcaaagcaaucagucauugaaauggcaaaucuagauggaucuaaaagaagaagacuaacucaaaacgauguaggacacccauuugccguagcaguauuugaagauuauguuugguucucagauugggcaaugccaagcguaaugagaguaaauaaaagaacaggaaaagauagagucagauugcaaggaagcauguuaaaaccguccagucuugucgucguucauccccuugcaaaaccaggugcggauccaugucuauaucaaaacggaggaugugaacauauuugcaagaaacgguuagguacugcauggugcagcugucgagaaggauucaugaaagcgagcgaugguaaaacauguuuagcacucgauggacaucaacuacuagcuggcggagaaguagaccugaaaaaccaagugacaccccuugauauacuuaguaaaaccagaguaagugaagauaauauaacggaaucacaacauauguuaguagcagaaaucauggugagcgaucaagaugauugugcacccguaggauguaguauguaugcaagaugcaucucagaaggagaagacgcaaccugccagugcuuaaaaggcuuugccggcgacggcaaacugugcucagauauugaugagugcgaaaugggugugcccguuuguccuccagcgucauccaaauguauaaauacagaaggagguuauguauguagaugcagcgaggguuaucaaggugauggcauacacuguuuggauaucgaugaaugucaauuaggagaacauucuuguggggaaaaugcaaguuguacaaauacagaaggagguuauacuuguaugugugcuggccguuuaagugaaccuggcuuaauauguccagacagcacuccgccuccucaccuaagagaggaugaucaccauuacagcguacgcaauagcgauucagaaugcccucuaagucacgacggguacugucuacaugacggaguauguauguacauagaggcuuuagauaaguaugcauguaacugugucguugguuacauaggagaaagaugucaauaucgagauuuaaaauggugggaauuaagacacgcgggacauggccaacaacaaaaaguaauagucguagccgucugcguaguuguucuaguaauguuacuacuacugagucuuuggggugcacacuauuauagaacacaaaaacuacuaucgaaaaaucccaaaaauccauaugaagaaagcaguagagauguaaggucaagacgaccggcugacacagaagaugggaugucaaguugcccacaaccaugguuuguaguaauaaaagagcaucaagaccuuaaaaacggaggucagccaguagcuggagaagacggucaggcugcggaugggaguaugcaaccaacaucuuggagacaagaaccucaacugugcggaauggguacggagcaaggcugcuggaucccugucagcucagacaaaggcagcuguccucaagugauggaacgaucauuccauaugccgucauacgggacacaaacguuggaaggaggaguggaaaaaccacauagucuauuauccgcaaacccauuauggcaacaacgagcauuagauccaccucaucaaauggaauuaacucaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3191 - RNA, 892 nt, Artificial Sequence
  mRNA product Design2 comprising derived and/or modified sequence from Homo sapiens__NP_001423.1__HsEREG (opt6)
ggggcgcugccuacggagguggcagccaucuccuucucggcaucaagcuuaccaugacagcagguagaagaauggaaauguuaugcgcaggaagaguacccgcacuacuacuaugccuaggauuccaccuauuacaagcaguacuaucaacaacaguaauaccaagcugcauaccaggagaaucaucagacaacugcacagcacuaguacaaacagaagacaauccaagaguagcacaaguaucaauaaccaaaugcucaucagacaugaacggauacugcuuacacggacaaugcauauaccuaguagacaugucacaaaacuacugcagaugcgaagucggauacacaggaguaagaugugaacacuuuuuucuaacaguacaucaaccacuaucaaaagaauacguagcacuaacaguaauauuaauaauacuauuucuaauaacaguagucggaucaacauacuacuucugcagaugguacagaaacagaaaaucaaaagaaccaaaaaaagaauacgaaagaguaacaucaggagacccagaacuaccacaaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3192 - RNA, 850 nt, Artificial Sequence
  mRNA product Design2 comprising derived and/or modified sequence from Homo sapiens__NP_000791.1__HsFGF1 (opt6)
ggggcgcugccuacggagguggcagccaucuccuucucggcaucaagcuuaccauggcagaaggagaaauaacaacauucacagcacuaacagaaaaauucaaccuaccaccaggaaacuacaaaaaaccaaaacuacuauacugcucaaacggaggacacuuccuaagaauacuaccagacggaacaguagacggaacaagagacagaagcgaccaacacauacaacuacaacuaucagcagaaucaguaggagaaguauacauaaaaucaacagaaacaggacaauaccuagcaauggacacagacggacuacuauacggaucacaaacaccaaacgaagaaugccuauucuuagaaagacuagaagaaaaccacuacaacacauacauaucaaaaaaacaugcagaaaaaaacugguucguaggacuaaaaaaaaacggaucauguaaaagaggaccaagaacacacuacggacaaaaagcaauacuauuccuaccauuaccagucucaagcgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3193 - RNA, 1249 nt, Artificial Sequence
  mRNA product Design2 comprising derived and/or modified sequence from Homo sapiens__NP_001997.5__HsFGF2 (opt6)
ggggcgcugccuacggagguggcagccaucuccuucucggcaucaagcuuaccaugguugggguaggaggaggagacguagaagauguaacaccaaggccaggaggaugucaaauaagcggaagaggagcaagaggauguaaugggauaccaggagcggcagcaugggaagcugcauuaccaagaagaagaccuaggagacauccaaguguuaauccaagaucuagagcagcggggaguccaagaacaagaggaagaagaacagaagaaagaccaagugggucaagauuaggagauagagguagggggagagcauuaccagguggaagauuaggagguagaggaagaggaagagcaccagaaagagugggaggaagaggaaggggaagaggaacagcagcaccaagagcagcaccagcugcaagaggaaguagaccagggccggcaggaacaauggcagcaggaaguauaacaacauuaccagcauuaccagaagacggaggaucaggagcauuuccaccaggacauuuuaaagacccaaaaagauuauauuguaaaaacggaggauuuuuucuaagaauacauccagauggaagagucgauggugugagggaaaaaagugauccgcauauaaaauuacaauuacaagcagaagaacgaggaguuguaaguauaaaaggaguaugugcaaauagauaucuagcaaugaaagaagauggaagauuauuagcaaguaaauguguaacagacgaauguuuuuuuuuugaaagauuagaaagcaauaauuauaauacuuauagaaguagaaaauauacaagcugguauguagcuuuaaaaagaacaggacaauauaaacuaggaaguaaaacaggaccaggacaaaaagcaauacuauuucuaccaaugagcgcaaagucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3194 - RNA, 967 nt, Artificial Sequence
  mRNA product Design2 comprising derived and/or modified sequence from Homo sapiens__NP_002000.1__HsFGF7 (opt6)
ggggcgcugccuacggagguggcagccaucuccuucucggcaucaagcuuaccaugcacaaauggauacuaacauggauacuaccaacacuacuauacagaagcugcuuccacauaauaugccuaguaggaacaauaagccuagcaugcaacgacaugacaccagaacaaauggcaacaaacguaaacugcucaucaccagaacgacacacaagaucauacgacuacauggaaggaggagacauacgaguaagaagacuauucugcagaacacaaugguaccuaagaauagacaaaagaggaaaaguaaaaggcacucaagaaaugaaaaacaacuacaacauaauggaaauaagaacaguagcagucggaaucguagcaauaaaaggaguagaaucagaauucuauuuagcaaugaacaaagaaggaaaacuauacgcaaaaaaagaaugcaacgaagacugcaacuucaaagaauuaauacuagaaaaccacuacaacacauacgcaucagccaaauggacacacaacggaggagaaauguucguagcacuaaaccaaaaaggaauaccaguaagaggaaaaaaaacaaaaaaagaacaaaaaacagcacacuuccuaccaauggcaauaacauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3195 - RNA, 1009 nt, Artificial Sequence
  mRNA product Design2 comprising derived and/or modified sequence from Homo sapiens__NP_001936.1__HsHBEGF (opt6)
ggggcgcugccuacggagguggcagccaucuccuucucggcaucaagcuuaccaugaaacuacuaccaucaguaguacuaaaacuauuuuuagcagcaguacuaucagcacuaguaacuggagaaucacuagaaagauuaagaagaggacuagcagcaggaaccucaaauccagacccaccaacaguaagcacagaccaauuauuaccacuaggaggaggaagagacagaaaaguaagagaccuacaagaagcagaccuagaccuauuaagaguaacacuaucaucaaaaccacaagcacuagcaacaccaaacaaagaagaacacggaaaaagaaaaaaaaaaggaaaaggacuaggaaaaaaaagagacccaugccuaagaaaauauaaagacuucugcauacacggagaaugcaaauacgucaaagaacuaagagcaccaagcugcauaugccaccccggauaccauggagaaagaugccacggacuaucacuaccaguagaaaaccgacuauacacauacgaucacacaacaauauuagcaguaguagcaguaguauuaucaucaguaugcuuacuaguaauaguaggacuauuaauguucagauaccacagacgaggaggauacgauguagaaaaugaagaaaaaguaaaacuaggaaugacaaauucacauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3196 - RNA, 2569 nt, Artificial Sequence
  mRNA product Design2 comprising derived and/or modified sequence from Homo sapiens__NP_000592.3__HsHGF (opt6)
ggggcgcugccuacggagguggcagccaucuccuucucggcaucaagcuuaccauguggguaacuaaacuuuuaccagcguuauuacuccaacacguauuacuacaccuccuauuauuaccaauagcuauaccauaugcagaaggacaaagaaaacgcagaaacaccauacaugaauuuaaaaaaucggccaaaacaacucuaaucaaaauagauccagcauuaaaaauaaaaacaaaaaaaguuaacacagccgaucaaugugcaaaccgcugcacacguaauaaaggccuaccauucacaugcaaagcauuuguauuugauaaagcacguaagcaaugucuaugguuuccauuuaauagcaugagcucuggcguaaaaaaagaauuuggacaugaauuugaccuauacgaaaauaaagacuauauuagaaacuguauuauaggaaaaggaagaucauauaagggcacaguauccauaacaaaaucaggaauuaaaugucaaccauggucauccaugauaccccacgaacauucauuuuuaccaucaaguuauagaggaaaagauuuacaagaaaacuauugccgaaacccaagaggagaagaaggcggaccuugguguuuuacaucaaacccagaagucagauaugaaguuugugauauaccccaauguucagaaguagaauguaugacauguaauggagaaucauauagaggucuaauggaucacacagaaagugguaagauaugccaaagaugggaucaucagacaccacaccgacauaaauuuuuacccgaaagauacccugauaaaggauuugaugauaauuacugucgaaacccugaugggcagccaagaccaugguguuauacuuuagacccccacacaagaugggaauauugcgcuauaaaaacaugcgcggauaauacaaugaaugauacagauguacccuuagaaacuacugaauguauacaaggacaaggugaggguuaucgcggcacugucaauacuauauggaauggcauccccugucaaagaugggauucacaauauccccaugaacaugauaugacaccagaaaacuuuaaauguaaagauuuacgagaaaauuauugccguaauccagaugguucagaaucucccuggugcuuuacaaccgauccaaauaucagagucggguacuguucacagauaccaaauugcgacaugucucauggucaagauuguuauaggggaaacggaaaaaauuauaugggaaacuuaucucaaacuagaucagguuuaacuuguaguaugugggauaaaaauauggaagauuuacacagacauauauucugggaaccugaugcaagcaaacuaaacgaaaacuacuguaggaauccagacgaugaugcacauggcccuuggugcuauacaggaaauccauuaaucccgugggauuauugucccauaucgcgaugugaaggcgacacaacgccaacuauaguaaaccuagaucauccagugauaucaugugcaaaaacuaaacaauuaagagucguaaauggaauaccaacaagaacaaacauuggauggaugguaucacuccgauacagaaauaaacauauauguggaggaucauuaauaaaagaaagcuggguuuuaaccgcaagacaauguuuuccaucucgagaccuuaaagacuaugaagcaugguuaggaauacacgacguacaugguagaggagacgaaaaauguaaacaaguacuaaauguuucccaacuuguauaugguccagaagguucagauuuaguauuaaugaaauuagcgagacccgcaguuuuagaugauuucguaagcaccauagaccuaccgaauuauggauguacuauaccagaaaaaacaaguuguaguguauacggauggggauauacaggccuaauaaauuaugacggauuacuaagagucgcacacuuauauauaaugggaaacgaaaaauguucacaacaucacagagguaaaguaacauuaaaugaaagugaaauaugugcaggagcugaaaaaauaggcucaggaccgugugaaggagauuauggaggcccacuaguaugugaacagcacaaaaugagaaugguacuaggaguaauaguaccaggccgaggaugugcaaucccaaacagaccaggaaucuuuguuagagucgcuuacuaugcuaaauggauacauaaaauaauacuaacauauaaaguaccacaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3197 - RNA, 2308 nt, Artificial Sequence
  mRNA product Design2 comprising derived and/or modified sequence from Homo sapiens__NP_005336.3 __HsHSPA1A (opt6)
ggggcgcugccuacggagguggcagccaucuccuucucggcaucaagcuuaccauggcaaaagcagcagcaauuggaauagauuuggguacaacauacaguugcgugggcguguuucaacacggaaaaguagaaauaauagcaaacgaucaaggaaacaggacaacaccaucauacguggcauuuacagacacagaacgauuaauaggggacgcugcuaaaaaccaaguagcauuaaacccccaaaacacaguguucgaugcgaaaaggcuuauaggucggaaauuuggggaucccguaguccaaagcgauaugaaacauuggccauuccaagucauuaaugauggagauaaaccaaaagugcaaguaaguuacaagggugaaacaaaagcauuuuacccggaagaaauaucaaguaugguacuaacuaaaaugaaggaaauagcugaagcauaccuaggauacccaguaacaaaugcgguaauaacagugccagccuacuuuaacgauucgcaacgacaagcaacgaaagacgcaggggucauagccggucuaaaugucuuaagaauaauaaaugaaccaacagcagcagcgauagcuuacggacuagauagaacaggaaaaggugaaagaaacguacuaauauuugauuugggaggaggaacauuugacguaucgauauuaaccauagaugacggcauauuugaaguaaaggcaacggcaggagacacacaucugggaggagaagacuuugauaaucggcuaguaaaucacuuugucgaagaauuuaaaagaaaacacaagaaagauauaagucaaaacaaaagagcaguaagaagacuuagaaccgccugcgaaagagcaaaaagaacacuaagcucaucaacacaagcaaguuuggaaauagauucauuauuugaagguauagacuucuauacuucaauuacaagagccagauucgaagaacuauguagugauuuauuuagaaguacguuagaaccgguagaaaaagcguuaagagaugcuaaacuagauaaagcucaaauccaugaucuaguauuaguaggaggaaguacaagaauaccaaaagugcaaaaauuacuucaagauuucuuuaacggaagagaucuaaauaaaucgauaaauccagaugaagcgguagcguacggagcagcaguacaagcagcaauauugaugggagauaaaagugaaaacguucaagauuuauuauuacuagauguagccccauuaaguuuaggacucgagacagcugguggaguuaugacagcgcuaauaaaaaggaacucaacaauaccaacaaaacaaacacaaauauuuacaacauauagugauaaucaaccaggaguacuaauacaaguauaugaaggagaaagagcgaugacaaaagacaauaauuuacuuggaagauucgaacuuaguggaauaccaccagcaccacgaggaguaccacaaauagaaguaacguuugauauugacgcaaacggaauacuaaauguaaccgcuacagauaaaagcacaggaaaagcaaacaaaauaacuauaacaaaugauaaagguagauuaaguaaagaagaaauagaacguaugguacaagaagcagaaaaauacaaagcagaagacgaaguacaaagagaaagggucagcgcgaaaaaugcacuagaaaguuacgcauucaauaugaaaagugcaguagaagaugaaggacucaaaggaaaaauaagugaagcagauaaaaagaaagucuuagauaaaugucaagaagugauaagcuggcuagaugcaaauacauuagcugaaaaagacgaauuugaacauaaaagaaaagaacuagagcaaguaugcaacccaauaauaaguggcuuguaccaaggggcaggaggaccggggccaggaggcuuuggagcucaaggaccuaaaggaggaagcgguagcggaccaacaauagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3198 - RNA, 2308 nt, Artificial Sequence
  mRNA product Design2 comprising derived and/or modified sequence from Homo sapiens__NP_005337.2 __HsHSPA1B (opt6)
ggggcgcugccuacggagguggcagccaucuccuucucggcaucaagcuuaccauggcaaaagcagcagcgauaggaauagauuuagggacaacuuauaguuguguaggaguauuccaacauggaaaaguagaaauaauagcuaaugaccaaggaaauagaacaacuccuaguuauguagcauuuacagacacagaaagacuaauaggagacgccgcuaaaaaucaaguagcccucaauccacagaauacaguauucgacgcaaaaagacuuauagguaggaaauucggagauccagugguacaaagcgauaugaaacauuggccauuucaaguaauaaaugacggagauaaaccaaaaguacaaguaucauacaaaggagaaacaaaagcauuuuauccugaagaaaucucaaguaugguacuaacaaagaugaaggaaauugcagaagcauaucuuggauacccaguaacgaacgcaguaauaacaguaccugccuacuuuaacgacagccaacgucaagcaacuaaagacgcaggaguaauagcuggucuaaacguacuuagaauuaucaaugaaccaacugcagccgcaaucgcauacggacuagaccgaacgggaaaaggagaaaggaauguauuaauuuucgaccuaggaggaggaacauucgaugucucuauauuaacuauagacgauggaauuuuugaaguaaaagcaacggcaggagacacgcauuuaggaggagaagauuucgauaaccgucuaguaaaucauuucguugaagaauuuaaaagaaaacauaaaaaggacauuucgcaaaauaaaagagcagugagaagauuaagaaccgccugugaaagagcaaaaagaacauuaagcagcaguacgcaagcaagccuugaaauagauucacuauuugaaggaauagauuucuacacaucaauaacaagagcucgauuugaagaauuauguagcgacuuguucagaucaacauuagagccaguagaaaaagcacuaagagacgcaaaauuagacaaagcacaaauacaugaccuaguauuaguuggaggcaguacacgaauaccaaaaguacaaaaacuucuacaagacuucuuuaauggaagagaucuaaauaaaucaauaaauccagaugaagcaguagccuacggugcggcgguucaagcagcaauacugaugggggacaaaucagaaaauguacaagauuuauuauuauuagauguggcaccacuaucauuaggauuagaaacagcuggagguguaaugacagcacuaauuaaacgaaacagcaccauaccaacgaaacaaacacaaauauuuaccacguacucggacaaucaaccgggaguauugauacaaguauacgaaggagaaagagcaaugacuaaagacaacaaucuauuaggaagauucgaauuaucaggaauaccgccagcaccaagaggaguaccacaaauagaaguaacauucgauauagacgcaaauggcauuuuaaacguaacagcaacagacaaaucaacagguaaagcaaacaaaauaacaauaacaaaugauaaaggaagacuaucuaaagaagaaauagaaagaaugguacaagaagccgaaaaauacaaagcagaagaugaaguucaaagagaacgugugagugccaagaaugcacuugaaucguaugcguucaauaugaaaagcgcaguagaagaugagggccuaaaaggaaaaauaucagaagcagacaaaaagaaagucuuggauaagugucaagaaguaauaaguugguuagaugcaaacacacucgcagaaaaagaugaauuugaacauaaaagaaaagaacuagaacaaguaugcaauccaauaauaucaggguuauaccaaggagcaggcggaccaggacccgggggauucggugcccagggaccaaaaggcgguaguggcagcggaccaaccauugaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3199 - RNA, 2308 nt, Artificial Sequence
  mRNA product Design2 comprising derived and/or modified sequence from Homo sapiens__NP_005518.3 __HsHSPA1L (opt6)
ggggcgcugccuacggagguggcagccaucuccuucucggcaucaagcuuaccauggcuacagcaaaaggaauagcaauaggaauagauuuaggaacaacauauucguguguuggaguauuccaacacggaaaaguagaaaucauagcaaaugaccaaggaaacagaacaacaccaagcuauguagcauuuacggauacagaaagauuaauaggagacgcagccaaaaaccaaguagcuaugaauccacaaaauacaguauucgaugcaaaaagacuaauaggaagaaaauuuaaugacccaguaguacaagcagauaugaagcuauggcccuuccaaguuauaaaugaaggagggaaaccaaaaguucuaguaaguuauaaaggugaaaauaaagccuucuauccagaagaaauaucaagcaugguccuaacaaaacuaaaagaaaccgcagaagcauucuuaggacauccugucacuaacgcaguaauaacaguaccagcauacuucaacgauagucaacgucaagcaacaaaagaugcuggaguuauagcaggacuaaauguacuacgaauaaucaacgaaccgacagcagcagcuauagcauauggacucgacaaaggcggacaaggagaaagacacgugcucaucuucgacuuaggcgguggcacauuugauguauccauacuaaccauugacgauggaauuuucgaaguaaaagccacagccggagacacccaucuagggggagaagauuucgauaaccgguuaguaagucacuucguagaagaauuuaaaagaaaacacaagaaagauauaagucaaaauaaacgagcaguaagaagauuaagaacagcaugugaaagagccaaaagaacacuuaguaguucaacacaagcaaacuuagaaauagauucauuauacgaaggaauagauuucuauaccaguauaacaagagcaagauuugaagaacuaugcgcugauuuauuucgcggaacauuagaacccgucgaaaaagcauuaagagaugcaaaaauggauaaagcaaaaauacacgacauaguauuagugggagguagcacgcgaauaccaaagguucaacgauuauuacaagacuauuuuaauggcagagaccucaauaaaaguauaaacccugaugaagcaguugcauacggagcugcaguacaagcagcuauacugaugggagacaaaucagaaaaaguacaagaucuccuacuacuagacguagcuccacuaucacugggucuugagacagcgggaggcguaaugacagcauuaauuaaaaggaacucgaccauacccacaaaacaaacacaaauauuuaccacauauucagauaaccaaccuggagugcuuauucaaguauacgaaggagaaagagcaaugacgaaagauaauaacuugcuaggaagauuugaucuaacagggauuccaccagcaccaagaggcgugccacaaauagaagucaccuucgacauagacgcaaacggaauauuaaacgucacagcaaccgauaaaucaacagguaaggucaauaaaauuacaauaacaaacgauaaaggaagacuaucaaaagaagaaauagaaagaaugguacuagaugcagaaaaauacaaagcagaagacgaaguacaaagagagaaaauagcagcuaaaaacgcgcuagaaaguuacgcauuuaacaugaaaaguguaguaucugaugaaggauuaaaaggcaaaauuucagaaagcgauaaaaauaaaauacuagacaaaugcaaugaacuacuuaguugguuagaaguaaaucaacuagccgaaaaggaugaauuugaccauaaaagaaaagaacuggaacaaauguguaaucccaucauaacaaaacuauaucaaggaggcugcacaggaccagcauguggaaccggauauguaccaggacguccagcaacaggaccaacaauagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3200 - RNA, 2302 nt, Artificial Sequence
  mRNA product Design2 comprising derived and/or modified sequence from Homo sapiens__NP_068814.2 __HsHSPA2 (opt6)
ggggcgcugccuacggagguggcagccaucuccuucucggcaucaagcuuaccaugucagcaagaggaccagcaauugggauagaucuaggcacaacuuacucaugcguagguguauuccaacacggaaaaguagaaauuauagcaaacgaucaagggaacagaacaacaccaaguuauguagcauuuacagacacugaaagauuaauaggugacgcagcuaaaaaucaaguagcaaugaacccuacaaacacaauuuuugacgcaaaacgacuaaucggaagaaaauucgaagacgcaacaguacaaucagauaugaaacauuggccguucagaguaguaagcgaaggagggaaaccaaaaguacagguugaauacaaaggagaaacaaaaacuuucuucccagaagaaauuaguaguaugguccucacaaaaaugaaagaaauagcagaagcauaccuuggaggaaaaguucacucagcaguaauuacaguaccagcauacuucaacgauucccaaagacaagcaacgaaagacgccgguacaauaacaggauuaaacguguuaagaauuauaaacgaaccuaccgcagcagccauagcguauggauuagauaagaaaggaugugcaggaggagagaaaaauguauuaauauuugacuuaggcggugggacauuugauguaaguauacugacaauagaagaugggauauuugaagucaaaucgacagcaggagacacacauuuagggggagaagacuuugacaacagaaugguaagccaucuagcagaagaguucaaaagaaaacacaagaaagacauaggacccaauaaaagagcugucaggagacuuagaacagcaugcgaaagagcaaaaagaacauuaucaaguucaacacaagcaaguauagaaauagauucgcuauaugaaggaguugauuucuauacaaguauaacaagagcaagauuugaagaacuaaacgccgaucuauuuagaggaacauuagaaccgguugaaaaagcacuuagagacgcaaaauuggauaaaggccaaauacaagaaauuguucuaguaggaggaaguacacgcauuccaaaaauacaaaaacuauuacaagacuuuuucaauggaaaagaacucaauaaaucaauaaacccugaugaagcgguagcguauggugcagccguacaagccgcaauauuaaucggagacaaaagugaaaacguacaagaccuacuauuguuagauguaacaccauuaucacucggaauugaaacagcuggaggaguaaugacaccacucauaaaaagaaauacaaccauucccacaaaacaaacacaaacauucacaacguacagcgauaaccaaaguagcguccuaguacaaguauaugaaggcgaaagagcaaugaccaaagacaacaaucuauuaggaaaauucgacuuaacaggaauaccuccagcaccaaggggaguaccacaaauagaaguuacauuugacauagaugcuaacggaauauuaaacguaacagcagcagauaaaagcacaggaaaagagaauaaaauaacaauuacaaacgauaaaggaagacuaagcaaagacgauauagauagaaugguacaagaagcagaaagauauaaaagcgaagacgaagcuaacagggaucgagucgcagccaaaaaugcauuggaaagcuauacauacaauauaaaacaaacuguagaagaugaaaaauuaagaggaaagauaagugaacaagauaaaaauaaaauuuuagacaaaugucaagaaguuauaaacugguuagauagaaaccaaauggccgaaaaagacgaguacgaacauaaacaaaaagaacuagaaagagucuguaaucccauaauuagcaaauuauaccaaggaggacccggagguggaaguggaggaggaggaucaggagcaagcggaggcccaacaauagaagagguugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3201 - RNA, 2905 nt, Artificial Sequence
  mRNA product Design2 comprising derived and/or modified sequence from Homo sapiens__NP_002145.3 __HsHSPA4 (opt6)
ggggcgcugccuacggagguggcagccaucuccuucucggcaucaagcuuaccaugagcgugguagguauagaucuuggauuccaaucauguuacguugccguagcaagagcaggaggaauagaaacaauagccaacgaauacagugacagauguacaccggccugcauauccuuuggaccuaaaaacagaucaaucggcgcagccgcaaaaucacaagugauuucaaaugcuaaaaacacagugcaagguuucaaaagauuccacggacgagcauuuagcgacccauuuguugaagcagaaaaaucaaacuuagcuuaugauaucguacaauuacccacaggacuaacagguauaaaagucacauauauggaagaggaaagaaacuucacaaccgaacaaguaaccgcgaugcuauuaucaaaacucaaagaaacagcagaauccgucuuaaagaaaccugucguugacuguguaguaucaguacccugcuucuacacagacgcagaaagaagauccguaauggaugccacacaaauagcuggucugaauugcuuacgacuaaugaaugaaacgacggcaguugcauuagcuuacggaauauauaaacaagacuuacccgcacuagaagaaaaaccaagaaacgucguauuuguagauaugggucacagugcauaucaaguguccguaugugcuuuuaacagagguaaacuaaaaguauuagcaacagcuuuugauacuacuuuaggcggacgaaaauuugaugaaguucuaguaaaucauuuuugcgaagaauuugguaagaaauacaaacucgauaucaaaucaaaaauacgugcauuauuacgacuuucacaagaaugugaaaaacuaaagaaauuaaugagugcaaacgcaagcgaccugccuuuaucuauagaauguuucaugaacgauguagauguaucgggcacaaugaacagagguaaauuccucgaaaugugcaacgaucuguuagcaagaguagaaccaccacuacgaaguguauuagaacaaacaaaacuaaagaaagaagacauuuaugcaguagaaauaguuggaggggcaacacgaauaccagcgguaaaagagaaaauuucaaaauucuuuggcaaagaauuaucaacuacacuuaaugcagaugaagccguaacuagaggaugugcacuccaaugugcaauauuaucaccagcuuucaaaguaagagaauuuagcauaacagauguaguaccauacccaauuucacugagauggaacucaccagcagaagaagggucauccgacugcgaaguauucaguaaaaaucaugcugccccuuuuucaaaaguacuaacauucuauagaaaagaaccuuuuacccuagaagcauacuauucaucaccccaagaucuuccauaccccgauccagcaauagcccaauuuagcgugcaaaaaguuacaccucaaagugauggaucaagcaguaaaguuaaaguaaaaguccgugugaacguucaugguauauuuaguguaucuucagccagccuaguagaaguacacaaaagcgaagaaaaugaagaaccaauggaaacggaucaaaaugcuaaagaagaagagaaaaugcaaguagaccaagaagaaccacauguagaggaacaacaacaacaaacacccgcagaaaacaaagccgaaagugaagaaauggaaacaucucaagcaggaucaaaggauaagaaaauggaucaaccuccucaagcgaagaaagcaaaaguaaaaacaucuacagucgaucuuccaauagaaaaccaacuuuuauggcaaaucgauagagaaauguuaaaccuauauauagaaaacgaaggaaaaaugauaaugcaagacaaauuagaaaaagaaagaaacgacgcuaaaaacgcaguagaagaauauguuuaugaaaugagagauaaacugagcggagaauacgaaaaauucguaagcgaagacgaucgaaauucauucacccuaaaacuugaagacacugaaaacuggcucuacgaagauggagaagaccaaccaaaacaaguauacguagauaaacuagcagaacugaaaaaccuaggacaaccaauaaaaauaagauuccaagaaagugaagaacguccuaaauuauucgaagaacuaggaaaacaaauacaacaauauaugaaaaucauaucaaguuuuaaaaacaaagaagaucaauacgaccacuuagaugccgcagacaugacaaaaguagaaaaaucuacuaacgaagccauggaauggaugaauaauaaauuaaaccuccagaacaaacaaucgcuaacaauggauccaguggucaaaucaaaagaaauagaagcaaaaauuaaagaacuaacaaguacuugcucaccaaucauaagcaaaccaaaacccaaagucgaaccaccaaaagaagaacagaaaaacgcagaacaaaauggaccaguagacggccaaggugacaacccaggaccacaagcagcggaacaagguacugacacagcaguacccucagacagugauaagaaacuaccagaaauggauauagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3202 - RNA, 2902 nt, Artificial Sequence
  mRNA product Design2 comprising derived and/or modified sequence from Homo sapiens__NP_055093.2 __HsHSPA4L (opt6)
ggggcgcugccuacggagguggcagccaucuccuucucggcaucaagcuuaccaugucaguagucggaauugaccuuggauuuuuaaacugcuacauagcaguagcuaggucaggaggaaucgaaacaauagcaaacgaauauagcgauagaugcaccccugccugcauaucauuaggaucacgcacuagagcaaucgggaacgcagccaaaucacaaauaguuacaaacguaagaaauacaauccacggauucaaaaaacuacacggcagguccuuugaugauccaauaguacaaacggaaagaauaagacuacccuacgaacugcaaaaaaugcccaauggaagugcaggcgucaaagucagauaucuagaagaagaaagaccuuuugcaauagaacaaguaaccggaauguuauuggcuaagcuaaaagaaacuucagaaaacgcauuaaagaaaccuguagcagauuguguuauaucaauaccaucguuuuucacagaugcagaacgaagaucaguaauggcagcagcacaaguagccggccuaaacugucuucgacuaaugaaugaaacaacugcaguugcccuagcuuauggaauuuauaaacaagauuuaccuccucuagacgaaaaacccaggaacguaguauucauagauaugggucauagugcauaucaaguucuagugugugcauuuaauaaaggaaaauuaaaaguccuagcaacaacauucgauccguaucuaggagggcgaaacuucgaugaggcacugguagacuacuuuugugacgaauucaaaacgaaauacaagauuaacguaaaagaaaacagcagagcucuucuaaggcuauaccaagaaugugaaaaacucaaaaaauuaauguccgcuaaugccucagaccuaccacuaaauauagaauguuucaugaaugauuuagaugugucaaguaaaaugaacagagcacaauuugaacaauuaugcgcaucauuacuagcucgaguagaaccaccauuaaaagccguaauggaacaagcuaauuuacaacgagaagauaucucaucaauagaaaucguuggaggagccaccagaauuccagcgguaaaagaacaaauuacuaaauuuuuucuuaaagacaucucaacaacacuaaaugcugacgaagcaguugcccggggaugcgcccuccaaugugcaauacuuagcccugcauuuaaaguacgagaauuuucaauaacagacuuaguuccauauucgaucacauuaagauggaaaacaucauucgaagacggcagcggcgaaugugaaguauucugcaaaaaccacccagccccuuuuagcaaaguaauaacauuucauaaaaaagaaccguuugaauuagaagcauuuuacacaaacuuacacgaaguaccauacccugaugcacgaauagguagcuuuacuauacaaaacguauucccacaauccgauggcgacagcucaaaaguuaaaguaaaagucagaguaaacauacauggaauuuucucugucgcaucagcaucuguuaucgaaaaacaaaaucuagaaggggaccauuccgacgccccaauggaaaccgaaacaagcuuuaaaaaugaaaacaaagacaauauggauaaaaugcaaguagaucaagaagaaggacaucaaaaaugccaugcugagcauacaccagaagaagagauagaccacacuggggcaaaaacaaaaucagccguuucagauaaacaagauagauuaaaucaaacacuaaaaaaaggcaagguaaaaucuauugauuuaccaauccaauccucacucugcagacaauuaggacaagaucuauuaaauagcuauauagaaaaugaaggaaaaaugaucaugcaagacaaacuagaaaaagaaagaaacgacgccaaaaaugcaguugaagaauacguauaugauuucagggaccgacuaggaaccguuuaugaaaaauuuauaacgccagaagaccuuucaaaacuaagugcaguauuagaagacacagagaacugguuauaugaagauggagaagaccaaccaaaacaaguauacguugacaaauuacaagaacuaaagaaauacggacaaccaauacaaaugaaauacauggagcacgaagaacguccaaaagcacuaaacgaccuaggcaaaaagauccaacuuguaaugaaaguaauagaagcuuauagaaauaaagaugaacgguaugaccaucuugaccccacagaaauggaaaaaguugaaaaaugcauaagcgacgcaaugagcuggcucaacagcaaaaugaacgcacaaaacaaauuaucacuaacacaagauccaguaguaaaagucagugaaauaguagcaaaaucaaaagaacuagacaauuucuguaauccaauaauauacaaacccaaaccaaaagccgaaguccccgaagacaaaccaaaagcaaacucagaacauaaugguccaauggauggacaaucuggaacagagacaaaaucagacucaacuaaagauucaucccaacauaccaagaguagcggggaaauggaagucgacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3203 - RNA, 2347 nt, Artificial Sequence
  mRNA product Design2 comprising derived and/or modified sequence from Homo sapiens__NP_005338.1__HsHSPA5 (opt6)
ggggcgcugccuacggagguggcagccaucuccuucucggcaucaagcuuaccaugaaauuaaguuugguggcagcaaugcuauuauuauuaagcgcugcaagagcagaagaagaggauaaaaaagaagauguugguacggugguuggaauugaccuuggaacaacauacagcugugucggaguauuuaaaaauggaagaguugaaauuauagcuaacgaucaggggaauagaauaacaccaaguuacguagcauucacaccagagggagaaagauuaaucggagacgcagcaaaaaaccaacuuacuaguaauccagaaaauacaguauucgaugcaaaaagauuaauaggaagaacauggaacgacccuuccguacaacaagauaucaaauuccuaccauuuaaaguuguagaaaaaaagacaaaaccauacauacaagucgauauaggaggaggacaaacaaaaacauuugcgccagaggaaaucagugcaaugguauuaacuaaaaugaaagagacagcagaagcauacuuagguaaaaaaguaacacacgcaguagucacaguaccagcauauuuuaacgacgcacaaagacaagcaacaaaggaugcaggaacaaucgcaggauuaaacguaaugagaauaauaaaugagccaacagcagcagcaauugcauauggauuagacaaacgagaaggugagaaaaacauccugguauucgacuuaggagggggcacauuugacguaaguuuauuaacuauagauaauggaguauuugaaguaguagcaacaaacggugacacacauuuaggaggagaagauuucgaucagagaguaauggaacauuuuauaaaauuauacaaaaaaaaaacaggaaaagauguaaggaaagacaauagagcagugcaaaaacuuaggagagaagucgaaaaagcaaaacgagcccuaaguagccaacaucaagcaagaauagaaauagaaagcuuuuaugaaggggaagacuucagugaaacacuuacgagagcaaaauuugaagaauuaaacauggaccuauuuagaagcacaaugaaaccuguacaaaaagugcucgaagauucagaccuaaaaaaaagcgacauagaugagauugucuuaguaggaggaaguacaagaauuccaaaaauccaacaacuaguaaaagaauuuuucaauggaaaagaaccuaguagaggaauaaacccagacgaagcaguagcauauggagcugcaguacaagcuggaguucuaaguggcgaccaagacacaggagacuuaguauuacuagacguauguccguuaacauuaggaauagaaacaguaggaggaguaaugaccaaauugauaccuaggaacacuguuguaccaacgaaaaaaucacaaauauuuaguacagcaucagauaaccaaccaacuguaacuauaaaaguauacgaaggagaaaggccucuaacaaaagacaaucaccuucugggaaccuuugaucucacaggaauaccaccagcaccacggggaguaccgcaaauagaaguaacauucgaaauagacgucaacgguauucuaagaguaacggccgaagauaaaggaacaggaaacaagaauaagauaacuauuacaaaugaccaaaaucgauuaacuccagaagaaauagaacgaauggucaacgacgcagaaaaauuugccgaagaagauaaaaaauuaaaagagagaauagauacucgaaacgaacuagaaaguuacgccuacucacucaaaaaccaaaucggggauaaagaaaaguuaggagguaaauuaucaagugaagauaaagaaacaauggaaaaagcagucgaagaaaaaauugaauggcuagaaucacaccaagacgcagauauagaagauuucaaagcaaaaaaaaaagaauuagaagaaauuguacaacccauaauuaguaaauuauauggaagugcagggccaccaccaacaggcgaagaagacacagcagaaaaagaugaauuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3204 - RNA, 2314 nt, Artificial Sequence
  mRNA product Design2 comprising derived and/or modified sequence from Homo sapiens__NP_002146.2__HsHSPA6 (opt6)
ggggcgcugccuacggagguggcagccaucuccuucucggcaucaagcuuaccaugcaagcaccaagagaacuagcgguaggaauagauuuaggaacaacuuacucauguguaggaguauuucaacaaggaagaguagaaauauuagcaaaugaccaaggaaauagaacaacacccucauacguagccuuuacagacaccgaacgauuaguaggagaugcagcaaaaagccaagcagcacucaacccacauaauacggucuuugacgcaaaaagauuaauaggccgaaaauuugcggauacuacaguacaaagugauaugaaacacuggcccuuucgaguaguaucugaaggaggaaaaccgaagguaagaguauguuaucgaggagaagacaaaacauucuauccagaagaaauaucuucuaugguauugucgaaaaugaaagaaacggcugaagcguaucuaggacaaccaguaaaacaugcaguaauaacuguaccagcuuacuuuaaugauagccagagacaagcaacaaaagaugcaggagccauagcaggauuaaauguauugaggauaauaaaugaaccaacugcagccgcaauagcauacggguuagaccgaagaggagccggugaaagaaaugucuuaauauuugauuugggcggaggaacauuugauguaaguguauuaucaauagacgcaggaguuuuugaagucaaagcaacggcaggagacacacauuuaggaggggaagacuuugauaauaggcuaguaaaucauuucauggaagaauuucgaagaaaacacggaaaagauuuaucuggaaauaaacgagcuuuaagaagguuaagaacagccugugaaagagcaaaaagaacauuaucaucaaguacacaagcaacauuagaaauugacucacucuucgaaggagucgacuucuauacaucaauaacacgagcaagauuugaagaacuaugcucagaucuauuucgaucaacauuagaaccaguggaaaaagcauugcgggaugcgaaauuagacaaagcacaaauacaugacguaguuuuaguaggcggcucaacaagaauaccaaaagugcaaaaacuauuacaagauuucuucaacgggaaagaauuaaacaaaucaauuaauccggaugaagcuguagcuuauggagcagcaguucaagccgccgucuuaaugggagacaaaugcgaaaaaguucaagauuuauuacuacuagauguggcaccacucucucuuggucucgaaacagcgggaggaguuaugacuacguuaauccaaagaaaugcaacaauuccaacaaaacaaacccagacauucacaacauacucugauaaucaaccaggagucuuuauacaaguuuacgaaggcgaacgagcaaugacaaaagauaauaauuuauugggaagauuugaacuuucaggaauacccccagcaccuagaggaguaccucaaauagaaguaaccuucgacauagacgcuaauggaauacuuagcguaacugcaacugauagaaguacaggaaaagcaaacaaaauaacaauaacaaacgauaaaggccgacuaagcaaagaagaaguagaaagaaugguacaugaagcugaacaauacaaagccgaagaugaagcacaacgagauagaguugcagcuaaaaauagucuagaggcacauguauuucauguaaaaggcagccuacaagaagagagcuuaagagacaaaauaccagaagaagacagaagaaaaaugcaagauaaguguagagaaguauuggcaugguuagaacauaaucaauuagcagaaaaagaagaauaugaacaucaaaaacgagaauuagaacaaauaugucgaccaauauuuucaagguuauauggaggcccaggaguaccagggggaaguucaugugguacacaagcaagacaaggugauccgucaacaggaccaaucaucgaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3205 - RNA, 1486 nt, Artificial Sequence
  mRNA product Design2 comprising derived and/or modified sequence from Homo sapiens__P48741__HsHSPA7 (opt6)
ggggcgcugccuacggagguggcagccaucuccuucucggcaucaagcuuaccaugcaagcaccaagagaauuagcuguaggaauagacuuaggaacaacauauuccuguguaggaguauuucaacaaggaagaguagaaauuuuagcaaaugaucaaggaaauagaacaacaccaucauauguagcauuuacugauaccgaaagauuagucggagaugcagcaaagucacaagcagcauuaaauccucacaauacaguuuuugaugcaaaaagauuaauaggaagaaaauucgcugauacaacaguacaaagcgacaugaaacauuggccauuccaaguuguaagcgaagguggaaaaccaaaaguacgaguauguuauagaggagaagacaaaacauucuaccccgaagaaauaucaaguaugguucuaucaaaaaugaaagaaacagcagaagcauauuuaggacaaccaguuaaacaugcaguaauaaccguuccaacauauuuuagcaauagucaaagacaagcaacuaaagaugcaggagcaauagcaggacuuaaaguacugccaauaauaaaugaagcaacagcagcagcaauagccuauggccuagacagaagaggagcuggaaaaagaaacguauuaauauuugauuuaggaggaggaacuuuugauguaaguguauuaaguauugacgcaggcguuuuugaaguaaaagcaacugcuggugauacucacuuggguggagaagauuuugauaauagauuaguaaaucauuuuauggaagaauuuagaagaaaacacggaaaagaucuaaguggaaauaaaagggcauugagaagauuaagaacagcaugugaaagagcaaaaagaacaccuagcucaaguacacaagcaacgcuagaaauagauucauuauucgaaggaguagauuuuuauaaaucaaucacaagggcaagauuugaagaauuaugcagugacuuauucaggagcacauuagaaccaguagaaaaagcauuaagagaugcaaaauuagauaaagcacaaauacaugauuuugugcuaggagggggauuacauucacauccacaaggagcagaaguugcagcaggauuauuacaaagacaaggagcagaacaagaacaccaaccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3206 - RNA, 2323 nt, Artificial Sequence
  mRNA product Design2 comprising derived and/or modified sequence from Homo sapiens__NP_006588.1 __HsHSPA8 (opt6)
ggggcgcugccuacggagguggcagccaucuccuucucggcaucaagcuuaccaugagcaaagggccagcaguaggaauagauuuagguaccaccuacagcuguguaggaguauuccaacacggaaaaguggaaauaauagcaaaugaccaaggcaauaggacaacaccaucauacguugcauucacagauaccgagcgacuaauuggagaugcagcuaaaaaucaaguagcaaugaauccaacaaauacgguauuugacgcaaaaagacuaauaggcaggagguuugaugacgcaguuguacaaagcgauaugaaacacuggccauuuaugguaguaaaugaugcuggaagaccaaaaguacaaguagaauacaaaggcgaaacuaaaaguuucuaccccgaagaaguaucuucaaugguauuaacaaaaaugaaagaaaucgcagaagcauacuuaggaaaaacgguuacaaacgcaguaguaacaguaccagcauauuuuaacgacucccaaaggcaagcaacaaaagacgcugggacaauugccgggcuuaauguauuaagaaucauaaaugaaccaacagcagcagcaauagccuacggauuagauaagaaaguaggugcagaaagaaacguauuaauauuugacuuaggcgguggaacauuugauguaucaauauuaacaauagaagacggaauauuugaaguaaaaucuacagcuggagacacacaccuaggaggagaagauuucgauaacagaaugguaaaucauuuuauagccgaauuuaaaaggaaacauaagaaagauauaagugaaaauaaaagagcaguaagaagauuaagaacagcaugcgagcgagcgaaaaggacuuuaucaucgagcacacaagcaagcauagaaauugauagccuauaugaagguauagacuuuuacacaucaauaacaagagcccgauucgaagaauuaaacgcagaucuauuuagaggaacguuagacccaguagaaaaagcauuaagagaugcaaaauuagauaaaagccaaauacaugacaucguauugguuggaggaucuacaagaauaccuaaaauacaaaaauuacuacaagacuucuuuaacggcaaagaauuaaacaaaucaauaaauccagacgaagcaguagcguauggugcggcgguacaagccgcuauauuauccggagacaaaagugaaaacguacaagaucuacuauuacuagacguaacaccccuaucauuaggaauugaaacagcaggaggaguaaugacaguuuuaauaaaaagaaauacaacaauaccaacuaaacaaacccaaacauuuacaacuuacagugacaaucaaccaggagugcucauacaaguuuacgaaggagaacgagcaaugacaaaagacaacaaucuauuaggaaaauuugaacuaaccggaauaccaccagcaccuagaggcgugccacaaauagaagucacauuugacauagaugcaaauggaauacuaaacgucagcgcagucgauaaaucaacaggaaaagaaaacaaaauaaccauaacaaacgacaaaggacgccugagcaaagaagauaucgaacgaaugguacaagaagcagaaaaauauaaagcggaggacgaaaaacaacgagacaaaguaagcaguaaaaacagcuuagaaucauaugcauuuaauaugaaagcaacuguagaagacgaaaaauuacaaggaaaaauaaacgaugaagauaaacagaaaauacuagacaaauguaacgagauaauaaauuggcuggacaaaaaucaaacggcagaaaaagaagaauuugaacaucaacaaaaagagcuugaaaaaguuuguaauccaauaauaacaaaacuauaucaaagugcaggaggaaugccaggaggaaugcccggaggauucccuggaggaggcgcacccccaaguggaggagccaguucaggcccaacaauagaagaaguagauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3207 - RNA, 2422 nt, Artificial Sequence
  mRNA product Design2 comprising derived and/or modified sequence from Homo sapiens__NP_004125.3 __HsHSPA9 (opt6)
ggggcgcugccuacggagguggcagccaucuccuucucggcaucaagcuuaccaugauaucagcaagcagagcagcagcagcaagacuugugggagcagcagcaucaagaggaccuacagcagcaaggcaucaagauucguggaauggguuaagccaugaggcguuuagacuugugucuaggagagauuacgccagcgaagcaauuaaaggugcgguuguaggaauagaucuaggaacgacaaacucauguguagcagucauggaaggaaaacaagcaaaagugcuagaaaaugcagaaggcgcaagaacaacaccaucaguaguugcauuuacagcagauggagaaagguuaguugguaugccagcaaaaagacaagcaguaacaaauccgaacaauacauuuuacgcuacaaaaagguuaauaggaagaagauacgaugacccagaagugcaaaaagauauuaaaaauguaccuuuuaaaauagucagagcaucuaauggugaugcauggguagaggcccacggaaaacucuacucuccaagucaaauaggagccuucguauuaaugaagaugaaagaaacagcugaaaauuauuuaggacacacagcgaaaaaugcaguaauaacgguaccagcauacuucaacgacagucaaagacaggcaacaaaagacgcaggacaaauaaguggauuaaacguauuaagaguaauaaaugaaccuacagcagcagcauuagcauauggccuagauaaaucagaagacaaaguaauagcgguauaugauuuaggcggaggaacauuugacauuucaauauuagagauacaaaaagguguauuugaaguuaaaaguacaaauggugacacauuuuugggaggagaagauuucgaucaagcacuacuucgacauauaguuaaagaguuuaaaagagaaacagggguagaucucacuaaagauaauauggcauugcaaaggguaagggaagcagcugaaaaagcaaagugcgagcuaagcucaucuguacaaacggauauuaaucuaccauauuuaacaauggacagcucagguccaaaacaucucaauaugaaauuaacaagagcucaauucgaaggaauaguaacggacuuaauaagaagaacuauagcaccaugucaaaaagcuaugcaggaugcggaagugagcaagagugacauaggagaaguuaucuugguagguggaaugacaagaaugccaaaaguucaacagacaguacaagaucuauucgggagagcuccuaguaaagcuguuaauccagacgaagccguagccauaggagcagcaauacaaggaggaguauuagcaggagauguaacugauguacuacuauuagauguaacaccguugagccuuggaauagaaacuuuaggaggaguguucacuaaauuaaucaauagaaauacaacgauaccuacgaagaaaucacaaguauucaguacagcagccgaugggcaaacacaaguagaaauaaaagucugccaaggagaaagagagauggcaggagauaauaaauuguuagggcaauuuacauuaauagguauaccuccagcaccgagaggaguaccucagauagaaguuacauucgauauagaugcaaaugguauaguucauguaucagcaaaagacaaaggaacuggaagagaacaacaaauagugauacaaagcaguggaggacuaaguaaagaugauauagaaaacaugguuaaaaacgcggaaaaauaugcagaagaagauagaagaaagaaagagagaguagaagcaguuaacauggcugaaggaauaauacaugacacugaaacaaaaauggaagaauuuaaagaucagcuaccagcagaugaauguaauaaacuaaaagaggaaauaaguaaaaugagagaauuguuagcuagaaaagacagugagacuggagaaaauauuagacaagcagcaagcucauuacaacaagcaagccucaaauuauuugagauggcauauaagaaaauggcaucagaaagggaaggauccggaucaagcggaacgggagaacaaaaagaagaucaaaaagaagaaaaacaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3208 - RNA, 2410 nt, Artificial Sequence
  mRNA product Design2 comprising derived and/or modified sequence from Homo sapiens__NP_079291.2__HsHSPA12A (opt6)
ggggcgcugccuacggagguggcagccaucuccuucucggcaucaagcuuaccauggcagacaaagaagcaggcggaagugaugggccaagagaaacagcaccaacaucagcauacaguucaccagcaagaagccuaggagacacaggaauaaccccauuaaguccaucgcacauuguaaacgacacagacuccaacguaagcgaacaacaaaguuuccuaguaguaguagcuguagauuuuggaaccacaucaucaggauacgcauacucauuuacaaaagaaccugaauguauacaugucaugagaagaugggaaggcggagauccuggaguaaguaaucaaaaaacuccaacaacaauacuucucacaccagaacgaaaauuccacucauuuggauaugcagccagagacuuuuaccacgauuuagauccaaaugaagcaaaacaaugguuauaccuagaaaaauucaaaaugaaacuucauaccacuggagauuuaacaauggacacagaccuaacagcagccaauggaaaaaaaguaaaagcacuagagauauuugcauacgcacuacaauacuuuaaagaacaagcacuaaaagaauuaagcgaccaagcagguuccgaauuugaaaauucagacguaagauggguaauaacaguccccgcaauauggaaacaacccgccaagcaauuuaugagacaggcagcauaccaagcgggacuagccuccccagaaaacucagaacaacuaauuauagcacuugaaccagaggcagcgucaauauauuguagaaaacuacgauuacaucaaaugauagaauuaaguucaaaagcagcaguaaauggauacucaggaucagauacagugggagcaggauuuacacaagcuaaagaacauauuagaagaaacagacaaagcagaacauuucuuguagaaaacgucauaggagaaauaugguccgaacuagaagaaggagauaaauauguaguaguugacagcggaggaggaacaguagaucuaacuguccaucaaaucagacuacccgaagggcacuuaaaggaacuauacaaagcaacgggaggcccauacggcucauuaggaguugacuacgaauucgaaaaauuauuauacaaaauauucggagaagauuuuauagaacaauuuaaaaucaaaaggccugcagcauggguagauuuaaugauagcauuugaaagcagaaaaagagccgcagcacccgauagaacaaacccacuaaauauaacacuaccguucucauuuauagauuacuauaaaaaauuuagaggacauucgguagaacaugcacuaagaaaaagcaacguugacuuugucaaauggagcagucaaggaauguuacggaugagcccagaugcaaugaaugcacuauucaaaccaacaauagauaguaucauagaacauuuaagagauuuauuucaaaaaccagaagucaguacaguaaaauuccuauucuuaguaggcggauucgcagaagcaccccuauuacaacaagccguacaagcagcauucggagaucaauguagaauaauaaucccacaagaugucggacucacaauacucaaaggagcaguucuauucggacucgacccagcaguaauuaaaguaagaagaucaccacuuaccuaugguguugguguauuaaauagauauguagaaggaaaacacccuccagaaaaauuauuaguaaaagauggaacaagauggugcacugacguauuugauaaauuuauuucggcagaccaaucaguagcucuaggugaacuuguaaaacgauccuauacaccugcaaaaccaucacaacuagucauaguaauaaauauauacuccucagaacacgauaaugucucauuuaucacugacccaggaguaaaaaaauguggcacauuaagauuagauuugacagguacaagugguacugcaguacccgcacgaagagaaauccagacauuaaugcaauuuggcgacacagaaaucaaagccacagcaauagacauagccacaucuaaaucaguaaaaguaggaauagacuucuuaaauuauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3209 - RNA, 2443 nt, Artificial Sequence
  mRNA product Design2 comprising derived and/or modified sequence from Homo sapiens__NP_443202.3 __HsHSPA12B (opt6)
ggggcgcugccuacggagguggcagccaucuccuucucggcaucaagcuuaccaugcuugcaguuccagaaaugggacuacaaggacuauauauaggcaguucaccagaacgaaguccgguacccaguccaccgggaucaccaaggacacaagaaaguugcggaauagcaccucuaacaccuagccaaucaccuaaaccugaagugagagcaccacaacaagcgaguuucucgguuguaguagcaauagauuucggaacaacaucaagugguuaugcauuuucauuugcuucagauccagaagcuauacauaugaugcgaaaaugggaaggaggcgauccuggcguagcacaucagaaaaccccuacuugucuauugcuaacaccagaaggagcauuucauaguuuuggauauaccgcucgagauuacuaucaugacuuagauccagaagaagcaagggauugguuauacuuugaaaaauuuaaaaugaaaauacauagugccacggaucuaacauuaaaaacacaauuagaagcaguaaauggaaaaacaaugccagcauuagaaguauuugcacacgcauugagauucuuucgcgaacaugccuuacaagaacuacgcgaacaauccccuuccuuaccagaaaaggauacuguacgauggguauuaacaguccccgcuauauggaaacaaccggcuaaacaauuuaugagagaagcagcauauuuggcuggccuagucagccgggaaaacgcugaacaauuacuaauagcauuagaaccagaagcugcaagcguauacuguagaaaacuaagacuucaucaauuacuagaucuaagcggaagggcaccuggaggagggcgauuaggagaaagaagaucuauagauucaucauuuagacaagcuagagaacaauuaagaagaucacgucacucaagaacauuucuaguugaaucagguguaggcgaacuuugggcagaaaugcaagcaggagacagauauguaguggcugacugcggaggggguacaguugaccuaacaguacaucaauuagaacaaccacacggaacacuaaaagaauuauauaaggcuucaggaggaccauacggggcaguaggaguugaucuagcuuuugaacaacuacuuugucgaauauucggugaagauuuuauagcaacauuuaaaaggcaaagaccugcugcauggguagaucuaacuauagcauucgaggcaagaaaacgaacagcaggaccacauagagcuggugcuuuaaacauuucauuaccauuuucauucauagauuuuuacagaaaacaaagaggacauaauguagaaacagcauuaagaagaaguucaguaaauuuuguaaaauggucuagucaaggaaugcuaagaaugucaugcgaagcuaugaacgaacuauuucaacccacaguauccgguauaauacaacauauagaagcacuauuagcuagaccugaaguacaaggaguaaaauuauuauuuuuaguaggaggauucgcagaaucagcuguguuacaacaugcugugcaagcagcguugggcgcuagaggucuaagaguaguaguuccucacgauguaggacuaacaauacuaaaaggagcaguauuauucggccaagcgccuggaguaguucgaguaagaagaucuccauuaacauauggugugggaguauuaaauagauucgugccagguagacauccaccagagaagcuauuaguaagagauggcaggaggugguguacugaugucuucgaaagguuuguugcagccgaacaaagcguugcacuaggagaagaaguuagaagaucauacuguccagcacggccaggacaaagaagagugcuaauuaacuuauauuguugcgcagcagaagaugcaagauuuauuacagacccagguguaagaaaguguggagcccucaguuuagaacuugaaccagcugauugcggccaagauacagcaggcgcacccccaggcagacgagaaauaagagcggcaaugcaauuuggagauacagaaauaaaaguuacagcuguagauguaagcacaaacagaaguguuagagcaucaauagacuuucuaaguaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3210 - RNA, 1798 nt, Artificial Sequence
  mRNA product Design2 comprising derived and/or modified sequence from Homo sapiens__NP_008879.3__HsHSPA13 (opt6)
ggggcgcugccuacggagguggcagccaucuccuucucggcaucaagcuuaccauggcuagagaaaugacaauacucggcucugcaguauuaaccuuacuauuagcaggauauuuagcacaacaauaccuucccuuaccaacaccaaaaguaauagguauagaucucgguacaacauauuguuccgucggaguuuucuuuccaggaaccggaaaaguuaaaguuauaccagacgaaaauggacacauauccauaccaaguaugguaaguuuuaccgacaacgauguauaugucgguuacgaaagcguagaauuagcagauaguaauccacaaaacacaauauaugacgcaaaaagauucauaggaaaaaucuucaccgcagaagaacuggaagcagaaauaggaagauauccauucaaaguacuaaauaaaaauggaaugguagaauucucaguaacuuccaaugaaacaauaacaguaucaccagaauaugucggcucaagauuauuauuaaaauuaaaagaaauggcagaagcauacuuaggaaugccaguagcaaacgcaguaaucucaguaccagccgaauucgauuuaaaacaaagaaauuccacuauagaagcagcaaaucuagcaggucuuaaaauauuaagaguaauaaaugaacccacagcagcagcaauggcauauggacuacacaaagcagauguuuuucacguacuagugauagauuuaggaggcggcacauuagacguaagucuacucaauaaacaaggcgguauguuucuaacaagagccaugaguggaaacaacaaauuaggaggacaagacuuuaaccaaagacuacuacaauauuuauacaaacaaauuuaccaaacauauggauucgucccaucaagaaaagaggaaauccacagacuaaggcaagcaguagagauggucaaacuaaacuuaacauuacaucaaucagcacaacuaucagucuuauuaacaguagaagagcaagauagaaaagaaccucacuccagugacacagaacucccuaaagauaaacuaucaucagcagaugaccaccgagucaacaguggauucggaagaggccuaagugacaaaaaaagcggagaaucacaaguauuauuugaaacugaaauuagcagaaaacuauuugauacauuaaaugaagaccuauuucaaaaaauacuaguaccaauacaacaaguacucaaagaaggacauuuagaaaaaacagaaauagacgaaguaguacuaguaggaggaagcacacgaauuccuagaauaagacaaguaauacaagaauuuuucggcaaagacccuaauacaucaguagacccagaucuagccgucguaacaggaguagcaauacaggcaggaauagauggaggaagcuggccacuucaagucagugccuuagaaaucccaaacaaacauuuacaaaaaaccaauuucaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3211 - RNA, 1912 nt, Artificial Sequence
  mRNA product Design2 comprising derived and/or modified sequence from Homo sapiens__NP_057383.2__HsHSPA14 (opt6)
ggggcgcugccuacggagguggcagccaucuccuucucggcaucaagcuuaccauggcagcaauaggaguacaccuaggauguacaucagcauguguagccguauauaaagaugguagagcaggaguuguggccaaugaugccggagauagaguaacuccugcaguaguugcauacagcgaaaaugaagagauaguuggacuagcugcaaaacaaagcagaauaagaaauauaaguaauacaguaaugaaagucaaacaaauauuaggaagaucaaguucagacccucaagcucaaaaauacauugcugaaagcaaaugucuaguaauagagaaaaauggaaaacuaagauaugaaauugauacgggugaagaaacuaaauucguaaacccagaagauguagcaagacuaauauuuaguaaaaugaaagaaacagcucauucaguauuaggaucagacgcaaaugacguaguaauaacuguaccauucgauuuuggagaaaaacaaaagaacgcuuuaggagaagcggcuagagcagcagguuuuaauguauuaagacuaauacaugaaccauccgcugcacuauuagcauacggaauaggacaagauaguccaacagguaaaucaaauauccuaguauucaaauuaggaggaacaucauuaucguuaucaguaauggaaguaaauagugggauauauagaguauugagcacaaauacagaugauaauauaggcggagcacauuuuacagaaacucuagcacaauaucuagcaagugaauuucaaagaaguuuuaaacaugauguucgaggaaaugcaagagcaaugaugaaauuaacaaauucagcggaaguagcaaaacacucauuaagcacguuagguagugcaaauuguuucuuagauaguuuauaugaaggacaagauuuugauuguaauguaucacgagcccgauuugaauuauuauguagcccucuauuuaauaaauguauagaagcaauaaggggauuacucgaucaaaauggauucacagcugaugauauaaauaaaguaguauuauguggagguucaaguagaauaccuaaauuacaacaacuaauaaaagacuuauuuccagcaguagaacugcuaaauaguauaccgccagacgaaguaauaccaauaggagcagcaauugaagccggaauacuaauuggaaaagaaaaucuauuaguagaagacagccuuaugauagaauguagugcaagagacauacucgucaaaggcguagaugaauccggagcaaguagauucacuguauuauucccaucaggaacgccacuaccagcaagaagacaacauacacuacaagcaccaggaagcauaucaaguguaugucuagaacuauaugaaucagacgggaaaaauagcgcaaaagaagaaacaaaauuugcacaaguaguauuacaagauuuagacaagaaagaaaauggauuaagagauauauuagcaguauuaacuaugaaacgagacggaagucuacauguaacauguacagaucaagagacaggaaaaugugaagcgauaucaauagaaauugcuagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3212 - RNA, 2959 nt, Artificial Sequence
  mRNA product Design2 comprising derived and/or modified sequence from Homo sapiens__NP_006635.2 __HsHSPH1 (opt6)
ggggcgcugccuacggagguggcagccaucuccuucucggcaucaagcuuaccaugucaguaguaggacuugauguaggaucacaaucauguuauauagcaguagcacgagcaggagguauagaaacaauagcaaaugaauucagcgauagauguacaccuucagucauaucuuucggaucaaagaaucgaaccauuggcguagccgcaaaaaaccaacaaaucacgcacgcuaacaauacaguaucaaacuuuaaaagauuucacggucgagcguuuaaugaccccuucauucaaaaagaaaaagaaaacuuaagcuaugaccuuguaccacuuaaaaauggaggaguaggcauuaaaguaauguacaugggagaagaacaccuauuuaguguagaacaaaucaccgcgaugcuacuaacaaaacuaaaagaaacagcagagaauagccuaaaaaaaccaguuacugacugcguaauaaguguaccaucuuucuuuaccgacgcagaaagacgguccguucuagaugcagcccaaauaguaggauuaaacugucucagacuaaugaaugauaugacugcaguggcucuaaauuauggaauauauaaacaagacuugccaucacuagaugaaaaaccaagaaucguagucuucgucgauaugggccauagcgcauuucaaguuucagcaugugcuuucaacaaaggaaaacugaaaguucuaggaacggcauucgauccauuucuagggggaaaaaauuuugacgaaaaauuaguagaacacuuuugcgccgaauucaaaacaaaauacaaacuagacgcaaaaaguaaaauaagagcauuauugagauuauaccaagaaugcgaaaaacuaaaaaaauuaaugagcuccaacucaacagacuugccauuaaacauagaaugcuucaugaaugauaaagacguauccgguaaaaugaauagaucccaguucgaggaacuaugugccgaacuacuucaaaaaauagaaguaccauuauacucacuauuagaacaaacucaccuaaaagucgaagacguaagugcaguagaaauuguagguggagcaacaagaauaccggcuguaaaagaaagaauagcaaaauucuuuggaaaagauauaucaacaacauuaaacgccgaugaagccguagcuagagggugcgcacuucaaugcgccauauuaucaccagcguuuaaagucagagaauucaguguuaccgaugcaguaccauucccaauaaguuuaauauggaaccaugacucagaagacaccgaaggaguucaugaaguauuuagccgaaaccacgccgcaccauuuaguaaaguauuaacauuucuaagacgugguccauuugagcuugaagcauuuuauucugauccacaaggaguaccauacccagaagcaaaaauaggcagauuugucguacaaaacguaucggcacaaaaagauggagaaaaaucacgagucaaaguaaaggugagaguaaacacacauggaauauucacaauaaguacagccagcaugguggaaaaaguuccaacagaagaaaacgaaaugagcagcgaagcagauauggaaugucuaaaccaaagaccgccagaaaacccagacacagauaagaauguccaacaagacaacucugaagcaggcacucaaccacaaguucaaacagaugcacaacaaacuucacaaucaccaccgucuccagaauuaaccagugaagaaaacaaaauacccgacgcagauaaagcaaacgaaaaaaaaguagaccaaccaccagaagcaaagaaaccaaaaauuaaagucgugaacguagaauuaccaauagaagcaaaucuaguauggcaauuaggcaaagaccuauuaaauauguauaucgagaccgaagguaaaaugauaaugcaagacaaauuagagaaagaacgaaaugaugcaaaaaaugcaguagaagaauauguauaugaauuuagagauaaacuauguggaccguacgaaaaauuuauaugugaacaagaccaucaaaauuuucuacgacuucuaacugagacagaagacuggcuauacgaagaaggagaagaucaagcaaaacaagcguauguagacaaacuagaagaauuaaugaagauagguacaccaguaaaaguacgauuccaagaagcagaagagagaccaaaaauguuugaagaacugggucaaagauuacaacacuaugcaaaaaucgccgcagacuuucgaaacaaagacgaaaaguauaaucauauagaugaaucagaaaugaaaaaagucgaaaaaagugucaacgaagugauggaguggaugaauaacguuaugaaugcacaagccaaaaaaagccuagaucaagauccuguaguaagagcacaagagaucaaaaccaaaauaaaagaacuaaauaacaccugcgagccagugguuacccagccaaaaccaaaaauagaaagucccaaauuagagagaacccccaauggaccaaauauagauaaaaaagaagaagaccuagaggauaaaaauaacuucggagccgaaccaccacaccaaaauggggaauguuaccccaacgaaaaaaauaguguaaacauggauuuagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3213 - RNA, 3382 nt, Artificial Sequence
  mRNA product Design2 comprising derived and/or modified sequence from Homo sapiens__NP_006380.1 __HsHYOU1 (opt6)
ggggcgcugccuacggagguggcagccaucuccuucucggcaucaagcuuaccauggcugauaaagucagacgacaacggccaagaagaaggguaugcugggcacugguagcaguucugcuagccgauuuauuagcguuaucagauacccuagcuguaaugagcguagacuuaggcagugaaaguaugaaaguggcaauaguaaaaccaggaguacccauggagauuguuuuaaauaaagaaucaagaagaaagacgccaguaauaguaacgcuaaaagagaacgaaagauucuuuggagacucagcagcaaguauggcaauuaaaaacccaaaagcaacccugagauacuuucaacaucuguugggcaaacaagcagacaacccacauguagcgcuauaccaagcgagguuuccugaacacgaacuaacauucgacccacaaagacaaacaguacacuuccaaauaucuucacaacuccaauuuucaccugaggaaguacuuggaauggucuuaaacuacagucgaaguuuggcggaagauuuugccgaacaaccuauaaaagaugcaguaauaacaguaccuguauucuuuaaucaagccgagaggagagcuguauuacaagcugcaagaauggcuggacuuaaaguacuacaacucauaaaugacaauacagcuacugcacuaucauaugguguuuuuagaagaaaagacauaaacacaacugcacaaaauaucauguuuuacgauaugggaagcggaagcacagucugcacuauagucaccuaucagauggugaaaacaaaagaagcaggaaugcagccucaauuacaaauaagaggaguagguuuugacagaacgcuggguggauuagaaauggaacugagauuaagagaacgauuggcaggacuauucaaugagcaacgaaagggucagagagcuaaagacguuagagaaaauccucgcgcaauggcuaaacuuuuacgcgaagcaaauagauuaaagacaguacuuagugcaaacgcagaccauauggcucaaauagaaggacuaauggaugacguagacuuuaaagcaaaaguaacacgaguagaguucgaagaacuaugugcagaucucuuugaaagaguaccugguccaguacaacaagcucuacaaagugcugaaaugucuuuagacgaaauugaacaaguaauauuggucggcggagcaacacgaguuccuagaguacaagaaguauugcuuaaggcaguaggaaaagaagaacuagggaaaaauauaaacgcugacgaagcagcagcaaugggagccguuuaccaagcggcagcacuaagcaaggcuuuuaaaguuaaaccauuuguaguaagagaugcaguuguauauccaauuuuaguagaauuuacucgagaaguagaagaagaaccagggauacacucacuaaaacacaacaaaagaguacucuuuagcaggaugggaccguauccacaacguaaagucauaacauuuaacagauauucucaugauuuuaauuuccauauaaacuacggagacuuaggcuuuuuagguccagaagaucuaaggguauuugguucacaaaaucucacaacgguuaaacuaaaagggguaggagauaguuucaagaaauacccagacuaugaaucuaaaggaauaaaagcacauuuuaaucuagaugaaagugggguauugagucuagaccgagucgagagcguauucgaaacucugguugaagauagugccgaagaggaaucaaccuugacuaaacuagguaauacgauaagcagcuuauucggagguggcacaacaccagaugcaaaagaaaauggaacagacacaguacaggaagaagaagaaagcccggcagagggcucaaaagaugaaccuggggaacaaguagaguuaaaagaagaagcagaagcaccaguggaagacgguucgcaaccaccucccccagagccaaaaggugaugcaacaccagaaggcgaaaaagcaacagaaaaagaaaauggggauaaaucagaagcacaaaagccaagugaaaaagcagaagcuggaccagaaggaguugcuccugcaccagaaggagaaaagaaacaaaaacccgcacgcaaaagaagaaugguagaggaaauaggugucgagcuaguaguauuagaucuaccagaucucccagaagacaaauuggcacaaaguguacaaaaacugcaggacuuaaccuuaagagacuuagaaaaacaagaaagggaaaaagcugcaaauucuuuggaagcauucauauucgaaacacaggacaaauuauaucaacccgaauaucaggaaguauccacagaagaacaaagagaagaaauaucaggaaaacucucagcagcaucaacgugguuggaagaugaaggaguaggugcaacaacaguaauguuaaaagaaaaauuagcagaacuaaggaaacugugccaaggauuauuuuucagagucgaagaaagaaagaaauggccagaacgguuaucugcauuagauaauuuacuaaaccacucuaguauguuucuaaaaggggccagauuaauaccagaaauggaucaaauuuuuacugaaguagaaaugacaacacuagaaaaaguaaucaacgaaacaugggcauggaaaaaugcaacuuuagcagaacaagcaaaauuaccggcaacagaaaaaccagucuuacuaucaaaagacauagaagcgaaaaugauggcauuagacagagaaguccaauaccuacuaaacaaagcaaaguucacaaaacccagaccgcggccaaaagauaaaaacggaacccgagccgagccaccacuaaaugcaagcgcaagugaucaaggggagaagguaauaccgccugcaggacaaacagaagacgcagaaccaaucuccgaaccagaaaaaguagaaacaggaucggaaccuggagauacagaaccccuagaauuaggaggaccuggagcugagccagaacaaaaagaacaaaguacaggacaaaaacgaccucuuaaaaaugacgaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3214 - RNA, 2581 nt, Artificial Sequence
  mRNA product Design2 comprising derived and/or modified sequence from Homo sapiens__NP_005339.3 __HsHSP90AA1 (opt6)
ggggcgcugccuacggagguggcagccaucuccuucucggcaucaagcuuaccaugccagaagaaacccaaacacaagaccaacccauggaagaagaggaaguagaaacauucgcuuuccaagcagaaauugcacaauuaaugagucuaauuauaaacacauucuacucaaacaaagaaauauuuuuacgcgaacuaauaagcaacucaagcgaugcauuagauaaaauuagauaugaaucguuaacagauccaagcaaauuagacucaggaaaagaauuacacauaaaucuuaucccaaacaaacaagauagaacacuuaccauagucgacaccggaauaggaaugacaaaagcugaccuaauaaacaauuuagguacaauagcaaaaucggguaccaaagcauucauggaagcacuacaagcaggugccgacaucucgaugauaggacaauuuggaguaggauucuacagcgcauaccuaguagcagagaaaguaacaguuauaacaaagcacaacgacgacgaacaauacgccugggaaucaagugcaggaggaucauucacaguaagaacagacacaggugaaccaaugggcagagguacgaaaguaauacuucaucuuaaagaagaccaaacagaauaccuagaggaaagaagaaucaaagaaauaguaaaaaaacacucacaauucauaggauauccaauaacacucuuuguagagaaagaaagagacaaagaagucagugacgaugaagcagaggaaaaagaagauaaagaagaagaaaaagaaaaagaagaaaaagaaagugaagacaaaccagaaauagaagacguaggaucggaugaggaggaagaaaaaaaagauggagacaaaaaaaaaaagaaaaaaauaaaagaaaaauacauagaucaagaagaacugaacaaaaccaaaccaauauggacaaggaaccccgacgacaucacaaacgaagaauacggagaauuuuacaaaucacuuacaaaugacugggaagaccaccucgccgucaaacacuuuagcguagaaggucaauuagaauucagagcccuacuguuuguaccuagaagagcaccauucgauuuguuugagaauagaaaaaaaaaaaauaauaucaaacuauacguaagaagaguauuuauaauggacaauugcgaagaauuaauaccagaauaucuaaauuuuaucaggggaguagucgacagcgaagauuuaccauuaaacauaucgcgagagauguuacaacaaucaaaaauucugaaaguaauaagaaaaaaucuagucaaaaaaugucuagaacuauucacagaacuagcagaagacaaagaaaacuacaaaaaauucuaugaacaauucucaaaaaauauaaaauugggcauacacgaagacucucagaauagaaaaaaacuaucagaauuacuaagauauuauacgucagcuaguggagacgagaugguaucccuaaaagacuacugcacaaggaugaaagaaaaucaaaaacauauauacuacauaacuggagaaaccaaggaccaagucgcaaacucagcauucguagaaagauuacgaaagcauggacuggaaguaauauacaugauagaacccauagaugaauauugcguacaacaauuaaaagaauucgaaggaaaaacuuuaguaagcguaacgaaagaaggacuagaauuacccgaagaugaagaagagaaaaaaaaacaagaagagaaaaaaaccaaauucgaaaacuuauguaaaauaaugaaagacauauuagaaaaaaaaguagaaaaaguuguaguaucaaacagacuaguaacaagcccauguugcauaguaacaaguaccuacggguggacggcaaacauggaaagaauaaugaaagcccaagcuuuacgagacaauaguacgaugggauacauggcagccaaaaagcauuuagaaauaaacccagaccacagcauaaucgaaacacuuagacaaaaagccgaagcugauaaaaacgacaaauccgugaaagaccucgucaucuuacuuuaugaaacagcauuauuaaguaguggauucucccuagaagacccgcaaacacacgcuaaucgaauauaccgaaugauuaagcucggauuaggaauagacgaagaugacccaacagcggaugauacaagcgcagcaguaacugaagagaugccaccauuagaaggagaugaugauacgucaaggauggaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3215 - RNA, 721 nt, Artificial Sequence
  mRNA product Design2 comprising derived and/or modified sequence from Homo sapiens__NG_005218__HsHSP90AA3P (opt6)
ggggcgcugccuacggagguggcagccaucuccuucucggcaucaagcuuaccauggacucaagcaaacuagacagcggaaaaggacuacacauaaacuuaguaccaaacaaacaaaaccaaacacuaacaauaguagacacaagaauaggaaugacaaaaacagacuuaauaaacaaccuaggaacaguaacaaaaucaggaacaaaagcauucauggaagcacuacaagcagacgcagacauaucaaugauaggacacuucggaguaggauucuacucagcauaccuaguagcaaaaaaaguaacaguaauaucaaaacacaacaacgacgaacaauacacaugggaaucaucagcaggaggaucauucacaguaagaacagacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3216 - RNA, 2557 nt, Artificial Sequence
  mRNA product Design2 comprising derived and/or modified sequence from Homo sapiens__NP_031381.2__HsHSP90AB1 (opt6)
ggggcgcugccuacggagguggcagccaucuccuucucggcaucaagcuuaccaugcccgaagaagugcaucauggcgaagaggagguagaaacauucgcuuuucaagcugaaauagcucagcuaaugagccuaauaauaaacacuuuuuacagcaacaaagaaauauuucuccgcgaguuaauaucaaacgcuucagaugcacuugauaaaauaagauacgagagccuaacagacccuaguaaacuagauagcgguaaagaacuaaaaauagacauaauacccaacccgcaagaaagaacacuuacacuugucgauacuggaauaggaaugacaaaagcagaucuaauaaauaacuuaggaacaauagcaaaaucagggacgaaagcguuuauggaagcauuacaagcaggagcagauauuaguaugauaggacaauuuggaguaggauucuacagugcuuaucuuguagcagaaaaaguaguaguaauaacaaaacacaaugacgacgaacaauaugcuugggaaucuucagccggagggucauucacgguuagagcagaccacggagaaccaauaggaagaggcacuaagguaauacuacauuuaaaggaagaucagacagaauaccuugaagaacgaagaguaaaagaaguaguaaaaaaacauucacaauuuauaggauaccccauaacauuauaccuggaaaaagaaagagaaaaagaaauaucugacgacgaagccgaagaagaaaaaggagaaaaagaagaagaagacaaagaugaugaagaaaaaccgaaaaucgaagacguaggaucagacgaagaagacgacucaggaaaagacaaaaaaaaaaaaacaaaaaaaauaaaagaaaaauacauagaucaagaagaauugaacaaaacaaaaccaauauggacaagaaauccagaugauauaacacaagaagaauauggagaauucuacaaaagucuuacaaaugacugggaagaccaucuagcagucaaacauuuuucaguagaaggacaacuagaauucagagcguuauuauuuauaccaagaagagcgccauucgaccuauuugaaaacaaaaaaaaaaaaaacaauauaaaacuauacguaagaagagucuucauaauggacucgugcgaugaauuaauaccagaauacuuaaauuucauaagaggaguagucgauuccgaagacuuaccacuaaauauaucucgagaaauguuacaacaauccaaaauacuaaaagugauaagaaaaaauaucguaaaaaaaugucuugaacuauuuucggaacuugcggaagacaaggaaaauuauaaaaaauuuuaugaagcguucaguaaaaacuuaaagcuaggcauacaugaagacuccacaaauagaagaagacuaagcgaacuauuaagauaccauacaucacaaucaggagacgaaaugacaucucuaagugaauaugugagcaggaugaaagaaacccaaaaaucaauauacuacauaacaggagaaucgaaagaacagguagcaaauucagcauucgucgaacguguacgcaaaagaggauuugaaguaguauacaugacugagccaauagacgaauauuguguacaacaacuaaaagaauucgacggaaaaagucuagucaguguaacaaaagaaggacuagaacuaccagaagaugaagaagaaaaaaaaaaaauggaagaaagcaaagcaaaguucgaaaauuuaugcaaauuaaugaaagaaauacuagauaaaaaagucgaaaaaguuacaauuucaaauagacuagucucaucaccaugcugcauagucacaagcacauacggauggaccgccaauauggaaagaauaaugaaggcacaagcauuaagagauaacagcacgaugggauacaugauggcaaaaaaacaucuugaaauaaauccagaccacccaauagucgaaacacuaagacagaaagcagaagcagauaaaaacgacaaagcuguaaaagaccucgugguccugcucuucgaaacagcauuacugaguucaggauucucgcuggaagacccacagacucauucaaauagaauuuacagaaugauaaaacuaggauuaggaaucgaugaagacgaaguggcagcagaagaaccaaacgccgcggucccagacgaaauaccuccauuagaaggagacgaggaugcaagccgaauggaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3217 - RNA, 2794 nt, Artificial Sequence
  mRNA product Design2 comprising derived and/or modified sequence from Homo sapiens__NP_003290.1__HsHSP90B1 (opt6)
ggggcgcugccuacggagguggcagccaucuccuucucggcaucaagcuuaccaugcgagcuuuauggguacuaggcuuauguugcguauuacuuacauucggaucaguacgugcagacgaugaaguagauguagaugguacaguagaagaagauuuaggcaaaucaagagaaggaaguaggacagacgaugagguaguacaaagagaagaagaagcaauucaacuagacggacuuaacgcaucucaaauaagagaauuacgagaaaaaucagaaaaauuugcauuccaggcagaaguaaauagaaugaugaaacuaaucauaaauagucucuauaaaaacaaagaaauauucuuacgagaacuaauaucaaaugcaagugaugcuuuagacaaaauacgacuuaucagucuaacagaugaaaaugcacucaguggcaaugaagaacuaacaguuaaaauaaaaugcgauaaagagaaaaauuuacuacauguuacagacaccgguguaggaaugacaagagaagaauuaguuaaaaauuuaggaacaauagcaaaaaguggaacaagugaauuucuaaauaaaaugacugaagcucaggaagauggacaaagcacuucagaacuaauuggacaauucggaguaggauucuacucagcauuccuuguagcugauaaaguaaucguaacuagcaaacacaauaacgacacacaacauauaugggaaucagauucaaacgaauuuagcguaauugcagauccaagaggaaauacacuaggaagagggaccacaauaacauuaguacuaaaagaggaagcaagcgacuacuuagaacucgauacgauuaaaaauuuaguaaagaaauacucacaguuuauaaauuucccaauauacgucuggaguaguaaaacagaaacaguagaagaaccaauggaggaagaagaagcagccaaagaagaaaaagaagaaucggacgacgaagcugcugucgaagaagaagaagaagaaaagaaaccaaaaacaaagaaaguagagaaaacuguuugggauugggaauuaaugaacgauaucaaaccaauauggcaaagacccucaaaagaagucgaagaagacgaauauaaagccuuuuacaagucauuuuccaaagaaucggaugacccaauggcauauauucacuuuacagcagagggagaagucacauuuaaaucuauacuuuuugucccaacaagugcaccgagaggauuauuugaugaauacgguucaaagaaaucagacuauauaaaauuauauguaagaagaguguucauaacagacgacuuucacgauaugaugccgaaauacuuaaacuuuguuaaaggagucguugacagcgaugaccuaccacucaacguaaguagagaaacacuacaacaacauaaacuauugaaaguuauaagaaagaaacucguaagaaaaacuuuagacaugauuaagaaaauagcagacgacaaauauaacgauacauuuuggaaagaguucgguacaaauauaaaacuaggaguaauagaagaccacaguaauagaacccgauuagccaaauuacucagguuccaaucaucgcaucacccaacagacaucacgagcuuagaucaauauguagaaagaaugaaagaaaaacaagauaaaauauacuuuauggcgggaucaucaagaaaagaagccgaaucuucuccauucguugaacgacuauuaaagaaaggauaugaaguaauauaccuaacagaaccuguagaugaauauuguauacaagcacuaccagaauuugauggcaaacgcuuccaaaauguagcaaaagaaggcguuaaauuugaugaaagcgaaaagacaaaagaaaguagagaagcgguugaaaaagaguucgaaccauuauuaaauuggaugaaagacaaagcacuaaaagauaaaauagaaaaagcuguaguaucucaaagauuaaccgaauccccgugcgcacucguagccagucaauauggcuggucagguaacauggaaagaauaaugaaagcucaagcauaucaaacaggaaaagauauaaguacgaacuauuacgcaucucaaaagaaaacauucgaaauaaauccaagacacccacugauaagagauauguuaaggcgaauaaaagaagaugaagacgacaaaacaguucuagacuuagcugucguacuauucgaaacagcaacauuaagaagcggauacuuacuaccagacacaaaagcauauggagauaggauagaacggauguuacgacuaagucucaacauagauccagaugccaaaguugaagaagaaccagaagaggaaccagaagagaccgcagaagacacaacagaagacacagaacaggacgaagacgaagaaauggacguaggaacugacgaagaagaagaaacagcaaaagaaucuacagcagaaaaagacgagcuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3218 - RNA, 2497 nt, Artificial Sequence
  mRNA product Design2 comprising derived and/or modified sequence from Homo sapiens__NP_057376.2__HsTRAP1 (opt6)
ggggcgcugccuacggagguggcagccaucuccuucucggcaucaagcuuaccauggcacgagaauuaagagcucuuuuacuaugggguagacgacugagaccauuauuaagggcgccagcccucgcagcaguaccaggaggaaaaccaauacucugcccaagaagaacaaccgcacaauuaggcccaagaagaaauccagcauggucauuacaagcuggaagacuauuuuccacccaaacagcagaagauaaagaagaacccuuacauucaauaauaucaagcacagaaucaguccaaggaucaacaucaaaacaugaauuucaagcagaaacaaagaaacuauuagauauuguugcuagaagccuuuauucugaaaaagaaguauuuauaagagaacuaauuaguaacgcuagcgacgccuuagaaaagcuaagacacaaguuaguaagugauggacaagcauuaccagaaauggaaauacaccugcaaaccaaugcagaaaaaggaacaauaaccauacaagauaccggcauaggaaugacacaagaagaauuaguaaguaaccuuggaacaauagcuagaagcggaucaaaagcauuccucgacgcacuacaaaaccaagcagaagcaucauccaaaauaauuggacaauuuggcguaggauucuauagugccuuuaugguagcagaucgugucgaagucuauucacgaucagcagcaccaggaucacuaggguaucaaugguuaucagacggauccgguguauucgaaauugccgaagccucgggcguaagaacggguacuaaaauaauaauacauuuaaaaucagauugcaaagaauucucuucagaagcacgaguccgagauguaguaacgaaauauucaaacuuuguuaguuuucccuuauauuuaaauggucguagaaugaauaccuuacaagcaauauggaugauggauccaaaagauguuagagaauggcaacaugaagaauuuuauagauauguugcucaagcucaugacaaaccccgauauacuuuacacuacaaaacagacgcaccauuaaauaucaggaguauauuuuaugugccagauaugaaacccucgauguuugaugucaguagagaauuaggaagcaguguggcucuauauucuagaaaaguacucauacaaaccaaagcaacggauauauuaccaaaauggcucagauuuauaagaggaguuguugauucagaagacauacccuuaaaucuuaguagagaacuacuucaagaaucagcauuaauaagaaaauuaagagacguccuucaacaaagauuaauuaaauucuuuauagaccaaucaaaaaaagaugcagaaaaauaugcaaaauucuucgaagacuauggauuauuuaugagagaaggaauaguaacagcaacagaacaagaaguaaaagaggauauagcaaaauuauuacgguacgaaucaucagcauuaccaucaggacaacuuacaucauuauccgaauacgccagucgaaugagagcaggcacaagaaacauauauuaccuaugugcaccaaacagacaucuagcagagcacucaccuuauuacgaagcaaugaaaaaaaaagauacagaaguucuauuuugcuuugaacaauuugacgagcuuaccuuacuccaucuaagagaauuugacaaaaaaaaauuaauaaguguugaaacagacauaguaguugaucauuauaaagaagaaaaauuugaagaucgaagcccagcagcagaaugccuaucagaaaaagaaaccgaagaauuaauggccuggaugcguaauguucuaggaagcagaguuacaaacguaaaaguaacgcuaagauuagauacucauccagccaugguaacugugcuagaaaugggcgcagccaggcacuuccuaagaaugcaacaauuagcaaaaacacaagaagaaagagcacaauuacuucaaccaacacuugagauaaaucccagacaugcauuaaucaaaaaacuaaaccaacuucgugcaagcgaaccaggauuagcacaacuuuuaguugaucaaauauaugaaaacgcaaugauagcagcuggacucgucgaugauccaagagcaauggugggacgccuuaaugaauuauugguaaaagcauuggaacgacauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3219 - RNA, 844 nt, Artificial Sequence
  mRNA product Design2 comprising derived and/or modified sequence from Homo sapiens__NP_000609.1__HsIGF1 (opt6)
ggggcgcugccuacggagguggcagccaucuccuucucggcaucaagcuuaccaugggaaaaauaucaucacuaccaacacaacuauucaaaugcugcuucugcgacuuccuaaaaguaaaaaugcacacaaugucaucaucacaccuauucuaccuagcacuaugccuacuaacauucacaucaucagcaacagcaggaccagaaacacuaugcggcgcagaacuaguagacgcauuacaauucguaugcggagacagaggauucuacuucaacaaaccaacaggauacggaucaucaucaagaagagcaccacaaacaggcauaguagacgaaugcugcuuccgaucaugcgaccuaagaagacuagaaauguacugcgcaccacuaaaaccagcaaaaucagcaagaucaguaagagcacaaagacacacagacaugcccaaaacacaaaaagaaguacaccuaaaaaacgcauccagaggaucagcaggaaacaaaaacuacagaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3220 - RNA, 925 nt, Artificial Sequence
  mRNA product Design2 comprising derived and/or modified sequence from Homo sapiens__NP_000603.1__HsIGF2 (opt6)
ggggcgcugccuacggagguggcagccaucuccuucucggcaucaagcuuaccaugggaauaccaaugggaaaaucaaugcuaguacuauuaacauuucuagcauuugcaagcuguugcauugcagcauacagaccaucagaaacacuauguggaggagaauuaguagauacauuacaauuuguauguggagauagaggauucuauuucucaagaccagcaucaagaguuagcagaagaaguagaggaauaguagaagaaugcuguuucagaagcugugauuuagcauuacuagaaacauauugcgcaacaccagcaaaaagugaaagagauguaucaacaccaccaacuguauuaccagauaacuuuccaagauacccaguaggaaaauucuuucaauacgauacauggaaacaaagcacacaaagacuaagaagaggacuaccagcauuauuaagagcaagaagaggacacguucuagcaaaagaacuagaagcauuuagagaagcaaaaagacauagaccacuaauagcauuaccaacacaagauccagcacacggaggagcaccaccagaaauggcaucaaacagaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3221 - RNA, 1021 nt, Artificial Sequence
  mRNA product Design2 comprising derived and/or modified sequence from Homo sapiens__NP_000591.1__HsIL6 (opt6)
ggggcgcugccuacggagguggcagccaucuccuucucggcaucaagcuuaccaugaauuccuucucaacaucagccuucggaccaguagccuucucacuaggacuacuacuaguacuacccgcagcauucccagcaccagucccaccaggagaagacucaaaagacguagcagcaccacacagacaaccauuaacaucaucagaacgaauagacaaacaaauaagauacauauuagacggaauaucagcacuaagaaaagaaacaugcaacaaaucaaacaugugcgaaucaucaaaagaagcccuagcagaaaacaaccuuaaucuaccaaaaauggcagaaaaagacggaugcuuccaaucaggauucaacgaagaaacaugccuaguaaaaauaauaacaggacuacuagaauucgaaguauaccucgaauaccuacaaaacagauucgaauccucagaagaacaagcccgagcaguccaaaugucaacaaaaguacuaauacaauucuuacaaaaaaaagcaaaaaaucuagacgcaauaacaacaccagacccaacaacaaacgccuccuuacuaacaaaacuacaagcacaaaaccaaugguuacaagacaugacaacacaccucauacuaagaucauucaaagaauuccuacaauccucacuaagagcacuuagacaaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3222 - RNA, 1663 nt, Artificial Sequence
  mRNA product Design2 comprising derived and/or modified sequence from Homo sapiens__NP_002183.1__HsINHBA (opt6)
ggggcgcugccuacggagguggcagccaucuccuucucggcaucaagcuuaccaugccacuacugugguuaagagguuuccuauuagcaagcugcuggauaauaguaagaagcaguccaacaccagggagcgaaggacacagugcggcaccagacugcccaucaugugcgcuagcagcauuaccaaaagacguuccaaauagucaaccagaaaugguugaagcaguaaaaaaacauauauuaaauaugcuacaucuaaaaaaaagaccagauguaacacaaccaguaccgaaagcagcauuauuaaaugcaauacgaaaauuacaugucggaaaaguaggagaaaacggauauguagaaauagaagacgacauuggaagaagagcagaaaugaacgaauuaauggaacaaacaagugaaauuauaacguuugcagaaucaggaacagccagaaaaacacuacacuuugaaauaucaaaagaaggcucagaccuaucaguuguagaaagagcggaaguaugguuauuucuaaaaguaccuaaagcaaacagaacaagaacaaaaguaacaauuagacuauuucaacaacaaaaacacccacaaggaagucuagauacaggagaagaagcagaagaaguaggauuaaaaggagaaaggagugaauuacuauuaagugaaaaaguaguagacgcaagaaaaucaacauggcacguauuuccaguaucaucaagcauacaacgacuacuagaccaaggaaaauccucauuagauguaagaaucgcaugcgaacaaugucaagaaaguggugcaucauuaguacuauuaggaaaaaaaaaaaaaaaagaagaagaaggagaaggaaaaaaaaaaggaggaggagaaggaggugcaggagcagacgaagaaaaagaacaaagccauagaccauucuuaauguuacaagcaagacaaagugaagaccauccucauaggagaagaagaagaggacuugaaugcgacggaaaaguaaauauauguuguaaaaaacaauucuuuguaagcuuuaaagauauaggauggaacgauuggauaauagcuccaaguggauaucacgcaaauuacugcgaaggagaaugcccaucacacauagcgggaacaagcggaagcucacuaucauuccauagcacaguaauaaaccauuacagaaugagaggacauaguccauucgcaaacuuaaaaucaugcugugucccaacaaaacuaagaccaauguccauguuauauuaugaugacggucaaaauauaauaaaaaaagauauacaaaacaugauaguagaagaauguggcuguagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3223 - RNA, 1606 nt, Artificial Sequence
  mRNA product Design2 comprising derived and/or modified sequence from Homo sapiens__NP_002184.2__HsINHBB (opt6)
ggggcgcugccuacggagguggcagccaucuccuucucggcaucaagcuuaccauggauggauuacccgggagggcacuaggugcagcuugccuauuacuacuagcagcaggauggcuaggaccagaagcauggggaagcccgacaccaccuccuacaccagcagcaccaccaccaccuccuccaccaggaucaccaggaggaagucaagacacauguacaucaugcggaggauuccgaagaccagaagaacuaggaagaguagauggagauuuucuagaagcaguuaaacgacauauacuaucuagacuacaaaugcgaggaagaccaaauauaacacacgcaguuccaaaagcagcaaugguaacagcacuuagaaaauuacaugcagguaaaguacgugaagauggaagaguagaaauaccacaucuagacggucacgcuucaccaggagcugacggucaagaaagaguaucagaaaucaucagcuuugccgaaacugauggacuagcaucaucacgaguuagauuauauuuuuuuauuaguaaugaaggaaaucaaaauuuauucguuguccaagcuucauuauggcuuuauuuaaaauuacuaccuuauguauuagaaaaaggaucaagaagaaaaguaagaguuaaagucuauuuccaagaacaaggucauggagauagauggaauaugguagaaaaaagaguagaccuaaaaagaucaggauggcacacuuucccauuaacagaagcaauacaagcauuauucgaaagaggagaaagaagacuaaauuuagacguucaaugugacucaugucaagaauuagcaguaguaccaguuuuugucgauccaggagaagaaagucauagaccuuuuguaguaguacaagcgagauuaggagauucaagacacagaauaaggaaaagaggauuagaaugugacgggagaacaaacuuauguuguagacaacaauuuuuuauagauuuucgacuaauaggauggaaugauuggauaauagcaccuacaggauauuauggaaauuauugugaaggaaguuguccagcauauuuagcaggaguaccaggaucagcaagcaguuuucauacagcaguaguuaaucaauauagaaugagaggacuaaauccuggaacgguaaauucguguugcauuccuacaaaacuaucaacaaugagcauguuauacuucgaugacgaauauaauauaguuaaaagagacguaccaaacaugauuguagaagaauguggaugugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3224 - RNA, 3841 nt, Artificial Sequence
  mRNA product Design2 comprising derived and/or modified sequence from Homo sapiens__NP_000623.2__HsITGAM (opt6)
ggggcgcugccuacggagguggcagccaucuccuucucggcaucaagcuuaccauggcucucagaguacuacuacuaacugcacuaacuuuaugccacggcuucaacuuagauaccgaaaacgccaugacuuuucaagaaaaugcaagagguuucggacaaucuguaguacaacuacaaggcucaaggguaguuguaggcgccccucaagaaaucguagccgcuaaucagcgagguucucuuuaucaaugugauuauucaacuggauccugugaacccauccgauuacaaguaccuguagaagcuguaaauaugucacuuggacuaagucucgcugcaacaacaucacccccgcaacuacucgcauguggcccaaccguacaucagacauguucugaaaacacauacguaaaaggauuauguuuccuauuuggcaguaacuuacgacaacaaccacaaaaauucccagaagccuuaagaggauguccucaagaagauagcgauauugcauuccucauagauggaucugguuccauuauaccucaugauuuccggcgaaugaaagaauuuguuucaacagucauggaacaacuaaagaaaucaaaaacauuauuuuccuuaaugcaauauagugaagaguuccgaauacauuuuaccuucaaagaauuucaaaauaacccaaacccgcgaagucucguaaaacccauuacccaacuucuagguagaacucacacagcaacagguauuagaaaaguuguucgagaguuauuuaauauuacaaacggagcacguaaaaacgcuuucaaaauccuaguuguaauaacagacggagaaaaauuuggugacccacuagguuaugaagauguuaucccagaggcugacagagaaggagucauuagauaugucauaggaguaggagaugcauuccgcagugagaaaaguagacaggaacuuaacacgauagccucuaaacccccaagggaucacgucuuccaaguaaacaacuuugaggcuuuaaaaaccauacaaaaccaauugcgugagaaaauuuuugcuauagaagggacacaaacuggauccucaucuucauuugaacaugaaaugucucaagaaggauuuucagcagccaucacaucaaacggaccuuuacuaucaaccguuggcuccuaugauugggcuggaggagucuuccuuuauacuucuaaagaaaaauccacuuuuauaaauaugacccggguugauagcgacaugaaugacgccuauuuggguuaugcagcugcuauaauacuacgaaaucguguccaaaguuuaguccuaggagcucccagauaucagcauauugguuuaguugcgauguuuagacaaaacacagguaugugggaaucaaaugcaaauguuaaaggaacacaaauuggggcauauuucggcgcuucccuauguucaguagacgucgauucaaauggauccacggauuuaguucucauaggugcaccacacuauuaugaacaaacccgagguggccaagucuccguaugcccccuaccacgcggccgugcacguuggcagugcgacgcuguacuuuauggugaacaaggacaaccuuggggacguuuuggagcagcccuaacuguacuuggagacguuaauggcgacaaauuaacggauguugcgaucggggcaccaggcgaagaagauaauagaggagccguauacuuauuucauggcacaagcggcucaggaauaucaccuucacauagucaaagaauagcaggaucaaaacuaucuccaagauuacaauacuuugggcaaagucuaagcggcggacaagaccuuacaauggauggauuaguagaucuaaccguuggagcacaaggacauguauuauuauuaagaucccaaccuguucuuagagucaaagcuauuauggaauuuaacccuagagaaguagcucgcaauguuuuugaauguaaugaucagguuguuaaagguaaagaagcaggagaaguccguguuugucuucacguacagaaaucaacuagggauagacuaagagaaggacaaauacaaaguguuguuacauaugauuuagcacuagacucuggucgaccacauucaagagcaguuuucaacgagacuaaaaacucaacacgaagacaaacccagguauuagguuuaacacaaacuugcgaaacacuuaaacuacaauuaccuaauugcauagaagauccaguuucaccaauaguccuacgauuaaacuucucauuaguuggcaccccacuguccgcuuucggaaaccuacgucccguccucgcagaagacgcacaaagacuauuuacagcuuuauucccuuuugaaaagaauugcggcaaugauaauauaugucaagacgaucuuucaauuacuuuuaguuuuaugucacuagauugccuaguaguaggaggaccaagagaauuuaauguaacaguuacaguacgcaacgacggagaagacucuuaucgaacacaaguuacauuuuucuuuccauuagacuuaaguuaccgaaaaguaucaacccuucaaaaucaacgaucacaaagaucauggagguuagccugcgaaucggcaucauccacugaaguaucuggugcacucaaaaguacuucauguuccauuaaucauccuauauuuccugaaaauuccgaaguaaccuuuaacauaacauuugauguugauucaaaagccucucucgguaauaaauuacuacuuaaagcaaacgugacauccgaaaauaacaugccaagaacuaauaaaacggaauuucaauuagaauuaccuguuaaguacgcagucuacaugguugugacaagucauggcguuuccacaaaauaucuuaacuuuacagcaagugaaaacacaucaaggguuaugcaacaucaauaucaagucaguaaccuuggucaacgaagccuaccaaucucauuggucuuucucgucccaguaagacuaaaucaaaccguaauaugggaucgaccgcaaguuacuuucagugaaaacuuaaguucuacaugccacacaaaagaaagacuuccaucucacucugacuuucuagcugaacuacgaaaagcucccguuguaaacuguucuauagcaguuugucaacguauacaaugugauauuccauucuuuggaauacaagaagaguucaaugcuacauuaaaagguaauuuaucguuugauugguacauuaaaacuagccauaaucauuuauuaauaguuucuacugcagaaauccuguuuaaugauuccguauucacucuauuacccggacaaggagcauuuguaagaucccaaaccgaaacaaaaguagaaccuuuugaaguccccaacccucuuccuuuaaucguuggaucaagcguuggcggacuauuacuuuuagccuuaauaacggcggcauuauauaaauuaggauucuucaaacgccaauauaaagauaugaugucugaagguggaccuccuggagcagaaccacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3225 - RNA, 1786 nt, Artificial Sequence
  mRNA product Design2 comprising derived and/or modified sequence from Homo sapiens__NP_002415.1__HsMMP8 (opt6)
ggggcgcugccuacggagguggcagccaucuccuucucggcaucaagcuuaccauguuuucacuaaaaacauuaccuuuccuacuucuacuacacguacaaauaucaaaagcauuuccagucucaucaaaagaaaaaaacacaaaaacaguacaagauuaucucgaaaaauuuuaccaauuaccaucaaaucaauaucaaucaacacgaaaaaauggaacaaacguaauaguugaaaaauuaaaagaaaugcaaagauucuuuggacucaaugucacaggcaaaccuaacgaagaaacacuagacaugaugaaaaaaccaagaugcggaguaccagacucaggaggauucauguuaaccccaggcaacccuaaaugggaaagaacaaaucuaacauacagaauacgaaacuauacaccacaacuauccgaagcagaagucgaaagagcaauaaaagacgcuuuugaacuuuggucaguagccuccccacuaauauucacacgaauaucacaaggagaagccgacaucaacauagcauuuuaucaacgagaccacggagacaauucccccuucgacggaccaaauggaauacuagcacacgcauuccaaccuggacaaggaauaggaggagaugcacauuucgacgcagaagaaacauggacaaacacaucagcaaacuacaaccuauucuuagucgcagcacacgaauucggacauucucuaggacuagcccauucaucugaccccggcgcacuaauguauccaaacuacgcauuuagagaaacauccaacuacucccuaccccaagacgauauagaugguauccaagcaauauacggacuauccucaaauccaauacaaccaacaggccccucuacaccaaaaccaugcgacccaucccuuacauucgacgcaauaacaacccuccgaggagaaauauuauucuuuaaagacagauacuucuggagaagacacccucaacuccaacgaguugaaaugaacuucauaucuuuauuuuggccaucucuaccaacagggauccaagcagcuuacgaagauuuugaucgcgacuuaauauuuuuauucaaaggaaaucaauacugggcauuaucaggauaugauauacuacaaggauaccccaaagacauaucaaauuauggauuccccuccucaguccaagccaucgacgcugcaguauucuaccgaucaaaaaccuacuucuuuguaaaugaccaauuuuggagauacgauaaucaacgucaauucauggaaccugguuauccaaaaucaauaucuggcgcauuucccggaauagaaagcaaaguagacgcagucuuucaacaagaacacuucuuccacguauuuagcggaccaagauacuacgccuuugacuuaauagcacaaagaguaacacgaguugcaagaggaaacaaauggcuaaacuguagauacggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3226 - RNA, 2506 nt, Artificial Sequence
  mRNA product Design2 comprising derived and/or modified sequence from Homo sapiens__NP_004985.2__HsMMP9 (opt6)
ggggcgcugccuacggagguggcagccaucuccuucucggcaucaagcuuaccaugagucuauggcaaccauuaguauuaguuuuacuuguacucgguuguugcuucgcugcaccuagacaacgucaaucaacccucgugcucuuuccaggagaucuucgaacuaauuuaacagauagacaauuagcagaagaauauuuauauagguauggcuauacacgaguagcugaaaugcgaggagaaaguaaaagccuaggaccugccuuauuacuacuacaaaaacaacuaucauuaccagaaacuggagaauuagacuccgcuacucuaaaagcaaugcgcaccccacguugcggaguaccagauuuaggacgauuucaaacauuugaaggagauuuaaaauggcaucaucacaauauaacauacuggauucaaaacuacagugaagauuuacccagggcaguaauagacgaugcauuugcaagggcauuugcauuauggucagcuguuacuccacucacuuucacuagaguuuacaguagagaugcagauaucguaauacaauuuggaguagcagaacacggcgacggauacccauucgacgguaaagauggacuacuagcucaugccuucccaccagguccagguauacaaggagacgcacauuuugaugaugaugaauuauggaguuuaggcaagggaguugucguaccaacucgauuuggaaaugcugauggugcagcuugccauuuucccuuuauuuucgaagggagaucguauucagcuugcacaacagacggaagauccgauggucuaccauggugcucuacaacagcuaacuaugacacagacgauagauucggauucugcccauccgaacgauuauauacucaagauggaaaugcagacgguaaaccaugucaauucccauuuauauuccaaggacaaucauauagcgcuugcacaacagauggaagaagcgauggauacagauggugcgcaacaacagcuaacuaugaucgagacaaacuauuuggauuuuguccaacacgugcugauuccacaguaaugggaggaaauucugcuggugaacuauguguauucccauuuacauuccuugguaaagaauacucuacauguacaagcgaaggcagaggcgacggaagacuuuggugugcuacaacaucuaauuuugauagugauaaaaaauggggauucuguccagaccaaggauacucauuauuucuaguagcugcacaugaauuuggacaugccuuaggauuagaucauaguucuguaccagaagcucugauguauccuauguaccgauucacugaaggaccaccacuccauaaagacgauguuaauggaauaagacauuuguacggacccaggccagaaccagaaccaagaccaccaacaacaacaacuccucaaccgacagcaccaccaacaguuuguccaacaggaccccccacaguacauccaucagaaagaccuacagcaggaccaacagguccgccaucagccggaccaacuggaccuccaacagcaggccccuccacagcaacaacaguaccauuaucaccaguagaugaugcaugcaauguaaauauauuugaugcuauagcagagauaggcaaucaacuauaucucuuuaaagacggaaaauauuggagauucucagagggcagaggaucaagaccccaaggaccauuuuuaauugcagauaaauggccagcuuuaccaaggaaauuagauucagucuuugaagagcgccucucaaaaaaauuauuuuuuuucucaggaagacaagucuggguuuauaccggagcauccguauuaggaccaagaagauuagacaaauuagguuuaggugcugaugucgcacaaguuacaggagcuuuacgaagcggucgaggaaaaaugcuacuguucucugguagaagacuauggagauuugacguaaaagcgcaaaugguagacccucgaagcgcuagugaaguagauagaauguucccugguguaccucuugacacccaugacguuuuucaauacagagaaaaagcauauuuuugccaagaucgcuucuacuggcgaguuaguucacguagcgaacuaaaucaaguagaccaaguuggauaugucacauacgauauacuacaauguccagaagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3227 - RNA, 1798 nt, Artificial Sequence
  mRNA product Design2 comprising derived and/or modified sequence from Homo sapiens__NP_002418.1__HsMMP13 (opt6)
ggggcgcugccuacggagguggcagccaucuccuucucggcaucaagcuuaccaugcacccagguguacuugcagccuucuuauuuuuaucauggacucacuguagagcacucccacuaccaucaggaggagacgaagaugauuuaucagaagaagaccuccaauucgcagaaagauaucuaagaucuuacuaucacccaacaaacuuagcagguauacuaaaagaaaacgcagcaucaucaaugacagaaagacuaagagaaaugcaaucauucuuuggauuagaaguaacaggaaaacuagaugauaauacacuagacguaaugaaaaaacccagaugcggaguaccugauguaggagaauacaacguauucccaagaacacuaaaauggucaaaaaugaaucuaacauacagaaucguaaacuauaccccagacaugacacauagugaaguagaaaaagcauucaaaaaagcauucaaaguauggucagacguaacaccauuaaacuucaccagacuucacgauggaauagcagacauuaugauuucauuuggcauaaaagaacauggcgacuucuacccauucgacgguccaagcgguuuacuagcccaugcauucccaccuggaccuaacuauggcggagacgcacacuuugacgaugacgaaacauggaccaguucaaguaaaggauacaaucuauuuuugguagcugcccacgaauucggccacucacuaggacuagaccauucaaaagacccuggugcauuaauguucccaauauauaccuauacaggaaaaucacauuucauguuaccagaugaugauguacaaggcauccaaucauuauacggcccaggagacgaagauccaaacccaaaacacccaaaaacaccagacaaaugcgacccuucacuaucucuagacgcaauaacuucuuuaagaggagaaacaaugauauucaaagaucgauucuucuggagacuucacccacaacaaguagaugcagaacuauucuuaacaaaaucuuucuggccagaacuaccaaaccguaucgacgcagcauaugaacacccaucacaugacuuaauauuuauauuuagaggacgaaaauuuugggcauuaaacggauaugauauauuagaaggauacccuaaaaaaauaucagaacucggauuaccaaaagaaguuaaaaaaauaucggcagcuguacacuucgaagacacaggcaaaacccuauuauuuucaggaaaccaaguauggcgauaugacgacacaaaucauauaauggauaaagauuacccaagauuaauagaagaagauuucccaggaauaggugacaaaguagacgcaguauacgaaaaaaaugguuacauauauuuuuuuaacggacccauacaauucgaauacucaauauggucaaacagaauaguacgagucaugccagcaaauucgauacuuuggugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3228 - RNA, 1450 nt, Artificial Sequence
  mRNA product Design2 comprising derived and/or modified sequence from Homo sapiens__NP_001286.1__HsCCR1 (opt6)
ggggcgcugccuacggagguggcagccaucuccuucucggcaucaagcuuaccauggaaacaccaaacacaacagaagacuacgauacaacaacugaauucgacuacggagacgcaacaccaugucaaaaagucaacgaacgagcauucggagcacaauuacuaccuccacuauacucauuaguauuuguaauaggcuuagucggaaacauacuaguaguacuaguuuuaguucaauacaaaagacuaaaaaacaugacaucuauauacuuacuaaacuuagcaauaucagaucuucuauucuuauucacccuuccauucuggauagacuacaaauuaaaagacgacuggguauucggcgacgcaaugugcaaaauauuauccggauucuauuacacaggacuauacucagaaauauuuuucauaauacuccuaacaauagacagauaccuagcaauaguucacgcaguauucgcuuuaagagcaagaaccguaacauucggaguuauaacaucaauuauaaucugggcacuagccauacuagccucaaugccaggacuauacuucucuaaaacucaaugggaauucacacaccauacauguucacuccacuuuccccaugaauccuuaagagaauggaaacucuuccaagcacuaaaauuaaacuuauucggacuaguauuaccacuacuaguaaugauaauaugcuacacaggaauuauaaaaauccuacuuagaagaccaaacgaaaaaaaaucaaaagcagucagacuaauauucgucauaaugauaaucuuuuuuuuauucuggacaccuuacaaucucacuaucuuaauaucaguuuuccaagacuuccuauucacacacgaaugugaacaaucaagacacuuagacuuagcaguacaagucacugaaguaauagcauacacacacugcugcguaaacccaguaaucuacgcauucguaggagaaagauuuagaaaauaccuaagacaacuauuccacagaagaguugcuguacaccuaguaaaaugguuacccuucuuaucagucgaucguuuagaaagagucucaucaacaucacccucaacaggugaacacgaacuaucagccggauuuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3229 - RNA, 1018 nt, Artificial Sequence
  mRNA product Design2 comprising derived and/or modified sequence from Homo sapiens__NP_002598.4__HsPDGFA (opt6)
ggggcgcugccuacggagguggcagccaucuccuucucggcaucaagcuuaccaugagaacauuagcaugcuuauuacuauuaggauguggauacuuagcacacguauuagcggaagaagcagaaauaccaagagaaguaauagaaagacuagcacgaucacaaauacacucaauaagggaccuacaaagauuacuagaaauagacucaguaggaagcgaagacucacuagacacaucauuaagagcacacggaguacacgcaacaaaacacguaccagaaaaaagaccacuaccaauaagaagaaaaagaagcauagaagaagcaguaccagcaguaugcaaaacaagaacaguaauauaugaaauaccacgaucacaaguagacccaacaucagcaaacuucuuaauauggccaccaugcguagaagugaaaagaugcacaggcugcugcaacacaucgucaguaaaaugccaaccaagcagaguacaccacagaucaguaaaaguagcuaaaguagaauacguaagaaaaaaaccaaaacuaaaagaaguacaaguaagacuagaagaacaccuagaaugcgcaugcgcaacaacaagccuaaacccagacuaccgagaagaagauacaggaagaccgcgagaaaguggaaaaaaacgaaaaagaaaaagacuaaaaccaaccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3230 - RNA, 1108 nt, Artificial Sequence
  mRNA product Design2 comprising derived and/or modified sequence from Homo sapiens__NP_002599.1__HsPDGFB (opt6)
ggggcgcugccuacggagguggcagccaucuccuucucggcaucaagcuuaccaugaauagaugcugggcacuauucuuaagcuuauguugcuacuuaagacuaguaucagcagaaggagauccaauaccagaagaauuauacgaaaugcuaagcgaccacucaaucagaagcuuugacgauuuacaaagacuacuacauggagauccaggagaagaagacggagcagaacuagacuuaaauaugacaagaucacacucaggaggagaauuagaaucacuagcaagaggaagaagaagucuaggaucacuaacaauagcggaaccagcaaugauagcagaauguaaaacacgaacagaaguauucgaaauaucaagaagauuaauagacagaacaaaugcaaacuuccuaguauggccaccaugcguagaaguacaaagaugcucaggauguugcaauaacagaaacguacaauguaggccaacacaaguacaauuaagaccagugcaaguaagaaaaauagaaauaguacguaaaaaaccaauauuuaaaaaagcaacaguaacacuagaagaccaucuagcauguaaaugcgaaacaguagcagcggccagaccaguaacaagaagcccaggaggaagucaagaacaaagagcaaaaacaccacaaacuagaguuacaauaagaacaguaagaguaagaagaccaccaaaaggaaaacauagaaaauucaaacacacacaugauaaaacagcacuaaaagaaaccuuaggagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3231 - RNA, 1420 nt, Artificial Sequence
  mRNA product Design2 comprising derived and/or modified sequence from Homo sapiens__NP_057289.1__HsPDGFC (opt6)
ggggcgcugccuacggagguggcagccaucuccuucucggcaucaagcuuaccaugagcuuauucggacuacuacuccuuacuucagcacuagcaggacaaagacaaggaacacaagcagaaucaaaccuaagcucaaaauuccaauuuucaucaaacaaagaacaaaauggaguacaagauccacaacacgaaaggauuauuacagucucaacaaacggaaguauacacaguccaagauucccacauacauacccaagaaacacaguuuuagucuggcgacuaguagcaguagaagaaaauguauggauacaacuaacauucgaugaaagauucggauuagaagacccagaagacgacauaugcaaauaugacuuuguagaagucgaagaaccaagugacgguacaauacuaggaagauggugcggaucaggaacaguaccaggcaaacaaauaaguaaaggaaaccaaauuagaauaagauucguaucagaugaauacuuuccaucagaaccaggauucugcauacauuacaacauaguaaugccacaauucaccgaagcaguuucaccaucaguuuuaccaccaagugcccucccauuagaccuacuaaacaacgcaauaacugcauucaguacucuagaagaccuaauaagauaccuagaaccagaaagauggcaauuagaucucgaagaccuauauagaccaacauggcaacuauuaggcaaagcauuuguauucggaagaaaaucaagaguaguagacuuaaaccuauuaacagaagaaguaagacuauacagcugcacaccaagaaacuuuucaguuucaauaagagaagaauuaaaaagaacagauacaaucuucuggccaggaugucuauuagucaaaagaugcggcggaaacugcgcaugcugccuacauaacugcaacgaaugccaaugcguaccaaguaaaguaacaaaaaaauaccacgaaguauuacaacuaagaccaaaaacuggaguaagaggucuacacaaaucacuaacugacguagcauuagaacaucacgaagaaugugacugcgucugcagaggaucaacaggaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3232 - RNA, 1477 nt, Artificial Sequence
  mRNA product Design2 comprising derived and/or modified sequence from Homo sapiens__NP_149126.1__HsPDGFD (opt6)
ggggcgcugccuacggagguggcagccaucuccuucucggcaucaagcuuaccaugcacagacuaauauucguauacacacucauaugcgcaaauuucugcucauguagagacacaucagcaacaccacaaucagcaucaauaaaagcacuaagaaacgccaaccuaagacgagacgauuuauacagaagagacgaaacaauacaaguaaaagguaacggauauguacaaucaccaagauucccaaacaguuacccaagaaaucuacuacuaacauggagacuacacucacaagaaaacacaagaauacaacuaguauuugacaaccaauuuggacuagaagaagcugaaaacgacauauguagauaugacuucguagaaguagaagacauaagugaaacaucaacaauaauuagaggaagauggugcggccacaaagaaguaccaccccgaauaaaaucaaggacaaaccaaaucaaaauaacuuucaaaucagacgacuacuuuguagcaaaaccaggcuuuaaaauauacuauagcuuacuagaagacuuccaaccagcagccgcaagugaaacaaacugggaaagcguaacaucaagcaucucaggaguaagcuauaacucaccaucaguaacagacccaacacuaauagcagacgcauuagacaaaaaaauagcagaauucgacacaguagaagauuuauuaaaauacuucaacccagaaucauggcaagaagaccuagaaaauauguaccucgacacaccaagauauagaggaagaagcuaucacgauagaaaaucaaaaguagaccuagacagacuaaaugacgacgcuaaacgauauaguuguacaccaagaaacuacagugucaacauacgagaagaacuaaaacuagcaaacguaguauucuuuccacgaugucuacuaguacaaagauguggaggaaacugcggaugcggaacaguaaauuggagaucaugcaccugcaacagcggaaaaacaguuaaaaaauaccacgaaguacuacaauucgaaccuggccacauaaaacgaaggggaagagcaaaaaccauggcacuaguagauauccaacuagaucaucacgagagaugugacuguauauguaguucaagaccaccaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3233 - RNA, 1060 nt, Artificial Sequence
  mRNA product Design2 comprising derived and/or modified sequence from Homo sapiens__NP_003946.3__HsSOCS3 (opt6)
ggggcgcugccuacggagguggcagccaucuccuucucggcaucaagcuuaccaugguaacacacucaaaauucccagcagcaggaaugucaagaccauuagacacaucauuaagacuaaaaacauucucaucaaaaucagaauaucaacuaguaguaaacgcaguaagaaaacuacaagaaucaggauucuacuggucagcaguaacaggaggagaagccaaccuacuccuaucagcagaaccagcaggaaccuuccuaauaagagacucaucagaccaacgacacuucuucacacuaucaguaaaaacacaauccggaacaaaaaaccucagaauacaaugcgaaggaggaucauucucacuacaaucagacccacgcuccacacaaccaguaccaagauucgacugcguacuaaaacuaguacaccacuacaugccaccaccaggagccccaucauuuccaucaccaccaacagaaccaucaucagaaguacccgaacaaccaucagcacaaccacuccccggaucaccaccaagaagagcauacuacauauacucaggaggagaaaaaauaccauuaguacuauccagaccauuaucuucaaacgucgcaacacuacaacaucuaugcagaaaaacaguaaacggacacuuagacucauacgaaaaaguaacccaacuaccaggccccauacgagaauuccuagaccaauacgacgcaccacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3234 - RNA, 865 nt, Artificial Sequence
  mRNA product Design2 comprising derived and/or modified sequence from Homo sapiens__NP_003227.1__HsTGFA (opt6)
ggggcgcugccuacggagguggcagccaucuccuucucggcaucaagcuuaccaugguaccaucagcaggacaauuagcauuauucgcauuaggaauaguauuagcagcaugucaagcauuagaaaauucaacaucaccacuaucagcagauccaccaguagcagcagcuguaguaucacauuuuaaugacuguccagauucacauacucaauucuguuuucauggaacauguagauucuuaguacaagaagacaaaccagcauguguaugucauucaggauauguaggagcaagaugugaacaugcagauuuauuagcaguagucgcagcaucacaaaaaaaacaagcaauaacagcauuaguaguaguaucaauaguagcauuagcaguacuaauuauaacauguguacuaauacauuguugucaaguaagaaaacauugugaauggugcagagcauuaauauguagacaugaaaaaccaucagcauuauuaaaaggaagaacagcauguugucauucagaaacaguaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3235 - RNA, 1555 nt, Artificial Sequence
  mRNA product Design2 comprising derived and/or modified sequence from Homo sapiens__NP_000651.3__HsTGFB1 (opt6)
ggggcgcugccuacggagguggcagccaucuccuucucggcaucaagcuuaccaugccaccuagcggacucagauuauuacccuuacuacucccacuccuauggcuacuaguacuaacuccaggaagaccagcagcaggacuaaguacauguaaaacuauagacauggaauuaguaaaaagaaaaagaauagaagccauacguggacaaauccuaucuaaauugagacuagccucaccuccaucacaaggagaaguaccaccaggaccccuacccgaagcaguacuagcacuauacaacucaacaagagauagaguagcaggagaaucagcagaaccagaaccagaaccagaagcagauuauuacgcaaaagaaguaacacgcguauuaaugguagaaacacauaacgaaauauaugauaaauucaaacaaucuacacacucuauauacauguucuuuaauacaucagaacucagagaagccguacccgaaccaguauuauuaucaagagcagaacuaagacuucuaagacuaaaacucaaaguugaacaacacguagaacuauaccaaaaauacucaaacaauucuuggagauauuuaucuaacagacuacuagcccccucagacuccccugaauggcuaucauucgacguaacaggaguagucagacaaugguuaucuagaggaggagaaauagaaggauuccgacuuucagcacacuguucuugugauagucgcgacaacacauuacaaguagacauaaacgguuucacaacuggacguagaggagaccuugcaacaauacaugguaugaacagaccauucuuacuacuaauggcaacaccacucgaacgagcacaacaucuacaauccucacgccacagacgagcccuagacacaaacuacugcuucucaucaaccgaaaaaaauuguugcguaagacaauuauacauagauuucagaaaagaccuaggauggaaauggauacaugaaccuaaaggauaccacgccaauuuuuguuuaggcccauguccauacauauggucacuagacacacaauacucuaaaguauuagcucuauacaaccaacacaacccaggcgcaucagcagcaccaugcuguguuccacaagcuuuagaaccauuaccaaucguauauuacguaggaagaaaacccaaaguagaacaauuaucaaacaugauagucagaucauguaaaugcucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3236 - RNA, 1627 nt, Artificial Sequence
  mRNA product Design2 comprising derived and/or modified sequence from Homo sapiens__NP_003229.1__HsTGFB2 (opt6)
ggggcgcugccuacggagguggcagccaucuccuucucggcaucaagcuuaccaugcauuacugcguacuaucagcauuccuaauacuacaccuaguaacaguagcauuaucccuaucaacuugcuccacccuagacauggaccaauuuaugagaaaacgcauagaagcaauaagaggacaaauuuuaucaaaacucaaacuaacaagcccaccagaagacuacccagaaccagaagaaguaccaccggaagucauuucaauauacaauucaacaagagaccuacuacaagaaaaagcaucaagaagagcugcagcaugugaaagagaacgcagcgacgaagaauacuacgcaaaagaaguauacaaaaucgacaugccuccauucuucccaagcgaaaacgcaauaccaccaacauucuaucgaccauauuuuagaauaguaagauucgacgucucagccauggaaaaaaaugcuagcaauuuaguaaaagcagaauuuagaguuuucagacuacaaaacccaaaagcacgaguccccgaacaacgaauagaauuauaccaaauacuaaaaucaaaagaccuaacauccccaacacaaagauacauagacucaaaaguaguuaaaacccgagcagaaggcgaauggcuaucuuucgauguaacagacgcaguacacgaaugguuacaccacaaagauagaaaccuagguuucaaaauaucucuccacugcccaugcugcacauucguaccauccaacaacuacauaauaccaaacaaaucugaagaauuagaagcaagauucgcaggaauagacgguacaucaaccuacacaucaggagaucaaaaaacaauaaaauccacaagaaaaaaaaauucaggaaaaacaccacaccuacuacuaaugcuacuaccaagcuacagauuagaaucacaacaaacaaacagacgaaaaaaaagagcacuagaugcagcauacugcuucagaaacguacaagacaacugcugucuccgcccacuauacauagauuucaaacgagauuuaggauggaaauggauacacgaacccaaaggauauaacgccaacuucugcgcaggagcaugcccauauuuauggucauccgacacccaacacuccagaguccuaucucucuacaacaccauaaacccagaagcaucagcaucacccugcuguguaucccaagacuuagaaccacuuacaauauuauacuacauaggaaaaacaccaaaaauagaacaacuaucaaacaugauagucaaauccuguaaaugcucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3237 - RNA, 1621 nt, Artificial Sequence
  mRNA product Design2 comprising derived and/or modified sequence from Homo sapiens__NP_003230.1__HsTGFB3 (opt6)
ggggcgcugccuacggagguggcagccaucuccuucucggcaucaagcuuaccaugaaaaugcacuuacaaagagcauuaguuguacuagcacuucucaacuuugcaacaguaucacuaucauuaucaaccugcacaacacuagacuuuggacacauaaaaaaaaaacgaguagaagccauaagaggacaaauacuaucaaaacuaagacuaacaucaccaccagaaccaaccguaaugacacacgucccauaccaaguauuagcccuauacaacaguacaagagaacuacucgaagaaaugcacggagaacgagaagaaggaugcacucaagaaaauacagaaucagaauacuacgcaaaagaaauacacaaauuugauaugauacaaggauuagcagaacacaaugaacuagccguaugcccaaaaggaauaacaucaaaaguauuuagauuuaacguaucaucagucgaaaaaaaccgcacaaaucuuuucagagcagaauuucgagugcuacgaguaccaaauccaucaucaaaaagaaacgaacaacgcauagaacuauuucaaauccuacgaccagacgaacacauagcaaaacaaagauacauaggaggcaaaaaccuccccacaagagguaccgcagaaugguuaucauucgaugucaccgacacaguacgagaaugguuacuaagaagagaaucaaaccuaggcuuagaaauaucaauccacugcccaugccacaccuuucaaccaaauggagacauauuagaaaacauacacgaaguuauggaaauaaaauucaaaggaguagauaaugaagaugaccacggacgaggugaucuuggaagacuaaaaaaacaaaaagaccaccacaacccacaucuaauauuaaugaugauaccuccacacagauuagacaaccccggacagggaggacaaagaaaaaaaagagcacuagauacaaacuauugcuucagaaaccuagaagaaaacugcugcgucagaccuuuauacauagauuucagacaagaucucggauggaaauggguccacgaaccaaaaggauacuaugcaaacuuuugcuccggccccugcccauaucuacgaucagcagacacaacacacucaacaguacucggacuuuauaacacucuaaaccccgaagcauccgccuccccaugcuguguuccacaagacuuagaaccacuaacaauauuauacuauguaggacgaacaccaaaaguugaacaauuaagcaacaugguaguaaaaucaugcaaauguagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3238 - RNA, 1768 nt, Artificial Sequence
  mRNA product Design2 comprising derived and/or modified sequence from Homo sapiens__NP_001057.1__HsTNFRSF1B (opt6)
ggggcgcugccuacggagguggcagccaucuccuucucggcaucaagcuuaccauggcacccguagcugucugggcagcauuagcaguuggauuagaauuaugggcagcugcccacgcacuaccagcccaaguagcauucacaccuuacgccccagaaccuggaucuaccugcagacuaagagaauauuacgaucaaacagcucaaauguguuguucaaaauguucaccaggccaacaugcaaaaguauucuguacaaaaacaucagauacaguaugugauucaugcgaagauucaacuuauacacaauuauggaauuggguucccgaaugccuauccuguggaucaagauguucaucagaucaaguagaaacccaagcauguacaagagaacaaaauagaauauguacaugcagaccagguugguauugugcacuaagcaaacaagaaggaugcagauuaugugccccauuaagaaaaugucgaccaggcuucggaguagcacgaccuggaaccgaaaccucugauguaguaugcaaaccaugugcaccaggaacauuuucaaacacaacaucuucaacagacauaugcagaccacaccaaauauguaacguuguagcaauaccuggcaaugccucaauggaugcaguuuguacaucaacauccccaacaagaucuauggcaccaggagccguacauuuaccacaaccaguuaguacucgaucacaacauacccaacccacacccgaaccauccacugcuccguccaccucauuccuacuaccaaugggacccucuccaccagcugaagguucuacaggagacuucgcacuaccaguuggauuaauaguaggaguaaccgcacuaggacuucuaaucauaggaguaguuaauuguguaaucaugacucaaguuaaaaaaaaaccuuuauguuuacaacgagaagcaaaaguaccacauuuaccggcagauaaagcaagaggaacucaaggaccagaacaacaacaucuauuaauuacagcuccaucaucaucaucaucaucacuagaaucaucagcuucagcacuugaucgaagagcaccuacacguaaccaaccacaagcaccagguguggaagcuucaggugcaggagaagcaagagcaaguacaggaucaucagacaguucaccaggaggucauggaacacaaguaaauguaacuuguauaguaaaugucuguagcucaucagaucauucaucccaaugcucaucucaagccuccucaacaaugggagacacagauuccucuccaucagaaucaccaaaagacgaacaaguaccauuuucaaaagaagaaugugccuucagaucacaacuagaaacaccagaaacuuuauuaggaucaacugaagaaaaaccgcuacccuuaggaguaccagacgccggaaugaaacccucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3239 - RNA, 895 nt, Artificial Sequence
  mRNA product Design2 comprising derived and/or modified sequence from Homo sapiens__NP_002623.2__HsPGF (opt6)
ggggcgcugccuacggagguggcagccaucuccuucucggcaucaagcuuaccaugccaguaaugagauuauuuccauguuuucuacaauuauuagcaggauuagcacuaccagcaguaccaccacaacaaugggcauuaucagcaggaaauggaaguucagaaguagaaguaguaccauuucaagaaguguggggaagaucauauuguagagcauuagaaagauuaguagauguaguaagugaauauccaagugaaguagaacauauguuuucaccaaguuguguaaguuuauuaagauguacagguuguuguggagaugaaaaccuacauuguguaccaguagaaacagcaaauguaacaaugcaauuauuaaaaauaagaaguggagauagaccaucauauguugaauuaacauuuagucaacauguaagaugugaaugcagaccacuaagagaaaaaaugaaaccagaaagaagacgaccaaaaggaagaggaaaaagaagaagagaaaaacaaagaccaacagauugucauuuauguggagaugcaguaccaagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3240 - RNA, 1621 nt, Artificial Sequence
  mRNA product Design2 comprising derived and/or modified sequence from Homo sapiens__NP_001020537.2__HsVEGFA (opt6)
ggggcgcugccuacggagguggcagccaucuccuucucggcaucaagcuuaccaugacagauagacaaacugauacagcaccgaguccgaguuaucauuuauuaccaggaagaaggagaacaguagaugcagcagcaucaagaggacaaggaccugaaccagcaccaggaggagggguagaaggaguuggagcuagaggaguagcauuaaaauuauuuguccaguuauuaggaugcaguagauuuggaggagccguaguaagggcaggagaagcagaaccaucaggggcagcacgaagugcaucaaguggaagagaagaaccacaaccagaagaaggagaagaagaagaggagaaagaagaagaaagaggaccacaauggcggcugggugcgagaaaaccaggaaguuggacaggagaagcagcaguaugcgcagauucagcucccgcagcgagagcaccucaagcauuagcaagagcaagcggaagaggaggaagaguagcaagaagaggagcagaagaaucagggccaccucauagcccaaguagaagggguagugcaaguagagcaggaccaggaagagcaagcgaaacaaugaauuuuuuauuaagcuggguacauuggucauuagcgcuauuacuauauuuacaucaugcaaaauggagccaagcagcaccaauggcagaaggaggaggucaaaaccaucacgaaguaguaaaauuuauggauguuuaucaaaggucauacugccacccaauagaaacacuaguagauauauuucaagaauacccagacgaaauagaauauauauuuaaaccaagcuguguaccacuaaugagaugugguggauguugcaacgaugaaggacuagaauguguaccaacagaagaaucuaauauaacaaugcagauaaugagaauaaaaccacaccaaggacaacauauaggagaaaugaguuuuuuacaacauaauaaaugugaauguagaccaaaaaaggauagagcaaggcaagaaaaaaaaucaguaagaggcaaaggaaaaggacaaaaaaggaaaagaaaaaagagcagauauaaaaguuggagcguguauguaggagcaagaugcugucuaaugccauggucacuaccaggaccucauccauguggaccauguagugaacgaagaaaacaucuauuuguacaggauccacaaacauguaaauguagcuguaaaaauacagauaguagauguaaagcaaggcaauuagaauuaaaugaaaggacuuguagaugcgauaaaccuagaagguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3241 - RNA, 1081 nt, Artificial Sequence
  mRNA product Design2 comprising derived and/or modified sequence from Homo sapiens__NP_001165094.1__HsVEGFA (opt6)
ggggcgcugccuacggagguggcagccaucuccuucucggcaucaagcuuaccaugaacuuucuauuaagcuggguacauuggucacuugcauuauuacuauauuuacaucacgcaaaauggagccaagcagcaccaauggcagaaggaggaggacaaaaccaucacgaaguaguaaaauuuauggauguauaucaaaggaguuacugccauccaauagaaacacuaguggacauauuccaagaauauccagaugaaauagaauauauauuuaaaccaagcuguguaccacuaaugagauguggaggaugcuguaacgaugaaggacuagaaugcguaccaacagaagaaagcaauauaacaaugcaaauaaugagaauaaaaccacaccaaggacaacacauaggagaaaugucauucuuacaacauaacaaaugcgaaugcagaccaaaaaaagaucgagcaagacaagaaaaaaaaucaguaagaggaaaaggaaaaggacaaaaaagaaaaagaaaaaaaagcagauacaaaaguuggagcguauacguaggagcaagauguugcuuaaugccauggucacuaccaggaccacacccaugcggacccuguagcgaaagaagaaaacaucuauucguacaagacccacaaacaugcaaaugcucaugcaaaaacacagacucaagauguaaagcaagacaacuagaacuaaaugaaagaacauguagaugugacaaaccaagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3242 - RNA, 1006 nt, Artificial Sequence
  mRNA product Design2 comprising derived and/or modified sequence from Homo sapiens__NP_003368.1__HsVEGFB (opt6)
ggggcgcugccuacggagguggcagccaucuccuucucggcaucaagcuuaccaugucaccauuacuaagaagacuauuacuagcagcauuauuacaacuagcaccagcacaagcaccaguaucacaaccugaugcaccaggacaucaaagaaaaguaguaucauggauagauguauauacaagagcaacaugccaaccaagagaaguaguaguaccacuaacaguagaauuaaugggaacaguagcaaaacaauuaguacccucaugcguaacaguacaaagaugcggagguuguuguccagacgauggacuagaauguguaccuacaggucaacaucaaguaagaaugcaaauauuaaugauaagauacccaaguucacaauuaggagaaaugucauuagaagaacauucacaaugcgaauguagaccaaaaaaaaaagacucagcaguaaaaccagacagagcagcaacaccacaccauagaccucaaccaagaucuguaccaggaugggacucagcaccaggagcuccaucaccagcagacauaacucauccaacaccagcaccaggacccucagcacaugcagcuccaucaacuacaucagcauuaacaccaggaccagcagcagcugcugcagacgcagcagccucaucaguagcaaaaggaggagcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3243 - RNA, 1642 nt, Artificial Sequence
  mRNA product Design2 comprising derived and/or modified sequence from Homo sapiens__NP_005420.1__HsVEGFC (opt6)
ggggcgcugccuacggagguggcagccaucuccuucucggcaucaagcuuaccaugcaccuauuaggauuuuucucaguagcauguucauuacuugcagcagcauuacuccccggaccaagagaagcaccagcugcagcagcagcauucgaaucaggacuagaccuaagcgaugcagaaccagacgcaggagaagcaacagcauaugcaaguaaagaccuagaagaacaauuaagaaguguaucaucaguagacgaacuaaugacaguacucuaccccgaauacuggaaaauguacaaaugccaauuaagaaaaggaggauggcaacacaacagagaacaagcuaaccuaaacucaagaacugaagaaacaauaaaauuugcagcagcccacuacaauacagaaauauuaaaaucaaucgauaacgaauggcgaaaaacacaauguaugccaagagaaguuuguauagacguaggaaaagaauuuggaguugcaacaaauacauuuuuuaaaccaccaugcgucucaguauacagaugcggaggaugcugcaauagcgaaggauuacaauguaugaauacaucaacaagcuacuuaagcaaaacacuauuugaaauaacaguacccuuaucacaaggacccaaaccaguuacaauaaguuuugcaaaucauacuucaugcagauguaugaguaaauuagauguuuaucgccaaguacauucaauaauacgacgcagucuaccagcaacauuaccacaaugccaagcugcaaauaaaacaugcccaacuaauuauauguggaauaaucacaucugcagaugucuugcacaagaagacuucauguuuuccucagaugcaggagacgauucaacagacggcuuccacgacauauguggaccaaauaaagaacuagaugaagaaacaugucaaugcgucugcagagcaggauuaagaccagcaucauguggaccacacaaagaauuagacaggaauuccugccaauguguauguaaaaauaaacuauuuccaucacaaugcggagccaaucgagaauucgacgaaaauacaugccaaugugucuguaaaagaaccugucccagaaaucaaccauuaaacccuggaaaaugugccugugaaugcacagagucaccacaaaaauguuuacuaaaaggaaaaaaauuccaucaucaaacaugcuccuguuacagaagacccugcacaaacagacaaaaagcaugcgaaccaggauucagcuacagugaagaaguaugcagauguguaccaucauauuggaaacgaccacaaaugucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3244 - RNA, 1447 nt, Artificial Sequence
  mRNA product Design2 comprising derived and/or modified sequence from Homo sapiens__NP_004460.1__HsVEGFD (opt6)
ggggcgcugccuacggagguggcagccaucuccuucucggcaucaagcuuaccauguacagagaauggguaguaguaaacguauucaugaugcuauacguacaauuaguacaagguuccucaaacgaacacggcccaguaaaaagaucaucccaaagcacacuagaaagaucugaacaacaaauaagagcagcaucuucacuagaagaacuuuuaagaauaacacacucagaagacuggaaacuauggagaugcagacuaagacuaaaaucauucacaucuauggacagcagguccgcaagucacagaucaaccagauucgccgcaacauuuuaugacauagaaacacucaaaguaauagacgaagaauggcaaagaacacaaugcaguccaagagaaacauguguagaaguagccucagaacuaggaaaaagcacuaacacauucuucaaaccaccaugcguaaauguauucagaugcggcggauguugcaacgaagaaucucucauauguaugaacacaaguacaucauacaucucaaaacaacuauucgaaauaucagucccauuaacaucaguaccagaacuaguaccaguaaaaguagcaaaccacacaggauguaaaugccuaccaacagcaccaagacacccauacaguaucauaagaagaucaauccaaauaccagaagaagaccgaugcucccacucaaaaaaauuaugcccaauagacaugcuaugggauucaaacaaaugcaaaugcguacuacaagaagaaaacccauuagcaggaacagaagaccacucucacuuacaagaaccagcauuaugcggaccacauaugauguucgacgaagauagaugugaauguguaugcaaaacuccaugcccaaaagaccuaauacaacacccaaaaaacugcucauguuucgaaugcaaagaaucucuagaaacaugcugccaaaaacacaaauuauuucacccagacacaugcucaugcgaagacagaugcccuuuccacaccagaccaugugccagcggaaaaacagcaugugcaaaacacuguagauuuccaaaagaaaaacgagcagcccaaggaccacacucaagaaaaaauccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3245 - RNA, 1012 nt, Artificial Sequence
  mRNA product Design2 comprising derived and/or modified sequence from Homo sapiens__NP_061986.1__HsFGF21 (opt7)
ggggcgcugccuacggagguggcagccaucuccuucucggcaucaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagcugcuguuggaagauggguauaacguguaccagagugaggcccacggccucccccugcaucugccagguaauaaaagcccgcacagggaccccgcaccacgggggcccgcccgcuuucucccacugcccggcuugccgcccgcccugccagaacccccaggcauccucgcaccccagccaccggaugugggguccagcgacccccugaguauggucgguccaucccagggcaggagccccuccuaugccaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3246 - RNA, 1792 nt, Artificial Sequence
  mRNA product Design2 comprising derived and/or modified sequence from Homo sapiens__NP_002412.1__HsMMP1 (opt7)
ggggcgcugccuacggagguggcagccaucuccuucucggcaucaagcuuaccaugcacagcuuucccccacugcuccuguugcuguucuggggcguggucucccauaguuucccggccacccucgagacucaggaacaagacguggaucugguacagaaguacuuggagaaauauuacaaccugaagaaugacgggaggcaaguggaaaaacggcgcaacagcggucccgucguggagaagcucaaacagaugcaggaauuuuucggccugaaggugaccgggaagccagaugcagagacgcugaaagucaugaagcagcccaggugcggcgugccagacguagcccaguuugugcucacugaggguaauccccggugggaacagacccaccugaccuaucgcaucgagaacuacacuccagauuugccgagggcggacgucgaucaugccauugaaaaagcauuccaacugugguccaaugugacgccccucaccuuuacuaaggugagugaggggcaggccgacaucaugauuagcuucguccggggcgaucaccgcgacaacuccccauuugauggccccggggguaaucuggcacaugccuuccagccaggccccgggaucggcggugacgcgcacuuugaugaggacgaaagguggaccaacaauuuccgggaguauaaccugcaccgcguggccgcacaugaauuggggcacagccucggccugucccauaguacugacauuggcgcccugauguacccgagcuauaccuucuccggggauguacagcucgcccaagacgauaucgacgguauccaggcaauuuacggcaggagccagaaucccgugcaaccaaucgggccccagaccccaaaagccugugauaguaagcugacguuugacgcgauuacuaccauccggggcgaggucauguucuuuaaagaucgcuucuacaugaggacuaaccccuuuuauccagaaguggaguugaauuucauuuccguguuuuggccgcagcugcccaacggucucgaggccgcauacgaguucgccgaccgggaugaaguccgcuuuuucaagggcaauaaguauugggcagugcaggggcaaaacguacugcacggcuacccaaaagacaucuauagcuccuuuggguuccccaggaccgugaagcacauugaugccgcccugagugaagagaacaccgguaaaacuuacuuuuucgucgcgaauaaguauuggcgguacgacgaauacaaacgcagcauggacccaggcuaucccaagaugaucgcacaugauuucccggggaucggccacaagguggacgccgucuuuaugaaagaugguuucuuuuacuucuuucauggcacgaggcaguauaaguucgacccaaaaaccaagcggauuuugacucuccagaaagccaacuccugguuuaauugcaggaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3247 - RNA, 1552 nt, Artificial Sequence
  mRNA product Design2 comprising derived and/or modified sequence from Homo sapiens__NP_002412.1__HsMMP1(1-19,100-469) (opt7)
ggggcgcugccuacggagguggcagccaucuccuucucggcaucaagcuuaccaugcacagcuuucccccacugcuccuguugcuguucuggggcguggucucccauaguuucgugcucaccgaggggaacccgaggugggaacagacucaccugaccuaccggaucgagaauuauacgcccgacuugccacgcgccgauguagaccaugcaauugaaaaggccuuucaacuguggagcaacgugacuccccucaccuucaccaaagucuccgagggucaggcggauaucaugauuaguuuugugaggggcgaccaccgggauaauagcccauucgacgggcccggcgguaaccuggcccaugcauuucagccagggccgggcaucggcggggaugcccacuucgacgaagaugagcgcuggacuaauaacuuuagggaguacaaucugcaccggguggcagcccaugaacucggucacucccugggcuugagccauuccaccgacauuggggcgcugauguaucccaguuacacguucagcggcgauguccagcucgcccaagacgauaucgacgguauccaggcaauuuaugggcgcucccagaacccagugcagcccaucggcccacaaacucccaaggccugcgacagcaaacugaccuuugaugccauuacuaccaucaggggcgagguaauguucuucaaggaccgguuuuacaugcgcaccaauccguucuaucccgaaguggagcugaacuuuauuagugucuucuggccacaguugcccaaugggcucgaggcagccuacgaauuugcggauagggacgaggugcgguucuuuaaagguaacaaguacugggccgugcagggccagaauguccugcacggguauccaaaggauaucuacuccagcuucggcuuuccccgcacggugaaacacauugacgcagcccuguccgaagagaacacugguaagaccuauuucuuuguagcaaauaaauacuggagguaugaugaauacaagcggaguauggacccaggcuauccgaaaaugaucgcccaugauuuccccgggaucggccacaagguggacgccgucuuuaugaaagauggguucuucuacuuuuuccaugguacucgccaauacaaguuugacccaaagaccaaaaggauucucacccugcagaaggcgaacagcugguucaacugucggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3248 - RNA, 3739 nt, Artificial Sequence
  mRNA product Design2 comprising derived and/or modified sequence from Clostridium histolyticum__BAA77453.1__ColG (opt7)
ggggcgcugccuacggagguggcagccaucuccuucucggcaucaagcuuaccaugaagaaaaacauccugaagauucucauggacagcuacuccaaagagaguaagauccagaccgugaggcgggucacuagcgugucccuguuggccguauaucugaccaugaauacgaguagccucgugcuggcaaaacccauugaaaacacuaaugauaccuccaucaagaacgucgagaaguugcgcaaugccccaaacgaagagaauagcaaaaagguggaagacuccaaaaacgauaagguggagcacgucaaaaauauugaggaagcgaagguggagcaaguagccccggaagugaaaaguaagagcacccugagguccgcaagcaucgccaacacuaauagugagaaguacgacuucgaguaucucaacggccuguccuacaccgaacugacgaaucucaucaaaaacauuaaguggaaucagaucaacgggcuguuuaacuauagcacugguucccagaaauucuuuggcgauaagaaucggguccaggcaauuaucaacgccuugcaagagagugggcgcaccuacacugcgaaugacaugaaaggcauugaaaccuucaccgaggugcugagggccgguuuuuaucucggguacuacaacgauggccugagcuaucugaaugaccggaacuuccaggauaagugcauccccgcaaugauugccauccagaagaauccaaacuuuaaauugggcacggccgugcaggacgaagucaucacuucccucgggaagcugauugguaaugcaagcgccaacgcggaggugguaaauaacugugugcccguccugaaacaauuccgcgagaaucucaaccaguacgccccagauuaugugaagggcaccgcagugaaugaacugaucaaagggauugaguuugacuucaguggcgccgcauacgaaaaggaugucaagacuaugcccugguaugguaaaaucgacccauuuauuaacgaguugaaggcccuggggcucuacggcaacaucaccuccgccaccgaaugggcgagcgacgugggcaucuauuaccugaguaaauucgggcuguacuccacuaauaggaacgauauuguacagagcuuggagaaggcaguggacauguauaaauacgguaagaucgccuucgucgccauggagcggauuacgugggauuaugacggcaucgggagcaauggcaagaaaguggaucaugacaaguuucucgaugacgcagaaaaacacuaccugccgaagaccuauacuuucgauaacgguaccuuuauuauccgcgccggcgacaaagucuccgaggaaaagaucaaaaggcuguacugggcgagucgggagguaaagagccaguuccaucgcgugguggggaaugauaaggcccucgaagugggcaacgcagacgacguccugaccaugaaaauuuuuaauucccccgaggaguauaaguucaacacuaauaucaacggggugagcacggauaaugguggcuuguacauugaaccaagggggaccuuuuacacuuaugagcggacuccccaacagaguaucuucucccuggaggaacucuuucgccacgaguacacccauuaucugcaggccagguaccuggucgacggcuuguggggucaaggcccauucuaugagaaaaaccggcucaccugguuugaugaagggacggcagaguucuuugccggcagcacccgcacuuccggggugcugcccaggaagaguauucugggcuaccucgccaaagacaagguggaucaccgguauagccugaagaaaaccuugaacuccgguuacgacgauagcgacuggauguucuacaauuauggguucgcaguagcccacuaccuguaugaaaaggauaugccgacuuuuaucaaaaugaauaaggcgauucucaacaccgacgugaaaaguuacgaugaaaucaucaagaagcuguccgacgaugccaacaaaaauacggaguaucagaaccauauucaggagcuggcagacaaguaccagggcgccgguauccccuuggucagcgacgauuaucugaaagaccacggcuacaagaaagccuccgaaguguacagugagauuagcaaggcagcgucccucaccaauacuagcgucaccgccgagaaaagucaauauuucaacacuuuuacccugagggggacguacaccggcgaaacuuccaagggggaguucaaggauugggacgaaaugagcaaaaagcucgauggcacccuggaguccuuggccaaaaauagcuggagugguuauaagacucugaccgcauacuuuacgaacuaucgcgugaccagcgacaauaaagugcaguacgauguagucuuccauggggugcucacugacaacgccgauaucuccaauaacaaggcaccaauugccaaggugaccggccccaguacuggcgcggucgggcggaauaucgaauuuagcgguaaagacuccaaggaugaggacggcaaaaucgugagcuacgacugggauuucggggacggcgccaccuccagggguaagaacagugugcacgcauauaaaaaggccgggacguacaauguaacccugaaggucacugaugacaaaggcgccaccgcaacugagagcuuuaccauugaaaucaagaacgaagauacuaccacgccaauuaccaaagagauggagcccaaugacgauaucaaggaagccaacggcccaauuguggagggggugacugucaaaggugaccugaacggcuccgaugacgcggauaccuucuauuuugacgugaaggaagauggggacguaacuaucgaguugccguacaguggcagcuccaauuucaccuggcugguguauaaagagggugacgaucagaaccacaucgccagcgggauugacaagaauaacaguaaggucggcacguucaaauccaccaagggccgccauuacguguuuaucuauaaacacgauagcgcauccaauauuagcuacagucucaacaucaaggggcuggguaaugaaaaacucaaggagaaggaaaacaaugacuccagcgauaaagccacugugauucccaacuucaauaccacuaugcagggcagucuguugggggacgauucccgggacuacuauagcuuugaggucaaggaagagggcgaggugaacaucgaacuggauaaaaaggacgaguucgguguaaccuggacgcugcauccagaauccaauauuaacgauaggaucaccuacgggcaaguggacggcaauaaagucagcaacaaggugaagcuccgccccggcaaauauuaccuguugguguauaaguacagugggagcgguaacuaugagcugcgggucaauaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3249 - RNA, 3463 nt, Artificial Sequence
  mRNA product Design2 comprising derived and/or modified sequence from Clostridium histolyticum__BAA77453.1__HsALB(1-18)_ColG(111-1118) (opt7)
ggggcgcugccuacggagguggcagccaucuccuucucggcaucaagcuuaccaugaagugggugaccuucaucagccugcucuuucuguucuccagugccuacagcauugcaaacacuaauuccgagaaauaugacuuugaauacuugaacggccugaguuauaccgagcucacgaaucugaucaagaacauuaaauggaaucagaucaacggguuguucaauuacagcacugguucccaaaaguuuuucggcgauaaaaacaggguccaggccauuaucaaugcgcugcaggaaagcgggcggaccuauaccgccaacgacaugaagggcaucgagacuuuuaccgaagugcuccgcgcagguuucuaccugggguauuacaaugauggccuguccuaccucaacgacaggaauuuucaggauaagugcauucccgccaugaucgcaauucagaaaaacccaaauuucaagcugggcacggccguacaggacgaggugaucacuagcuuggggaaacugauugguaacgcgagcgccaacgcagaggucgugaauaacugugugccgguccucaagcaguuucgggaaaaucugaaccaguaugcccccgauuacgugaaaggcaccgccguaaaugagcugaucaaggggauugaguucgacuucuccggcgcagccuaugaaaaagaugugaagacuaugccaugguacgguaagaucgaccccuuuaucaacgaguugaaagcgcucgggcuguauggcaauauuaccagcgccaccgaaugggcaagugaugucggcaucuacuaucuguccaaguucgggcucuacagcacgaaccgcaaugacauugugcaaucccuggagaaagccguggauauguacaaguaugguaaaaucgcauuugucgccauggaaaggauuacuugggacuacgacggcaucgggaguaacggcaagaagguggaucacgacaaauucuuggaugacgccgagaagcauuaucugccaaaaaccuacacuuuugauaaugguaccuucaucauucgggcgggcgacaagguaagcgaagagaaaaucaagcgccucuauugggcauccagggaggugaagagucaguuucaccgggucguggggaacgauaaagcccuggaagugggcaaugccgacgauguccugaccaugaagauuuucaacagucccgaggaauacaaauuuaauacuaacaucaacgggguguccacggacaaugguggcuuguauauugagccacgcgggaccuucuacacuuacgaaaggaccccgcagcagagcaucuuuagucucgaggagcuguuccggcaugaauauacccacuaccugcaagcacgcuaucucguagauggccuguggggucagggccccuuuuacgagaagaacagguugacuugguucgacgaagggacggccgaguucuuugcgggcuccacccggacuagcggggugcugccacgcaaaagcauccucggcuaucuggccaaggacaaggucgaucauagguacucccugaaaaagaccuugaauagugguuaugacgauagcgacuggauguucuacaacuacggguuugcaguggcccacuaucucuacgaaaaagauaugcccaccuucauuaagaugaauaaagcaauccugaacacugacgucaaguccuaugaugagauuaucaaaaagcugagcgacgaugccaauaagaacacggaguaccagaaucacauucaagaacucgccgacaaauaucagggcgcagguaucccacuggugagugaugacuacuugaaggaucauggcuauaaaaaggccuccgagguguacagcgaaauuuccaaagcggccagucugaccaacacuagcguaaccgcagagaagucccaguacuuuaauacuuucacccuccgggggacguauaccggcgagacuagcaagggggaauuuaaagacugggacgagaugaguaagaaacuggauggcacccuggaauccuuggccaagaacagcugguccgguuacaaaacucugaccgccuauuucacgaauuaccgcgugaccagugacaacaagguccaguaugauguggucuuucacggggugcucacugacaaugcagauaucagcaacaacaaggcgcccaucgccaaagugaccggcccguccacuggcgcaguagggaggaauauugaguucagcgguaaggacaguaaagaugaagacggcaagaucguguccuacgauugggacuuuggggauggcgccaccagccgggguaaaaacuccguccaugccuacaagaaagcagggacguauaaugugacccugaaggucacugacgacaagggcgccaccgcgacugagagcuucaccauugagaucaaaaacgaagauacgaccacucccauuaccaaggagauggaaccaaaugacgauaucaaagaggccaacggccccaucguggaaggggugacuguaaagggugaccucaauggcagugaugacgcagauaccuucuacuuugacgucaaagaggauggggacgugacuauugagcugccauauagcggcuccaguaacuucaccugguugguguacaaggaaggugaugaccaaaaucacaucgccagcgggauugauaagaacaauuccaaagucggcacguuuaagagcaccaaaggcaggcacuauguguucaucuacaagcaugacuccgccaguaacauuagcuauucccugaauaucaaagggcucgguaacgagaagcugaaggaaaaagagaauaacgacaguagcgauaaggcaacugugauccccaacuuuaauaccacuaugcagggcucccuguugggggacgauagccgcgacuacuacaguuucgaaguaaaagaggagggcgaagucaacauugagcuggauaagaaagacgaauuuggugugaccuggacgcuccacccagaguccaauaucaacgaucggauuaccuaugggcaaguggacggcaauaaggucagcaacaaagugaagcugaggccgggcaaguacuaucuccugguauacaaauauuccgggagcgguaauuacgaguugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3250 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt7)
ggggcgcugccuacggagguggcagccaucuccuucucggcaucaagcuuaccaugaagugggugaccuucaucagccugcucuuucuguucuccagugccuacagcaugaaaaagaacauuuugaaaauccugauggacuccuauaguaaggagagcaaaauucagacugucaggcgggugaccuccguaagccuccuggcaguguacuugacgaugaauacuuccagucugguccucgccaagcccaucgaaaacaccaaugauaccagcauuaagaacguggagaaacugcgcaaugcgccaaacgaagaaaauuccaagaaaguggaagacagcaagaacgauaaagucgagcacgugaagaauaucgaggaagccaaaguagagcaaguggcaccggaagucaagaguaaguccacucugaggagcgccucccggcgcaggcggaaacgcaucgcaaacaccaauagugagaaguaugacuuugaguaccucaacggccugagcuauacggaauugacuaaucugauuaaaaacaucaaguggaaucagauuaacggucucuucaacuacuccaccgggagccagaaauuuuucggcgauaagaauagggugcaggccaucauuaacgcgcugcaagagagugggcggacuuauaccgccaaugacaugaagggcaucgaaaccuuuacggaggugcugcgcgcagguuucuacuugggguacuauaacgauggccucuccuaccugaaugacaggaacuuucaggauaaaugcauucccgccaugaucgccauccagaagaauccaaacuucaaacugggcacugcaguccaggacgaagugauuaccagccucgggaagcugaucgguaaugccagugcgaacgccgagguagugaauaacuguguccccguguugaaacaauuucgggagaaucugaaccaguaugcaccagauuacgugaagggcacugccgucaaugaacucauuaaggggaucgaguucgacuucuccggcgcagccuaugaaaaagaugugaagaccaugcccugguacgguaaaauugacccauuuaucaacgagcugaaggcccugggguuguauggcaacaucaccagcgcgacugaaugggcaagcgacguaggcauuuacuaccucuccaaauucgggcuguauaguacgaaucgcaacgauaucgugcagagccuggagaaggccgucgacauguacaaguaugguaaaauugccuuuguggcaauggagaggaucaccugggauuacgacggcauuggguccaauggcaagaaagucgaucaugacaaguuccucgaugacgccgaaaaacacuaucugccgaagacuuacaccuuugauaacgguaccuucaucauccgggcgggcgacaaagugagcgaggaaaagauuaagcgcuuguauugggccaguagggaggugaaaucccaguuucaucggguaguggggaaugauaaggcacuggaagucggcaacgccgacgacgugcucacuaugaaaaucuucaauagccccgaggaguacaaguuuaacacgaauauuaacggggucuccaccgauaaugguggccuguacaucgaaccacgcgggacuuucuauaccuacgagaggacuccccaacagaguauuuuuagccuggaagaguuguuccggcacgaguauacccauuaccuccaggcaagguaucugguggacggccuguggggucaaggcccauuuuacgagaaaaaccgccucacgugguucgaugaggggaccgccgaguucuuugccggcuccacucggaccagcggggugcugcccaggaagaguaucuugggcuaucuggcaaaggacaaaguagaucaccgcuacucccucaagaaaacucugaauagcgguuacgacgauuccgacuggauguucuauaacuacggguuugccguggcgcacuaucuguacgaaaaggauaugccgaccuucauuaaaaugaauaaggccaucuugaacacggacgucaagaguuaugaugaaaucauuaaaaagcugagcgacgaugcaaacaaaaauaccgaguaccagaaccauauccaggagcucgccgacaaguaucagggcgccgguauuccccugguguccgacgauuaccucaaagaccacggcuacaagaaagcaagcgaagucuauagugagaucuccaaggcggccagccugacuaauaccuccgugacugcagaaaagagccaauacuuuaacaccuucacguugcgggggaccuauacuggcgagaccaguaaaggggaauuuaaggauugggacgagaugagcaaaaagcuggauggcacucucgagucccuggccaaaaauaguuggagcgguuacaagacccugacggccuauuucaccaacuacagggugacuuccgacaauaagguacaguacgaugucguguuucaugggguguugaccgacaacgcagauauuagcaauaacaaagccccaaucgcgaaggucacuggccccuccaccggcgccguggggcgcaauaucgaguucagugguaaagacagcaaggaugaagacggcaaaauuguguccuaugacugggauuuuggggacggcgcaacgagucgggguaagaacagcguacacgccuacaagaaagccgggaccuauaaugucacucugaaggugaccgaugacaaaggcgcaacugccaccgaauccuucacuaucgagauuaagaacgaagauaccacgaccccaaucacuaaagagauggagcccaaugacgauauuaaggaagcgaacggcccaaucguggagggggucaccgugaaaggugaccucaacggcagcgaugacgccgauacuuucuacuuugacguaaaggaagauggggacgugaccaucgagcugccguauaguggcuccagcaauuucacguggcucgucuacaaggagggugacgaucagaaccacauugcauccgggaucgacaaaaauaacagcaaggugggcaccuuuaaaaguacuaagggcaggcauuauguguucauuuacaaacacgauuccgccagcaauaucaguuacucccugaacauuaagggguuggguaaugaaaagcugaaagagaaggaaaacaaugacagcuccgauaaagcaaccgucauccccaacuuuaauacuaccaugcagggcagccugcucggggacgauagucgggacuauuacagcuucgaggugaaggaagagggcgagguaaacauugaacuggauaaaaaggacgaguuuggugugacguggaccuugcauccagaauccaauaucaacgaucgcaucacuuaugggcaagucgacggcaauaaggugaguaacaaagugaagcugaggcccggcaaauacuaucuccuggucuacaaguauagcggguccgguaacuacgagcuccgggugaauaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3251 - RNA, 3487 nt, Artificial Sequence
  mRNA product Design2 comprising derived and/or modified sequence from Clostridium histolyticum__BAA34542.1__ColH (opt7)
ggggcgcugccuacggagguggcagccaucuccuucucggcaucaagcuuaccaugaacuuccugaagaucauucucaauaggggcaaaaccaugaagcggaaaugccugagcaagcgcuugaugcuggccaucacuauggcaaccauuuuuacggugaacuccacucuccccaucuacgccgcggucgacaaaaauaacgccaccgcagccgugcagaaugagaguaagagguauaccguaagcuaccugaagacuuugaacuauuacgaucugguggaccuccuggucaaaaccgaaauugagaaucugccagaucucuuccaauauuccagugacgcaaaggaauuuuacgggaacaaaacgcggaugagcuucaucauggaugagaucggucgcagggccccgcaguauacugaaauugaccacaagggcauccccacccugguggaggugguccgggcgggguuuuacuugggcuuccauaauaaagagcugaacgaaauuaauaagcgcuccuuuaaagagagggugaucccaagcauucucgccauccagaagaaccccaauuucaagcuggguacugaaguacaggauaaaauuguguccgcaaccgggcuguuggccggcaacgagaccgccccacccgaggucgugaauaacuuuacgccaauccuccaagacuguaucaagaacauugaucgguacgcacuggacgaucugaaaaguaaggcccucuucaaugugcuggcggccccgacuuaugacaucaccgaauacuugcgcgcaacuaaagagaagcccgaaaacaccccaugguauggcaagauugauggguuuaucaaugagcugaaaaagcucgcccuguacgguaaaauuaacgacaauaacagcuggaucaucgacaauggcauuuaucacaucgcaccccuggggaaguugcauuccaacaauaaaauuggcaucgaaacccucacugaggucaugaagguguacccauaucugagcaugcagcaucugcagagugccgaucagauuaagaggcacuacgacuccaaagaugccgaggguaacaagaucccccucgacaaauucaagaaagaagggaaggagaaguacugcccgaaaacguauaccuucgaugacggcaagguaaucauuaaagcgggcgcacggguggaagaggaaaaggucaaacgccuguacugggccagcaaggaggugaauagucaauuuuucaggguguaugggaucgauaaacccuuggaggaagguaacccagacgauauucugacuauggucaucuacaauagucccgaggaauauaagcucaacagcgugcuguacggcuaugacaccaauaacgggggcauguacauugagccagaagguaccuuuuucacuuacgagcgggaggcccaggaauccacguauacccuggaggaauuguuucgccacgaguacacucacuaucuccagggcagguacgcaguacccgggcaguggggccggaccaagcuguaugauaacgaccgccugaccugguacgaggaagggggugccgaacucuucgcgggcagcacuaggacgagugggauccugccacggaaauccauugugagcaauauccauaacaccacuaggaauaaccgcuauaaguugagugacaccguccacuccaaauacggcgccagcuuugaguucuacaauuaugcauguauguuuauggauuacauguauaacaaggacauggguauccugaauaaacucaacgaucuggccaagaauaacgacguggauggcuacgacaauuauauucgggaucugagcuccaacuacgcauugaaugacaaguaucaagaucauaugcaggagaggaucgacaacuacgaaaaucugacugucccguucguggccgaugacuaccucgugcgccacgccuauaaaaaccccaacgagauuuacagugagaucagcgaaguagcaaagcugaaagaugccaaguccgaggugaaaaagagccaguauuuuaguaccuucacgcuccggggguccuacaccggcggggcgagcaagggcaaacuggaagaccaaaaggccaugaauaaauuuauugacgauuccuugaagaaacuggacacuuauaguuggagcgguuacaagacccucacugcauacuucaccaacuauaaagucgauuccagcaauagggugacguacgacgucguguuccacggguaucugccaaacgagggcgauaguaaaaauucccugcccuacgguaagaucaacggcaccuauaaggggacugaaaaggagaaaaucaaguuuagcuccgagggcaguuucgacccagaugggaaaauugugagcuacgaaugggacuuuggcgaugguaauaaguccaacgaggaaaaucccgagcauagcuaugacaagguagggaccuacacugugaaauugaaggucaccgaugacaaaggcgaaaguuccgugagcacgaccacugccgagaucaaggaccuguccgagaacaaacucccggucauuuacaugcacgugccaaagagcggcgcccugaaucagaaggugguauucuaugggaaagguaccuacgaucccgacggcaguaucgcaggguaucagugggauuuuggcgacgguagcgauuucuccagugaacagaaccccagccaugucuacacuaagaaaggggaguauaccgugacgcuccgcgugauggacuccagcggccaaauguccgaaaagaccaugaaaauuaagaucacugauccagucuaccccaucggcaccgagaaagagccaaauaacaguaaggaaacugcgagcgggccgauugugcccgguaucccaguguccggcaccauugagaauacuuccgaccaggauuauuuuuacuucgacguaaucacccccggggaagucaagauugauaucaacaaacugggcuacgguggggccacgugggugguguaugacgagaacaauaacgcagucagcuacgccaccgaugacggccagaauuuguccggcaaguuuaaagccgacaagccagggcgguauuacauucaccuguauauguucaacgguagcuacaugcccuauaggaucaauaucgaaggcaguguggggcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3252 - RNA, 3448 nt, Artificial Sequence
  mRNA product Design2 comprising derived and/or modified sequence from Clostridium histolyticum__BAA34542.1__ColH (opt7)
ggggcgcugccuacggagguggcagccaucuccuucucggcaucaagcuuaccaugaagaggaaaugccugagcaagcggcucaugcuggccaucaccauggcaacuauuuucaccgugaacuccacguugcccaucuacgccgcggucgacaaaaauaacgccacugcagccgugcagaaugagaguaagcgcuauaccguaagcuaccugaaaacccucaacuauuacgaucugguggacuugcuggucaagacugaaauugagaaucucccagaucuguuucaauauuccagugacgcaaaggaguucuacggcaacaaaaccaggaugagcuuuaucauggaugaaauugggcggcgcgccccgcaguauacggaaaucgaccacaaggguauccccacucugguggagguggucagggcgggcuucuaccucggguuucauaauaaagagcugaacgaaauuaauaagcgguccuucaaagagcgcgugaucccaagcauuuuggccauccagaagaaccccaauuuuaaacugggcaccgaaguacaggauaagauuguguccgcaacuggucuccuggccgggaacgagaccgccccacccgaggucgugaauaacuucaccccaauccugcaagacuguauuaagaauaucgauagguacgcauuggacgaucucaaaaguaaggcccuguuuaacgugcuggcggccccgacguaugacaucacugaauaccuccgggcaaccaaagagaagcccgaaaacacuccaugguauggcaaaauugauggcuucaucaaugagcugaagaaguuggcccuguacgggaaaauuaacgacaauaacagcuggaucauugacaaugguaucuaucacaucgcaccccucggcaagcugcauuccaacaauaaaauugggaucgaaacccugaccgaggucaugaagguguacccauauuugagcaugcagcaccuccagagugccgaucagauuaaacgccauuacgacuccaaggaugccgagggcaacaagaucccccuggacaaauuuaagaaagaagguaaggagaaauacugcccgaagacuuauacguucgaugacgggaagguaauuaucaaagcgggcgcaaggguggaagaggaaaaggucaaacggcuguacugggccagcaaggaggugaauagucaauucuuucgcguguauggcaucgauaaaccccucgaggaagggaacccagacgauauucugaccauggucaucuacaauagucccgaggaauauaaguugaacagcgugcuguacgguuaugacacuaauaacggcgggauguacauugagccagaaggcaccuucuuuaccuacgagagggaggcccaggaauccacuuauacgcucgaggaacuguuccggcacgaguacacccacuaucugcagggucgcuacgcaguacccggccagugggggaggacuaaauuguaugauaaugaccggcucaccugguacgaggaaggcggggccgagcuguuugcggguagcacccgcacuuccggcauccugccaaggaaguccauugugagcaacauccauaacacgacccggaauaacagguauaagcucagugacacuguccacuccaaauacggggccagcuucgaauuuuacaauuaugcauguauguucauggauuacauguauaacaaggacaugggcauucugaauaaauugaacgaucuggccaagaauaacgacguggaugguuacgacaauuauauccgcgaucucagcuccaacuacgcacugaaugacaaauaucaagaucauaugcaggagcggaucgacaacuacgaaaaucugaccgucccguuuguggccgaugacuacuuggugaggcacgccuauaagaaccccaaugagauuuacagugagaucagcgaaguagcaaagcugaaagaugccaaguccgaggugaaaaagagccaguauuucaguacuuuuacccuccgcggcuccuacacgggcggcgcgagcaaagggaagcuggaagaccaaaaggccaugaacaaauucauugacgauucccucaagaaacuggacaccuauaguuggagcggcuacaagacuuugaccgcauacuuuacuaacuauaaagucgauuccagcaaucgggugaccuacgacgucguguuccacgguuaucugccaaacgagggggauaguaaaaauucccuccccuacggcaagaucaacgguacguauaagggcaccgaaaaggagaaaauuaaguucagcuccgaggggaguuuugacccagauggcaaaaucgugagcuacgaaugggacuucggggauggcaauaaguccaacgaggaaaaucccgagcauagcuaugacaaaguagguacuuacaccgugaagcugaaggucacugaugacaaaggggaaaguuccgugagcaccacgaccgccgagaucaaggaccuguccgagaacaaauugccggucauuuacaugcacgugccaaagagcggcgcccugaaucagaaagugguauuuuauggcaaggggacuuacgaucccgacgguaguaucgcaggcuaucagugggauuucggggacggcagcgauuuuuccagugaacagaaccccagccaugucuacaccaagaaaggugaguauacugugacccucagggugauggacuccagcgggcaaauguccgaaaagacgaugaaaauuaagaucaccgauccagucuaccccauuggcacugagaaagagccaaauaacaguaaggaaaccgcgagcggcccgaucgugcccgggaucccaguguccgguacuauugagaauaccagugaccaggauuauuucuacuuugacguaaucacucccggcgaagucaaaauugauaucaacaagcugggguacggcggugccaccugggugguguaugacgagaauaacaacgcagucagcuacgccacggaugacgggcagaaucucuccggcaaguucaaagccgacaagccaggccgcuauuacauucaccuguauauguuuaacgggagcuacaugcccuaucggaucaauauugaagguaguguggggaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3253 - RNA, 3382 nt, Artificial Sequence
  mRNA product Design2 comprising derived and/or modified sequence from Clostridium histolyticum__BAA34542.1__HsALB(1-18)_ColH(41-1021) (opt7)
ggggcgcugccuacggagguggcagccaucuccuucucggcaucaagcuuaccaugaagugggugaccuucaucagccugcucuuucuguucuccagugccuacagcguccagaacgaguccaaaagguauacugugaguuacuugaagacccugaauuauuacgaccucguagaucuguuggugaaaacggaaauugagaaccugcccgaccucuuucaauauagcuccgaugcaaaggaguucuacggcaauaaaacucggaugagcuuuaucauggacgaaauugggcgcagggccccacaguauaccgaaaucgaucacaaggguauuccgacccuggucgagguggugcgggcgggcuucuaccugggguuucauaacaaggagcucaaugaaaucaacaaacgcuccuucaaggagagggucauccccaguauucuggccauccagaaaaauccaaacuuuaaguugggcacugaagugcaggacaaaauuguaagcgcaaccggucugcucgccgggaaugagacggcacccccagagguggucaacaauuucacucccauccugcaagauugcauuaagaacaucgaccgguacgcccuggaugacuugaaauccaaggcgcucuuuaaugugcuggccgcaccaaccuaugauauuacugaauaccugcgcgccaccaaggagaaaccggaaaacacccccugguauggcaagaucgacggcuucaucaaugagcucaaaaagcuggccuuguacgggaaaauuaacgauaacaauagcuggaucauugacaacgguaucuaucacauugcaccacugggcaagcuccauaguaauaacaagaucgggaucgaaacgcugacugaggugaugaaagucuaccccuaucuguccaugcagcacuugcagagcgccgaccagauuaagaggcauuacgauuccaaagacgcggagggcaauaagaucccacucgauaaauucaagaaggaagguaaagagaaguacugucccaaaaccuauacuuuugacgaugggaaggugauuaucaaagccggcgcacggguagaagaggaaaaggugaagcgccuguacugggccaguaaagaggucaacagccaauucuuuaggguguauggcauugacaagccgcuggaggaagggaaucccgaugacauccucaccauggugaucuacaacuccccagaggaauauaaacugaauagcgucuuguacgguuaugauaccaacaauggcgggauguacauugagcccgaaggcacuuucuuuacguacgagcgggaggcacaggaaaguaccuauacucuggaggaacucuuccgccacgaguacacccacuaucugcaggguagguacgccgugccaggccagugggggcggaccaagcuguaugacaacgaucgcuugacuugguacgaggaaggcggggccgagcucuuugcggguuccacgaggaccagcggcauccugccccggaaaaguauuguauccaauauccauaacacuacccgcaauaacagguauaagcugagcgacaccgugcacagcaaauacggggcauccuucgaauuuuacaacuaugccugcauguucauggacuacauguauaauaaggauaugggcauucucaacaagcugaaugacuuggccaaaaacaaugaugucgacgguuacgauaacuauauccgggaccugaguagcaauuacgcacucaacgauaaguaucaagaccauaugcaggagaggauugauaauuacgaaaaccugacugugccauuugucgccgacgauuaccuggugcgccacgcguauaaaaauccgaacgagaucuacuccgagaucagcgaaguggccaaguugaaagacgcaaagagugagguaaagaaaucccaguauuucagcacguuuacccugcggggcuccuacacugggggcgccaguaaggggaaacucgaagaucaaaaggcaaugaauaaauucauugacgacagccugaagaagcucgauaccuauuccuggagcggcuacaaaacucugaccgccuacuucacgaacuauaagguggacaguuccaauagggucaccuacgauguggucuuucacgguuauuugcccaacgagggggacagcaaaaacucccugccauacggcaagaucaaugguacuuauaaaggcaccgaaaaggagaaaauuaaguucaguagcgagggguccuuugaucccgacggcaagaucgugagcuacgaaugggauuucggggacggcaacaaaaguaaugaggaaaacccagagcauuccuaugauaagguggguacuuacaccguaaaacucaaggugacggacgauaaaggggaaagcuccgucagcaccacuaccgccgagauuaaggaccugagugagaauaagcugcccgugaucuacaugcacgucccgaaaagcggcgcauugaaccagaaggugguguuuuauggcaaagggacuuacgacccagaugguuccaucgccggcuaucagugggacuucggggauggcagugacuuuagcuccgaacagaaucccagccauguauacaccaagaaaggugaguauacggucacccugcgcgugauggauuccagugggcaaaugagcgaaaagacuaugaagauuaaaaucaccgaccccguguacccaauuggcacugagaaggagcccaacaauuccaaagaaaccgcgaguggcccaaucgucccggggauucccgugagcgguacgaucgagaacaccuccgaucaggacuauuucuacuuugaugugaucacuccaggcgaaguaaagauugacaucaauaaacucggguacggcggugccaccugggucguguaugaugagaacaauaacgcagugagcuacgccacugacgaugggcagaaucugaguggcaaguucaaagccgacaagcccggccgguauuacauucaccucuauauguuuaacggguccuacaugccauauaggaucaacauugaagguagcgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3254 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt7)
ggggcgcugccuacggagguggcagccaucuccuucucggcaucaagcuuaccaugaagugggugaccuucaucagccugcucuuucuguucuccagugccuacagcaugaaaaggaagugcuuguccaaacggcugaugcucgcaauuacuauggccaccaucuuuacggucaacaguacucugcccauuuaugcggccguggacaagaauaacgcaaccgccgcacgcaggcggcgcaaaaggguacagaaugagagcaagcgguacaccguguccuauuugaagacucugaacuacuaugaucucgucgaccugcuggugaaaaccgaaaucgagaaucucccagaucuguuccaauacagcuccgacgccaaggaauuuuauggcaacaaaacgcgcaugaguuucauuauggaugagaucgggaggcgggcgccgcaguacacugaaaucgaccacaaggguauucccaccuugguggaggucgugcgcgccggcuuuuaccugggguuccauaauaaagagcucaacgaaaucaauaagaggagcuuuaaagagcggguaauuccauccauccuggcaauucagaagaaccccaauuucaagcugggcacugaagugcaggauaaaaucgucagcgccaccgguuugcucgccgggaacgagaccgcaccacccgagguggugaauaacuuuacgccaauucugcaagacuguaucaagaauaucgaucgcuaugcccuggacgaucucaaaaguaaggcgcuguucaacgucuuggccgcaccgacuuacgacauuaccgaauaucugagggccacuaaagagaagcccgaaaacaccccaugguacggcaagaucgauggcuucauuaaugagcucaaaaagcuggcacuguaugggaaaaucaacgacaauaacuccuggauuaucgacaaugguaucuaccacauugcccccuugggcaagcuccauagcaacaauaaaaucgggauugaaacccugacugaggugaugaagguauauccauaccuguccaugcagcaccuccagagugccgaucagaucaagcggcauuacgacagcaaagaugcggagggcaacaagauuccccuggacaaauuuaagaaagaagguaaggagaaguauugcccgaaaacguacaccuucgaugacgggaaggugaucaucaaagcaggcgcccgcgucgaagaggaaaaggugaaaagguuguauugggccuccaaggaggugaauagccaauuuuuccgggucuacggcauugauaaaccccuggaggaagggaacccagacgauauccucacuauggugauuuauaauagucccgaggaauacaagcugaacuccguacuguaugguuacgacaccaauaacggcgggauguacaucgagccagaaggcaccuuuuucacuuaugagcgcgaggcacaggaaagcacguacaccuuggaggaacucuuuaggcacgaguauacucacuaccugcagggucgguaugccgugcccggccagugggggaggaccaagcuguacgauaaugaccgccucaccugguaugaggaaggcggggcggagcuguucgccgguaguacucggacguccggcauuuugccaaggaaaagcaucgucagcaacauucauaacaccacucgcaauaaccgguacaagcuguccgacaccgugcacaguaaauacggggcgagcuuugaguucuauaauuacgccuguauguuuauggauuauauguacaacaaggacaugggcauccucaauaaacugaacgaucuggcaaagaauaacgacgucgaugguuaugacaauuacaucagggauuuguccagcaacuaugcccugaaugacaaguaccaagaucauaugcaggaacgcauugacaacuacgaaaaucucacugugccguucguggccgaugacuaucugguacggcacgcauacaaaaaccccaaugagaucuauagugagauuuccgaaguggccaagcucaaagaugcaaagagcgaggucaaaaagucccaguacuuuaguaccuucacgcugaggggcagcuauaccgggggcgccuccaaggggaaauuggaagaccaaaaggcaaugaacaaauucaucgacgauagccugaagaaacucgacacuuacaguugguccggcuacaagacccugacugccuauuuuaccaacuacaaaguggauagcuccaaucgggucacguaugacgugguguuccacgguuaccugccaaacgagggggauaguaagaauagcuugcccuauggcaagauuaacgguaccuacaaaggcacugaaaaggagaaaaucaaguuuuccagcgaggggaguuucgacccagauggcaaaaucguauccuaugaaugggacuuuggggauggcaauaagagcaacgaggaaaaucccgagcauuccuacgacaagguggguaccuacacugucaaacugaaggugaccgaugacaaaggggaaagcagugucagcacgaccacugccgagauuaaggaccucuccgagaacaaacugccggugaucuauaugcacgugccaaagaguggcgcacucaaucagaagguagucuucuacggcaaagggaccuaugaucccgacgguagcauugcgggcuaccagugggauuuuggggacggcuccgauuucagcuccgaacagaaccccagucauguguauacuaagaaaggugaguacaccgugacgcugcgcgucauggacagcuccgggcaaaugagugaaaagaccaugaaaaucaagauuacugauccaguguaucccaucggcaccgagaaagagccaaauaacagcaaggaaacugccuccggcccgaucgugcccgggauuccaguaagcgguaccaucgagaauaccagugaccaggauuacuuuuacuucgacgucauuacucccggcgaagugaagaucgauauuaacaaauugggguauggcggugcaacguggguggucuacgacgagaauaacaacgccguguccuaugccaccgaugacgggcagaaucugagcggcaaguuuaaagcagacaagccaggcagguacuauauccaccuguacauguucaacggguccuauaugcccuaccggauuaauaucgaagguagcguaggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3255 - RNA, 958 nt, Artificial Sequence
  mRNA product Design2 comprising derived and/or modified sequence from Homo sapiens__NP_001133.1__HsAMELX (opt7)
ggggcgcugccuacggagguggcagccaucuccuucucggcaucaagcuuaccaugggcaccuggauccuguucgccugccuccugggggcagccuuugcgaugcccuugccaccgcaccccggucauccaggcuacauuaacuucagcuaugaggugcugacuccccucaagugguaccaguccaucaggccacccuauccaaguuacggguaugaaccgaugggcgguuggcugcaccaucaaauuauccccgucuugagccagcagcacccacccacccauacgcugcagccacaccaccauauucccgugguaccggcccaacagcccgugaucccacagcagcccaugaugccaguccccgggcaacacuccaugacuccaauccagcaucaccagccgaaucugcccccacccgcacagcaaccauaccagccccagccggugcaaccacagccccaccagcccaugcagccacaacccccagugcauccgaugcagccccucccaccccagccaccccugccgccaauguuucccaugcagccacugcccccgaugcuccccgacuugacccuggaggccuggccaaguaccgauaaaacuaagcgggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3256 - RNA, 517 nt, Artificial Sequence
  mRNA product Design2 comprising derived and/or modified sequence from Homo sapiens__NP_001133.1__HsAMELX-TRAP (opt7)
ggggcgcugccuacggagguggcagccaucuccuucucggcaucaagcuuaccaugccccugccaccgcaccccggccauccaggguacaucaacuucagcuaugaggugcucaccccacugaagugguaccaguccauuaggccacccuaucccaguuacgguuaugaaccgaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3257 - RNA, 550 nt, Artificial Sequence
  mRNA product Design2 comprising derived and/or modified sequence from Homo sapiens__NP_001133.1__HsAMELX-LRAP (opt7)
ggggcgcugccuacggagguggcagccaucuccuucucggcaucaagcuuaccaugccccugccaccgcaccccggccauccaggguacaucaacuucagcuaugaggugcucacuccccugaagugguaccaguccauuaggccacccccaauguugccggaccugacccucgaagccuggcccaguaccgauaaaacgaagcgggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3258 - RNA, 589 nt, Artificial Sequence
  mRNA product Design2 comprising derived and/or modified sequence from Homo sapiens__NP_001133.1__HLA-A2-SP_HsAMELX(17-60) (opt7)
ggggcgcugccuacggagguggcagccaucuccuucucggcaucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguauucggcccccauauccgagcuacggcuaugaacccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3259 - RNA, 622 nt, Artificial Sequence
  mRNA product Design2 comprising derived and/or modified sequence from Homo sapiens__NP_001133.1__HLA-A2-SP_HsAMELX(17-47,168-191) (opt7)
ggggcgcugccuacggagguggcagccaucuccuucucggcaucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguauucggcccccaccgaugcuccccgaccugacucuggaagcauggccaagcaccgauaaaaccaagcgcgaggaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3260 - RNA, 961 nt, Artificial Sequence
  mRNA product Design2 comprising derived and/or modified sequence from Homo sapiens__NP_001134.1__HsAMELY (opt7)
ggggcgcugccuacggagguggcagccaucuccuucucggcaucaagcuuaccaugggcaccuggauccuguucgccugccucgugggggcagccuuugcgaugccccugccaccgcaccccggucauccaggcuacauuaacuucagcuaugaggucuugacuccccugaagugguaccaguccaugaucaggccacccuauaguagcuacggguaugaaccaaugggcgguuggcuccaccaucaaauuaucccggugguaucccagcagcacccccugacccauacguugcagagucaccaccauauuccagugguccccgcccaacagccacgggugcgccagcaggcacugaugcccgugccggggcaacagagcaugacucccacccagcaccaucagccaaaucucccccugccagcccaacagcccuuucagccacaaccgguccagccccagccacaccagcccaugcaaccacagcccccggugcagccaaugcagccccugcucccccaaccaccccugccaccgauguuccccuugaggccacugcccccaauccuccccgaccugcaccuggaggcauggccggccaccgauaaaacuaagcaggaagagguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3261 - RNA, 520 nt, Artificial Sequence
  mRNA product Design2 comprising derived and/or modified sequence from Homo sapiens__NP_001134.1__HsAMELY-TRAP (opt7)
ggggcgcugccuacggagguggcagccaucuccuucucggcaucaagcuuaccaugccccugccaccgcaccccggccauccaggguacaucaacuucagcuaugaggugcucaccccacugaagugguaccaguccaugauuaggccacccuauaguagcuacgguuaugaacccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3262 - RNA, 553 nt, Artificial Sequence
  mRNA product Design2 comprising derived and/or modified sequence from Homo sapiens__NP_001134.1__HsAMELY-LRAP (opt7)
ggggcgcugccuacggagguggcagccaucuccuucucggcaucaagcuuaccaugccccugccaccgcaccccggccauccaggguacaucaacuucagcuaugaggugcucacuccccugaagugguaccaguccaugauuaggccacccccaaucuugccggaccugcaccucgaagccuggcccgcaaccgauaaaaccaagcaagaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3263 - RNA, 592 nt, Artificial Sequence
  mRNA product Design2 comprising derived and/or modified sequence from Homo sapiens__NP_001134.1__HLA-A2-SP_HsAMELY(17-61) (opt7)
ggggcgcugccuacggagguggcagccaucuccuucucggcaucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguaugauucggcccccauauagcuccuacggcuaugaaccgaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3264 - RNA, 625 nt, Artificial Sequence
  mRNA product Design2 comprising derived and/or modified sequence from Homo sapiens__NP_001134.1__HLA-A2-SP_HsAMELY(17-48,169-192) (opt7)
ggggcgcugccuacggagguggcagccaucuccuucucggcaucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguaugauucggcccccaccgauccuccccgaccugcaccuggaagcauggccagccacugauaaaaccaagcaggaggaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3265 - RNA, 952 nt, Artificial Sequence
  mRNA product Design2 comprising derived and/or modified sequence from Sus scrofa__NP_999071.1__SsAMELX-001-1 (opt7)
ggggcgcugccuacggagguggcagccaucuccuucucggcaucaagcuuaccaugggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccauauaccaguuacggguaugaacccaugggcgguuggcugcaucaccaaauuaucccagucgugagccagcagacgccgcagucccaugcguugcaaccccaccaccauauuccaaugguacccgcccagcagccagggaucccccagcaaccgaugaugccccugccaggccagcacaguaugacucccacccagcaucaccagccaaaccucccccugccagcacaacagccguuucagccccaaccagugcagccccagccacaccagccccugcaaccgcagagcccaaugcaucccauccagccccuccugccacagcccccauugccgcccauguucuccaugcaaagccugcucccagaccugccccuggaggccuggccagcaaccgauaaaacuaagcgggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3266 - RNA, 520 nt, Artificial Sequence
  mRNA product Design2 comprising derived and/or modified sequence from Sus scrofa__NP_999071.1__SsAMELX-TRAP (opt7)
ggggcgcugccuacggagguggcagccaucuccuucucggcaucaagcuuaccaugccccugccaccgcaccccggccauccaggguacaucaacuucagcuaugaggugcucacuccccugaagugguaccagaauaugauuaggcacccauauaccuccuacgguuaugaacccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3267 - RNA, 553 nt, Artificial Sequence
  mRNA product Design2 comprising derived and/or modified sequence from Sus scrofa__NP_999071.1__SsAMELX-LRAP (opt7)
ggggcgcugccuacggagguggcagccaucuccuucucggcaucaagcuuaccaugccccugccaccgcaccccggccauccaggguacaucaacuucagcuaugaggugcucacuccccugaagugguaccagaauaugauuaggcacccauccuugcugcccgaccucccacuggaagccuggccggcaaccgauaaaaccaagcgggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3268 - RNA, 592 nt, Artificial Sequence
  mRNA product Design2 comprising derived and/or modified sequence from Sus scrofa__NP_999071.1__HLA-A2-SP_SsAMEL(17-61) (opt7)
ggggcgcugccuacggagguggcagccaucuccuucucggcaucaagcuuaccauggccgugauggcacccaggacucugguccuccuguugagcggcgcccuggcgcucacucagaccugggccaugccacugccgccccacccagggcaucccgguuacaucaacuucuccuaugagguguugacgccacugaagugguaccaaaauaugauucggcaccccuauaccaguuacggcuaugaaccaaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3269 - RNA, 625 nt, Artificial Sequence
  mRNA product Design2 comprising derived and/or modified sequence from Sus scrofa__NP_999071.1__HLA-A2-SP_SsAMEL(17-49,167-189) (opt7)
ggggcgcugccuacggagguggcagccaucuccuucucggcaucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaauaugauucggcaccccagucuccugccagaccugccgcucgaagcauggcccgccacugauaaaaccaagcgcgaggaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3270 - RNA, 916 nt, Artificial Sequence
  mRNA product Design2 comprising derived and/or modified sequence from Sus scrofa__P45561-2__SsAMELX-001-2 (opt7)
ggggcgcugccuacggagguggcagccaucuccuucucggcaucaagcuuaccaugggcaccuggauccuguucgccugccuccugggggcagccuuuagcaugcccuugccaccgcaccccggucauccaggcuacauuaacuucuccuauaucaggcaccccuacaccaguuauggguacgagccaaugggcgguuggcugcaucaccagauuauccccguggucagccaacagacuccacagucccaugcgcuccagccgcaccaccauauucccauggugccagcccaacagcccgggaucccacagcagcccaugaugccgcugcccggccaacacaguaugacgccaacucagcaucaccagcccaauuugccacugcccgcacagcaaccauuucagccgcagcccguacaaccacagccccaccagccacuccagccccaaagcccgaugcauccaauccagccccugcugccccagccaccccucccaccgauguucuccaugcagagccuguugcccgaccugccacucgaagccuggcccgcaaccgauaagaccaaacgggaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3271 - RNA, 952 nt, Artificial Sequence
  mRNA product Design2 comprising derived and/or modified sequence from Sus scrofa__NP_998965.1__SsAMELX-001-3 (opt7)
ggggcgcugccuacggagguggcagccaucuccuucucggcaucaagcuuaccaugggcaccuggaucuucuuugccugccugcucggggcaagccuggccaugcccuugccaccgcaccccggucauccaggcuacauuaacuucuccuaugaggugcugacuccccucaagugguaccagaauaugaucaggcacccauauaccaguuacggguaugaacccaugggcgguuggcugcaucaccaaauuaucccagucgugagccagcagacgccgcagucccaugcguugcaaccccaccaccauauuccaaugguacccgcccagcagccagggaucccccagcaaccgaugaugccccugccaggccagcacaguaugacucccacccagcaucaccagccaaaccucccccugccagcacaacagccguuucagccccaaccagugcagccccagccacaccagccccugcaaccgcagagcccaaugcaucccauccagccccuccugccacagcccccauugccgcccauguucuccaugcaaagccugcucccagaccugccccuggaggccuggccagcaaccgauaaaacuaagcgggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3272 - RNA, 601 nt, Artificial Sequence
  mRNA product Design2 comprising derived and/or modified sequence from Sus scrofa__K7GPB2__SsAMELX-002 (opt7)
ggggcgcugccuacggagguggcagccaucuccuucucggcaucaagcuuaccaugggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccaagucuguugcccgaccugccacucgaagcguggccggccaccgauaaaacgaagcgggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3273 - RNA, 994 nt, Artificial Sequence
  mRNA product Design2 comprising derived and/or modified sequence from Sus scrofa__K7GLD0__SsAMELX-003 (opt7)
ggggcgcugccuacggagguggcagccaucuccuucucggcaucaagcuuaccaugggcaccuggauccuguucgccugccuccugggggcagccuuuagcaugcccuugccaccgcaccccggucauccaggcuacauuaacuucuccuaugaggaccuguaccucgaagcgaucaggauugaucggacugccuuugugcugacccccuugaagugguaucagaauaugauccgccacccauacacgaguuauggguacgagcccaugggcgguuggcugcaucaccaaauuaucccagucgugagccagcagacuccgcagucccaugcacuccaaccccaccaccauaucccaaugguacccgcccagcagccagggauuccccagcaaccgaugaugccccugccaggccagcacaguaugacccccacccagcaucaccagccaaaccugccccucccagcacaacagccguuccagccccaaccagugcagccccagccacaccagccccugcaaccgcagagcccaaugcaucccauccagcccuugcugccacagcccccacucccgcccauguuuuccaugcaaagccugcugccagacuugccccucgaagccuggccagcgacugauaaaaccaagagggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3274 - RNA, 880 nt, Artificial Sequence
  mRNA product Design2 comprising derived and/or modified sequence from Sus scrofa__K7GPE9__SsAMELX-004 (opt7)
ggggcgcugccuacggagguggcagccaucuccuucucggcaucaagcuuaccaugggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccaacgccccaaagucaugcgcugcagccacaccaucacauuccgaugguccccgcccagcagccagggaucccccaacagccaaugaugcccuugccgggccagcacagcaugacccccacucagcaucaccaaccaaaccugccccucccagcacagcagcccuuucagccacaaccggugcagccccagccacaucaaccccugcagccacagucccccaugcacccgauucagccacugcucccccaacccccacugcccccaauguucaguaugcagagcuugcugccggaccucccccuggaagccuggccagcaaccgauaaaaccaagcgggaggaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3275 - RNA, 904 nt, Artificial Sequence
  mRNA product Design2 comprising derived and/or modified sequence from Sus scrofa__J9JIM4__SsAMELX-201 (opt7)
ggggcgcugccuacggagguggcagccaucuccuucucggcaucaagcuuaccaugccccugccaccgcaccccggccauccaggguacaucaacuucagcuaugaggugcucacuccccugaagugguaccagaauaugauuaggcacccauauaccuccuacgguuaugaacccaugggcgggugguugcaucaccaaaucauuccagucgugagucagcagaccccgcagagccaugcccugcaaccccaccaccauaucccaaugguacccgcacagcagccaggcauuccccagcaaccgaugaugccccucccaggucagcacuccaugacgcccacucagcaucaccagccaaaccugcccuugccagcccaacagccguuucagccccaaccagugcagccccagccacaccagccccugcaaccgcagaguccaaugcaucccauccagccccuccugccacagcccccacugccgcccauguucagcaugcaaucccuccugccagacuugccccuggaggcguggccagccaccgauaaaaccaagcgggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3276 - RNA, 3343 nt, Artificial Sequence
  mRNA product Design2 comprising derived and/or modified sequence from Homo sapiens__NP_006120.1__HsBMP1 (opt7)
ggggcgcugccuacggagguggcagccaucuccuucucggcaucaagcuuaccaugcccggcguggccaggcugccacuccuguuggggcugcuccuguugccgcggcccggucgcccacuggaccucgcagauuacaccuaugaccuggccgaggaagaugacagcgagccccugaacuacaaggauccaugcaaagcggccgcauuccucggcgacaucgcccuggaugaagaggacuugagggcauuucagguccaacaggccguggaucugcggcgccacacugcgaggaaguccaguauuaaagccgcaguacccgggaauaccagcacgccauccugucagaguacuaacggccagccgcaacggggugccugcgggcgcuggaggggccggagccgcuccaggcgggccgcaaccagccgccccgaaaggguguggccagacggcgucauccccuucgugauuggggguaauuuuaccggcucccagcgggccguguuccgccaggcgaugaggcauugggagaagcacacuugugucaccuuucucgagcggacggaugaagacaguuauaucguguucacuuaccgcccaugcggguguugcagcuauguaggcaggcggggugggggcccccaggccauuuccaucggcaaaaacugugauaaguuugggaucgugguccaugagcugggucacguggugggcuucuggcaugaacacaccaggccggaccgcgaccggcacgucagcauugugagggagaauauccaacccgggcaggaguacaacuuucugaagauggaaccacaggagguagaaaguuugggcgagacuuaugauuucgacuccauuaugcauuacgcacgcaauaccuuuagccgggguaucuuccucgauaccauugugcccaaauacgaagucaacggcgugaagccacccaucgggcagaggacgcgccuguccaaaggcgacauugcccaagcacggaagcuguauaaaugcccagccuguggggagacucuccaggauaguaccgguaauuucagcuccccggaguaccccaacggcuauagcgcccacaugcauugcguguggaggaucagugucacuccaggggaaaagaucauucugaauuuuaccuccuuggaccuguaccggagccgccucugcugguaugauuacguggagguaagggacggcuucuggcggaaagcgccccugcgcgguagguuuuguggcaguaagcugccagaacccaucguguccaccgauagccgguugugggucgaguuccgcagcuccaguaacuggguggggaagggcuuuuucgcagucuaugaagccauuugcgggggcgacgugaaaaaggauuacggucacauccagagcccgaauuacccagacgacuauaggcccuccaaaguguguauuuggcggauccaaguaagcgagggguuucacgugggccucacuuuccagaguuuugagaucgaaaggcaugauuccugcgccuacgacuaucuggagguccgcgauggucacagcgaauccaguacgcugauuggccgguacuguggguaugagaagcccgacgauaucaaaagcaccuccagcaggcucuggcugaaguucgugagugacggcuccauuaacaaggcaggguuugccgucaauuucuuuaaagaaguggaugagugcagccgcccaaaccggggcgguugugagcagaggugcuugaacacucugggguccuacaaguguaguugcgaccccggcuaugaacucgcgccagauaaacgccggugcgaggccgcauguggcggguuccugaccaagcugaaugguagcaucaccuccccgggcuggcccaaagaauacccacccaacaagaauugcauuuggcaguugguggccccaacucaauacaggaucagccuccaguucgacuuuuucgagacggaggggaacgauguauguaaguaugacuuuguggaaguccgcaguggccugaccgcagauuccaaacugcaugguaaguucugcgggagcgagaaacccgaagugaucacuucccaguacaauaacaugcgggucgaguuuaagagcgacaauaccgugaguaaaaagggcuucaaggcccacuuuuucagcgacaaagaugaauguuccaaggacaacggcgggugccagcaagauugugugaauaccuuugguaguuaugagugccaguguaggagcggcuucguacuccaugacaacaaacacgauugcaaggaggccgggugugaccacaaagucacuuccacgagcggcaccauuacuuccccgaauuggccagauaaguaccccaguaaaaaggaaugcaccugggcaaucagcuccacuccaggucaucgcgugaagcugaccuuuauggagauggacauugaaagucagcccgagugcgccuaugaucacuuggaaguguucgacgggcgggaugcgaaagccccgguccugggcagguucuguggcagcaagaaacccgagccagugcucgcaacggggucccgcauguuucugcgguucuacagcgacaacagugugcagaggaaggguuuucaagccucccaugccaccgagugcggcgggcagguacgcgcagacgucaaaacuaaggaucuguauagccacgcgcaguucggcgacaauaacuaccccggugggguggauugugaaugggugaucgucgccgaggaaggcuacggcguggaguugguauuucagaccuucgaaguggaggaggaaacugacugcggguaugauuacauggagcuguuugacgguuaugauuccaccgcaccaaggcucggccgguacugugggagcggucccccagaagaggucuauagugccggcgacuccgugcuggugaaguuccacagcgaugacacgauuaccaaaaagggcuuucaucucagguacaccaguacuaaauuccaagauacucugcacucccgcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3277 - RNA, 1573 nt, Artificial Sequence
  mRNA product Design2 comprising derived and/or modified sequence from Homo sapiens__NP_001191.1__HsBMP2 (opt7)
ggggcgcugccuacggagguggcagccaucuccuucucggcaucaagcuuaccaugguggccggcaccaggugccugcucgcacuguugcugccccagguccuccuggguggggccgcgggcuuggugccagagcuggggcggcgcaaguucgccgcagccagcuccggcaggccgaguagccaacccuccgacgaaguacucagugaguuugaacugcggcugcucagcauguucggucugaaacagcgcccaacucccuccagggaugcaguggucccacccuacauguuggaccuguaucggcgccacagcgggcagccaggcuccccggcccccgaucauaggcucgagcgggcggccagucgcgcaaacaccgugaggagcuuucaccaugaagagucccuggaggaacugccagagacgagcggcaagacuacccggcgcuucuuuuucaauuugaguuccauccccaccgaagaguuuauuacuagcgccgagcuccagguguucagggaacaaaugcaggacgcccuggggaacaauuccaguuuucaccaucggaucaacauuuacgagaucauuaaaccagcaaccgccaauagcaaguuccccgucacgcgccugcucgauacuaggcuggugaaccagaaugcgucccggugggaauccuuugacguaaccccggccgugaugcgcuggacugcacagggucacgccaaccacggcuucgucguggagguggcacauuuggaagagaaacaaggggucaguaagaggcacgugcggaucuccaggagccugcaucaggaugagcacaguuggucccagauccgcccccuccugguaaccuucggccacgacgguaaggggcauccacugcacaaacgggaaaagaggcaggccaaacauaagcaacgcaaacggcucaagagcagcuguaaaaggcaccccuuguauguggauuuuuccgacgucggcuggaaugauuggauuguggccccacccggcuaccaugcguucuauugccacggggaguguccauuuccgcuggcagaccaccugaacaguaccaaucaugccaucgugcagacgcucgucaacagcgugaauagcaagauucccaaggccugcuguguaccaacugaacugagcgcaaucaguauguuguaccuggaugagaacgaaaaagugguccucaagaauuaucaggacaugguggucgaggguugcggcugucgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3278 - RNA, 1609 nt, Artificial Sequence
  mRNA product Design2 comprising derived and/or modified sequence from Homo sapiens__NP_001193.2__HsBMP4 (opt7)
ggggcgcugccuacggagguggcagccaucuccuucucggcaucaagcuuaccaugauccccggcaacaggaugcugauggugguccuccugugccagguguugcucgggggugccagccacgcaucccugauuccagagaccggcaagaaaaagguagccgaaauccaagggcaugcgggcggucggcgcagugggcagagccacgagcuguugagggacuucgaagccacucugcuccagauguuuggccugcggcgcaggccgcagcccuccaaaagugcagugauuccagauuacaugcgggaccuguaucgccuccaaagcggcgaggaagaggaggaacagauccauuccaccgggcuggaguaccccgaaaggccagccagccgggcaaauacgguccgcuccuuccaccaugaggagcacuuggaaaacauucccgguaccagugagaauagcgccuuuagguuccuguuuaaccucuccagcaucccagaaaaugaggugaucaguuccgcggaacugcggcuguuccgcgaacagguggaucagggcccggacugggagaggggguuucaccggauuaacaucuaugaggucaugaagcccccagccgaggugguacccggccauuugauuacucgccuccuggauaccaggcuggugcaccauaaugucacucggugggaaaccuucgacgugagcccagcagugcuccgcuggacgagggagaaacaacccaacuacggucuggccaucgaagucacucacuugcaccagacccggacucaucaggggcagcacgugaggauuucccgcagucugccgcaaggcagcggcaauugggcccagcuccggccccugcugguaaccuuugggcaugaugguaggggccacgcauugacccgccggaggcgcgccaagcgguccccaaagcaucacagccagagggcgcggaaaaagaacaaaaauugucgcaggcacagucucuauguggacuucuccgaugucggguggaacgacuggaucguggcacccccaggcuaccaagccuuuuauugccauggugauugucccuucccacuggccgaccaccugaauagcacgaaccaugcaauugugcagacucucgucaauagugugaacuccagcaucccgaaggccugcuguguacccaccgagcugagcgccaucuccauguuguaccuggaugaguacgacaaagugguccucaagaacuaucaggaaaugguggucgagggcugcgggugucggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3279 - RNA, 1924 nt, Artificial Sequence
  mRNA product Design2 comprising derived and/or modified sequence from Homo sapiens__NP_001709.1__HsBMP6 (opt7)
ggggcgcugccuacggagguggcagccaucuccuucucggcaucaagcuuaccaugcccggccuggggaggcgggcccaguggcucugcuggugguggggucuguuguguagcugcuguggcccaccgccccugcgcccaccccucccagcagccgcggccgcagccgcagggggccaacuguugggugacgggggcucccccggcaggaccgagcagccaccgcccaguccacagagcuccaguggguuccuguaccggcgccucaagacucaggagaaaagggaaaugcaaaaggaaauccugagcgugcugggucucccccaccggccacgcccccugcauggcuugcagcagccgcagcccccagcccugaggcaacaggaggaacagcagcaacagcagcaacucccccgcggggagccacccccaggccggcugaaauccgcgccgcuguuuauguuggaucucuauaacgcccugagcgcagacaaugaugaggacggugccuccgaaggggagaggcagcagaguuggccccacgaagccgcaagcuccagccagcggcgccaaccacccccaggcgccgcgcauccccugaacaggaagagucuccuggccccgggcuccgggagcgguggcgcauccccauugaccagugcccaggauagcgcauuccugaaugacgccgauauggucauguccuuugugaaccucguagaguacgacaaagaguucagcccccggcagcgccaccauaaggaauuuaaguucaaucugagucagauucccgagggggaaguggucacggccgcggaguuuaggaucuauaaagauugcgugaugggcuccuucaagaaccaaacuuuucugauuagcaucuaccagguguugcaggaacaccagcaccgggacagugaucucuuccugcuggacacccgcgucgugugggcauccgaggaggguuggcucgaauuugauauuaccgccacuagcaaucuguggguagugaccccacaacauaacaugggcuugcagcugagcgucgugacgagggacggggugcacguccauccccgggccgcaggccucguggggagggacgguccauaugauaaacagccguucaugguagccuucuuuaagguguccgagguccacgugcgcacuacccggagugcgagcuccaggcgccggcagcaaagcaggaaucgcaguacucagucccaggacguggcccgggucagcuccgcaagugauuacaacagcuccgaacugaaaaccgccuguaggaagcacgagcuguaugugagcuuccaagacuugggcuggcaggauuggaucaucgcacccaaaggguacgccgccaauuacugcgacggcgaauguaguuuuccacucaacgcacauaugaaugccaccaaccacgcgauuguacagacgcuggugcaucugaugaaucccgaguaugucccaaagcccugcugugccccgacuaagcucaacgcaaucuccgugcuguacuucgaugacaacagcaaugucauuuugaaaaaguaucggaacaugguggugcgcgccugcgguugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3280 - RNA, 1678 nt, Artificial Sequence
  mRNA product Design2 comprising derived and/or modified sequence from Homo sapiens__NP_001710.1__HsBMP7 (opt7)
ggggcgcugccuacggagguggcagccaucuccuucucggcaucaagcuuaccaugcacgugaggagccugcgggccgcagcgccccauuccuucgucgcccucugggccccacuguuuuugcugcgcagugcacucgccgacuucagccuggauaacgaggugcacuccaguuuuauccauaggcgguugcgcagccaggaaaggcgggagaugcaacgcgaaauucuguccauccucggccugccgcacaggccccggccacaucugcaggggaagcacaauagcgcacccauguucaugcucgaccuguacaacgccauggcgguagaggaagguggcgggccaggcggucagggguuuuccuaucccuacaaagccguguucaguacccagggcccaccguuggcaagccugcaagauucccacuuucucacugacgccgauauggucaugagcuucgugaaucugguggagcaugacaaggaguuuuuccacccccgcuaucaucacagggaauuucgguucgaucugaguaaaauuccagagggcgaagccgucaccgcagccgaguuccgcaucuacaaggacuauauuagggagcgguuugauaacgaaacguuccgcaucuccguguaccagguauugcaggagcaccucgggagggaaagcgaccuguuucugcucgauucccggacucugugggcgagugaggaagguugguugguguucgacaucaccgccaccagcaaucauugggucgugaacccccgccacaaucugggccuccagcuguccguggagacucuggaugggcaaagcauuaacccaaaauuggcaggccucaucgguaggcaugggccccagaauaagcagccguuuauggucgccuucuuuaaggcaaccgaggugcacuuccggaguauuagguccacgggcagcaaacagcgcagucaaaaccgguccaagacucccaaaaaucaggaagcccugaggauggccaacguagcggagaauagcagcuccgaccagcgccaagcaugcaagaaacaugaacuguaugugaguuuucgggaccucggcuggcaggauuggaucauugccccagagggguacgccgcauacuauugugaaggugagugcgccuucccccugaacagcuacaugaaugcgaccaaccacgccaucguccagacuuuggugcacuuuauuaacccagagaccgugcccaagccauguugcgcaccgacccagcugaaugccaucuccguccucuauuucgacgauagcaguaacgugauccugaaaaaguacaggaauaugguagugcgcgcauguggcugccauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3281 - RNA, 682 nt, Artificial Sequence
  mRNA product Design2 comprising derived and/or modified sequence from Homo sapiens__NP_006264.2__HsCCL7 (opt7)
ggggcgcugccuacggagguggcagccaucuccuucucggcaucaagcuuaccaugaaggccagcgcagcccugcucugccuguugcugaccgcggccgcauucaguccccagggccucgcccaaccaguggggaucaacacuuccaccacguguugcuacagguuuauuaauaaaaagaucccgaaacagcggcuggagagcuaucgcaggacuaccuccagucacuguccccgggaagcagucauuuucaagaccaaauuggacaaggagaucugcgccgauccaacucagaagugggugcaggacuuuaugaaacaucuggauaagaaaacccaaacgcccaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3282 - RNA, 4006 nt, Artificial Sequence
  mRNA product Design2 comprising derived and/or modified sequence from Homo sapiens__NP_001954.2__HsEGF (opt7)
ggggcgcugccuacggagguggcagccaucuccuucucggcaucaagcuuaccaugcugcucacccugaucauuuugcugcccguggucagcaaguucuccuuugugagucucagcgccccacagcacugguccugcccggagggcacucuggcagggaacgguaauaguaccuguguaggccccgccccauucuugaucuuuagccaugggaacuccauuuucaggaucgacacggaaggcacuaauuacgagcaacugguggucgacgcgggugugagcgugauuauggacuuucacuauaacgaaaaacggaucuacugggucgaucucgagcgccagcugcugcagaggguguuccucaaugggucccggcaggaacgcguaugcaacaucgagaagaaugugaguggcauggccauuaacuggaucaaugaggaagucauuuggagcaaccaacaggagggcaucauuaccgugaccgacaugaaagggaauaacucccauauccuguugagcgcacugaaguaucccgccaauguggcagucgauccaguggaaagguuuauuuucuggaguuccgagguagccgguagccucuaccgggcggaccuggauggcgugggggucaaagcccuguuggagacuuccgaaaagaucaccgcagugagucucgacgugcuggauaagcgccuguuuuggauccaguauaacagggagggcagcaauucccucauuuguagcugcgacuacgauggugggaguguccacaucuccaaacaucccacgcagcacaaccuguucgccaugagcuuguuuggcgaccggauuuucuauaguacuuggaagaugaaaaccaucuggauugccaacaagcacacuggcaaagauauggugcgcaucaaucugcauuccagcuucguaccacucggggaacugaaggugguccacccgcuggcacaacccaaagccgaggacgacaccugggaaccagagcagaaguuguguaagcucaggaaagguaacugcagcuccaccguguguggccaggaucugcagagucaucugugcaugugugcggagggguacgcccucagccgggaccgcaaguacugcgaagaugucaaugagugcgcauuuuggaaccacggcuguacgcuggguugcaaaaauacucccggcuccuauuacuguaccugcccagugggguucguguugcugcccgacggcaagaggugucaccaacucguaagcugcccgcggaacgugagugaauguucccaugauugcguccugacuagcgaggggccccuguguuuuugcccagaagguuccguguuggagcgcgacggcaaaaccugcaguggguguagcucccccgauaauggcgguugcagccagcucugugucccacugagucccguguccugggagugcgacuguuucccaggcuaugaucugcagcucgacgaaaagagcugcgccgcauccgggccgcaacccuuucuguuguucgccaacagucaggauaucaggcacaugcauuuugacggcaccgacuacgggacucugcucagccagcagaugggcaugguguaugcccuggaucacgacccaguagagaauaagauuuacuucgcgcauacggcacugaaauggaucgaacgggccaacauggaugguucccaacgcgagagguugauugaagaggggguggacguccccgagggccuggccguggauuggaucggucggagguuuuauuggaccgaccgcggcaagagccucauugggcggagugaucugaauggcaaaagguccaagaucaucacuaaagaaaacauuagccagccacgcgggaucgcaguccaccccauggccaagcggcuguucuggaccgacaccggcauuaauccgaggaucgaguccagcagucuccaggguuuggggcgccuggugauugcgagcuccgaucucaucuggccaaguggcauuacuaucgacuuucugacggauaagcuguacuggugugacgccaaacagagcgugaucgaaauggcaaacuuggauggcuccaagcggaggcggcugacccaaaaugacguagggcaccccuucgccgucgcaguguuugaggacuacgugugguucagcgauugggccaugcccuccgucaugcgcgugaacaaaaggacugguaaggaccgggugcgccuccagggcaguaugcugaaaccaagcucccucguagucgugcauccccuggccaagccaggggcagauccgugcuuguaucagaacggcgguugugagcacauuugcaagaaaaggcuggggaccgccugguguaguugccgggaaggcuucaugaaggcgagcgacggcaaaaccugccuggcccucgaugggcaucagcuguuggccgguggcgagguggaccugaagaaucaagucacuccccucgauauccuguccaaaacgcgcgugagcgaagacaacauuaccgagagucagcacaugcucguagcagaaaucaugguguccgaucaggacgauugugccccagucgggugcagcauguacgcaagguguauuuccgagggcgaggacgcgacuugccagugucugaaggguuuugccggggacggcaaauugugcagcgauaucgacgaaugugagaugggcgugcccgugugcccacccgcaaguuccaaguguaucaauaccgaaggggguuaugucugccggugcagcgagggcuaccaaggggauggcauucacugucuggacaucgaugaaugccagcugggugagcauaguuguggggagaacgccuccugcacuaauaccgaaggcggcuauacguguaugugcgccgggaggcucagcgagccgggucugauuuguccagacuccacucccccaccccacuugcgcgaagaugaccaucacuacagcgugcggaacagugauagcgagugcccgcugucccaugacggcuauugucuccacgaugggguaugcauguacaucgaagcacuggacaaguacgccugcaauuguguggucggcuauauuggugagaggugccaguaccgcgaucugaaauggugggagcuccggcacgcgggccaugggcaacagcagaaggugaucguggucgccguguguguagugguccuggugauguugcugcuccugaguuuguggggcgcacacuauuacaggacccagaaacugcucagcaagaaccccaaaaauccauaugaagaguccagccgcgacgugcgguccaggcgccccgccgacaccgaagaugggaugaguagcugcccacaacccugguucgucgugaucaaggagcaucaggaccugaagaacgguggccagccaguagccggggaggauggccaggcagccgacgguuccaugcaaccgacuagcuggcggcaggaaccccagcuguguggcauggggaccgagcagggcugcuggauuccagugaguuccgauaaagggagcuguccccaagucauggaaagguccuuucacaugccaaguuacgguacgcagacccucgagggcgggguggaaaagccccacagccuguuguccgcgaauccgcuguggcagcaacgcgcccucgaucccccacaucagauggagcugacucagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3283 - RNA, 892 nt, Artificial Sequence
  mRNA product Design2 comprising derived and/or modified sequence from Homo sapiens__NP_001423.1__HsEREG (opt7)
ggggcgcugccuacggagguggcagccaucuccuucucggcaucaagcuuaccaugaccgccggcaggcggauggagaugcugugcgcagggcgcgugcccgcccuccuguugugccuggguuuccaccuccugcaggcggucuugagcacuaccgugaucccauccugcauuccgggcgaaaguagcgacaacuguacggcccugguacaaacugaggauaaucccaggguggcacaggucuccaucaccaagugcaguagcgacaugaacggguacugucuccauggccagugcauuuaucugguggauaugucccagaauuacugucggugcgaaguggguuauaccgggguccgcugugagcacuuuuuccugacugugcaucaaccacucagcaaagaauacguagcccugaccgugaucuugauuauccuguuucucaucacggucgugggcuccacuuauuacuucuguaggugguaucggaaccgcaagaguaaagagcccaagaaagaguacgaaagggugaccagcggcgacccagagcugccccaggucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3284 - RNA, 850 nt, Artificial Sequence
  mRNA product Design2 comprising derived and/or modified sequence from Homo sapiens__NP_000791.1__HsFGF1 (opt7)
ggggcgcugccuacggagguggcagccaucuccuucucggcaucaagcuuaccauggccgagggcgaaaucaccacuuucaccgcacugacggagaaguuuaaccugcccccagggaauuacaaaaagccgaaacucuuguauugcagcaacgguggccacuuccugaggauucuccccgacgggacuguggauggcacccgggaccgcuccgaucagcauauccaacugcaguugagugccgaaagcgucggugagguguacauuaaguccaccgaaacugggcaguaucuggcgauggacaccgauggccuccuguacggcagucagacgccaaaugaggagugucuguuucucgaaaggcuggaggaaaaccacuauaauacuuacaucagcaaaaagcaugccgagaagaacugguucguaggguugaaaaagaaugguuccugcaaacggggcccccgcacccacuaugggcaaaaggcaauucuguuucucccacugcccgugagcuccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3285 - RNA, 1249 nt, Artificial Sequence
  mRNA product Design2 comprising derived and/or modified sequence from Homo sapiens__NP_001997.5__HsFGF2 (opt7)
ggggcgcugccuacggagguggcagccaucuccuucucggcaucaagcuuaccauggugggcgucggggguggcgacguggaggauguaacccccaggccagggggcugccagaucagcggucgcggggcccggggcuguaacggcauuccgggggcagccgcgugggaagccgcacugcccaggcggcgcccaaggcggcaccccuccgugaauccacgcaguagggccgcagguagcccccggacucgcggcaggcggaccgaggaacgcccauccgggaguaggcucggcgaccggggucgcgggagggcccugccgggcggccgguugggugggcgcggcagggggcgggcgcccgagagggucggcggucgcggccgggggaggggcacggccgcaccacgcgccgcccccgcagcccgggggagcaggccaggucccgcgggcacuauggccgcaggguccaucaccacccugccggcccuccccgaagauggcgguagcggcgcauucccacccgggcauuuuaaggacccaaaacgccuguacugcaagaacggcggguucuuuuugcggauucaccccgauggcaggguggacggugugcgggagaaauccgauccacauaucaagcugcaacuccaggccgaggaacgcggggucgugaguauuaaaggcguaugugccaauagguaucuggcgaugaaggaggacggucggcugcucgcaagcaagugcgugacugaugaauguuucuuuuucgagcgccuggaguccaacaauuacaacaccuauaggagccggaaauacacgaguugguaugucgccuugaagcgcacuggccaguacaaacugggguccaagaccggcccggggcagaaagccauccucuuucugcccaugagcgcaaaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3286 - RNA, 967 nt, Artificial Sequence
  mRNA product Design2 comprising derived and/or modified sequence from Homo sapiens__NP_002000.1__HsFGF7 (opt7)
ggggcgcugccuacggagguggcagccaucuccuucucggcaucaagcuuaccaugcacaaguggauccugaccuggauucuccccacucuguuguacaggagcugcuuccauaucauuugucuggugggcaccaucucccucgccugcaacgacaugacgccagagcagauggcaacuaaugucaacuguaguagcccggaacggcacacccgcuccuaugauuacauggaagggggugacauuagggugcggcgccuguuuugcaggacccaaugguauuugcggaucgauaaacgcggcaagguaaaagggacucaggagaugaagaauaacuacaauaucauggagauuaggaccguggccgucggcaucguggcgauuaaagguguggaaagugaguucuaucuggccaugaacaaggaggggaagcucuacgccaaaaaggaauguaaugaggacugcaacuuuaaagaacugauccuggagaaucauuauaacacguacgcaagcgcaaaguggacucacaauggcggcgagauguucgucgcccucaaccagaaagggauucccgugcgggguaagaaaaccaagaaggaacagaaaacugcgcauuuucugccaauggccaucaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3287 - RNA, 1009 nt, Artificial Sequence
  mRNA product Design2 comprising derived and/or modified sequence from Homo sapiens__NP_001936.1__HsHBEGF (opt7)
ggggcgcugccuacggagguggcagccaucuccuucucggcaucaagcuuaccaugaagcugcuccccagcgugguccugaaauuguuccuggccgcagugcucuccgcccugguaaccggcgagaguuuggaaaggcugcggcgcgggcucgcggccgguacuagcaacccagacccgcccaccguguccacggaucagcugcugccacucggcgggggcagggaccggaagguccgcgaucugcaagaggcagacuuggaucugcucagggugacucugaguagcaaaccccaggcccuggcaaccccaaauaaggaggaacacgguaaacggaagaagaaagggaagggcuugggcaaaaagcgcgaccccugccucaggaaauacaaggauuuuuguauccauggggaaugcaaauaugugaaggagcugcgggccccauccuguauuugccacccggguuaccauggcgagcgcugucacgggcugagccuccccgucgaaaacaggcuguauaccuacgaccauacuaccaucuuggcggugguagccgugguccuguccagugugugccuccuggugauugucggccuguugauguuccgguaucaccgcagggguggguacgauguggagaaugaagagaagguaaaacucggcaugacgaacagccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3288 - RNA, 2569 nt, Artificial Sequence
  mRNA product Design2 comprising derived and/or modified sequence from Homo sapiens__NP_000592.3__HsHGF (opt7)
ggggcgcugccuacggagguggcagccaucuccuucucggcaucaagcuuaccaugugggugaccaagcugcuccccgcccuguugcugcagcacguccuccugcauuugcugcuccugccaaucgcaauuccguacgccgagggccaaaggaaacggcgcaacacuauccacgaauuuaagaaaagcgcgaagaccacgcugauuaaaaucgaccccgcccucaagauuaagacuaaaaaggugaauaccgcagaucagugcgccaacagguguacccggaauaaagggcugccauucacuugcaaggcauucguauuugacaaagcccgcaagcaguguuugugguuccccuuuaacuccaugaguagcggugugaaaaaggaguucggccaugaauuugaucuguaugagaauaaggacuacaucaggaacugcaucauugggaaaggccgguccuauaaggguaccgucaguaucacgaaaagcgggauuaagugucagccaugguccagcaugaucccccacgaacauuccuuccucccaaguagcuaccgcggcaaagaucugcaagagaauuauugcaggaacccgcggggcgaggaagggggucccugguguuuuacuuccaauccagaggugcgcuacgaagugugcgacauuccccaguguagcgaggucgagugcaugaccugcaacggcgaaaguuauagggggcugauggaucacacugaguccggcaagaucugucagcggugggaccaccagaccccacaucgccacaaguucuugcccgaaagguacccggauaaagguuuugacgauaauuacugccggaaccccgacgggcaaccacgccccugguguuauacccucgauccacauacgaggugggaguacugcgcgauuaagacuugugccgacaauaccaugaacgacacugaugugccccuggaaaccaccgagugcauccagggccagggcgagggguaucgggguacuguaaauacgaucuggaacggcauuccaugucagcgcugggacagccaauacccgcacgaacacgauaugacccccgagaacuucaaaugcaaggaccugagggaaaauuauugucggaacccagauggguccgagagucccuggugcuucacuaccgacccaaauaucagggugggcuacugcagccagauucccaacugugauaugucccauggucaggacugcuaucgcggcaaugggaaaaacuacaugggcaaucucagccaaacccggagugggcugacuuguuccaugugggauaagaacauggaagacuugcacaggcauaucuuuugggagccggaugcaagcaagcugaaugagaacuacugccgcaauccagacgacgaugcccacggucccugguguuauacgggcaacccccucauuccaugggacuacugccccaucagucggugugaaggggauaccacuccaaccaucgucaaucuggaccauccggugauuuccugcgccaaaaccaagcagcugaggguggucaacggcauccccacucgcacgaauauugguuggauggugagcuugcgguauaggaacaaacacaucuguggcgggagccucauuaaggaguccuggguacugaccgcacggcagugcuucccaagucgcgaucugaaagacuacgaagccuggcucggcauccacgaugugcaugggaggggcgacgagaaguguaagcagguccugaacgugagccaauugguguauggucccgaaggguccgaucugguccucaugaaacuggcgcggccagccgugcuggacgauuuuguaagcacuaucgacuugcccaauuacggcugcaccauuccggagaagaccaguugcuccguguaugguuggggcuacacugggcucaucaacuacgauggccugcugcgcgucgcacaccucuauauuauggggaaugagaaauguagccagcaucacaggggcaaggugacgcugaacgaauccgagaucugcgccggugcagagaaaauugggaguggcccaugugaaggcgacuacgggggucccuuggucugcgagcagcacaagaugcggauggugcugggcgugaucguaccagggcgcggcugugccauucccaauaggccggguaucuucgugcgggucgccuauuacgcgaaauggauccauaagauuauccucaccuauaaggugccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3289 - RNA, 2308 nt, Artificial Sequence
  mRNA product Design2 comprising derived and/or modified sequence from Homo sapiens__NP_005336.3 __HsHSPA1A (opt7)
ggggcgcugccuacggagguggcagccaucuccuucucggcaucaagcuuaccauggccaaggcagccgcgaucggcauugaccuggggaccacuuacagcugcgugggugucuuccagcacggcaaaguggagaucauugccaacgaucaagggaauaggaccacgcccuccuauguagcauuuacugacaccgaacggcucaucggcgaugccgcaaagaaccagguggcccugaauccacagaacaccgucuucgacgcgaaacgcuugauugguaggaaguuuggggauccgguggugcagagugacaugaaacauuggcccuuccaagucaucaaugauggcgacaagccaaaggugcagguaagcuacaaaggcgagacuaaggccuuuuaucccgaagagaucuccaguauggugcugaccaaaaugaaggaaauugcagaggccuaccucggguauccagucacgaacgccgugaucacugugcccgcauacuucaaugauagccagcggcaggccaccaaagacgcgggugucauugccggccugaacguguugcgcaucauuaaugagccaacugcagccgcaaucgccuaugggcuggauaggaccggcaagggugaacggaacguacucauuuuugaccucgggggcggcaccuucgauguguccauccugacgaucgacgacgggauuuuugaggucaaagccacugcgggugauacccaccugggcggggaagacuucgauaaucgccuggugaaccauuuuguggaggaguucaagaggaagcacaaaaaggacaucagccaaaauaaacgggcaguccgcagguugcggacugccugugaacgcgccaagaggacccuguccaguagcacccaggcaucccucgagauugauagccuguucgaaggcaucgacuuuuacacuagcauuacgcgggcccgcuucgaggaacugugcuccgauuuguuuaggagcacccucgagccgguggagaaagcgcugcgggacgccaagcuggauaaggcacagauccaugaccucguacugguggguggcuccacucgcauccccaaaguccagaaguugcugcaagauuucuuuaacgggagggaccucaauaaaaguauuaacccagacgaagccguggcauacggcgccgccguccaggcagccauccugaugggggauaagagcgagaacgugcaggaccuguugcuccuggauguggcgccccugucccucggucuggaaaccgccggcgggguaaugaccgcauugauuaaacggaauagcacuaucccaacgaagcaaacccagauuuucacuaccuauagugacaaccagcccggcgugcugauccaggucuacgagggugaaagggccaugaccaaggauaauaaccuccugggccgcuuugagcuguccgggaucccgcccgccccacggggcgugccccaaauugaggucacuuucgacaucgaugcaaaugggauuuugaacgugacggcgaccgacaaaagcacuggcaaggccaauaaaaucaccauuacuaacgauaaggguaggcucaguaaagaagagaucgaacgcauggugcaggaggcagaaaaguauaaggccgaggacgagguacagcgggaaaggguguccgccaaaaaugcacuggagagcuacgccuuuaacaugaagagugcggucgaagaugaggggcugaaaggcaagauuuccgaggccgacaaaaagaaagugcucgauaagugucaggaagucaucaguuggcuggacgcaaauaccuuggccgagaaggacgaguucgaacacaaacgcaaggaacuggagcaagugugcaacccaaucauuagcggucucuaucagggcgccgggggccccgggccaggcgguuuuggggcacagggcccgaaaggcggguccgguagcggccccacgaucgaggaaguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3290 - RNA, 2308 nt, Artificial Sequence; identical to SEQ ID NO: 3289
  mRNA product Design2 comprising derived and/or modified sequence from Homo sapiens__NP_005337.2 __HsHSPA1B (opt7)

SEQ ID NO: 3291 - RNA, 2308 nt, Artificial Sequence
  mRNA product Design2 comprising derived and/or modified sequence from Homo sapiens__NP_005518.3 __HsHSPA1L (opt7)
ggggcgcugccuacggagguggcagccaucuccuucucggcaucaagcuuaccauggccaccgcaaagggcaucgccauugggaucgaccuggguacuaccuacagcugcgugggcgucuuccagcacgggaaaguggagauuaucgcgaacgaucaaggcaauaggacgacucccuccuauguagccuuuaccgacaccgaacggcucauuggugaugcagccaagaaccagguggcaaugaauccacagaacacugucuucgacgccaaacgccugaucgggaggaaguuuaaugauccgguggugcaggcggacaugaaauuguggcccuuccaagucaucaacgagggcggcaagccaaaggugcugguaaguuacaaaggggaaaauaaggccuuuuaucccgaggaaauuagcuccauggugcucaccaaacugaaggagacggcagaggccuucuugggucauccagucacuaacgccgugaucaccgugcccgcauacuuuaaugauagucagcggcaggccacuaaagacgcgggcgucauugccgggcugaacgugcuccgcaucauuaaugaaccaaccgcagccgcaaucgccuauggccuggauaagggugggcagggcgagaggcacguacugauuuucgaccucggcggggguaccuuugaugugagcauccugacgaucgacgauggcauuuucgaagucaaagccacugcgggggacacccauuugggcggugaggacuuugauaaccggcuggugucccacuucguggaggaguucaagcgcaagcauaaaaaggacaucagccaaaauaaaagggcaguccggcgccucaggacugccugugagcgggccaagcgcacccuguccaguagcacccaggcaaaccuggaaauugauuccuuguacgagggcaucgacuuuuauacuagcauuacgagggcccgguucgaagaacucugcgcggaucuguuucgcgggacccuggagccgguggaaaaagcccucagggacgcaaagauggauaaggccaaaauccacgacaucguacuggugggcgggaguacucggauucccaagguccagcgcuugcugcaggauuacuucaaugguagggaccucaacaaauccaucaacccagaugaggcaguggccuacggcgccgcaguccaagccgcgauucugaugggggacaagagcgaaaaagugcaggaccuguugcuccuggauguggcaccccugucccucggccuggagaccgccgguggcguaaugaccgccuugaucaagcggaauaguacuauuccaacgaagcagacccaaaucuuuacuaccuauagcgacaaccagcccggggugcugauccaggucuacgaaggcgagagggccaugaccaaagauaauaaccuccuggggcgcuucgaccugacuggcauuccgcccgcaccacggggugugccccagaucgaggucacguuugauauugacgcgaaugggaucuugaacgugaccgccacugauaaguccaccggcaaagugaauaagauuacuaucaccaacgacaaagguaggcucagcaaggaagagauugaacgcaugguacuggaugcagagaaguauaaagccgaagacgaggugcaacgggagaagaucgccgccaaaaaugcacuggaaaguuacgcguucaacaugaaguccgucgugagcgaugagggccucaaagggaagaucagugaauccgacaaaaauaagauucuggauaaguguaacgaguugcugagcuggcucgaggucaaucagcuggccgaaaaagacgaguuugaccacaagaggaaagaacuggagcagaugugcaacccaaucauuacgaaguuguaucagggcggguguaccggccccgcaugcgguacuggguacgugccaggccgcccggccaccggccccacuaucgaagagguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3292 - RNA, 2302 nt, Artificial Sequence
  mRNA product Design2 comprising derived and/or modified sequence from Homo sapiens__NP_068814.2 __HsHSPA2 (opt7)
ggggcgcugccuacggagguggcagccaucuccuucucggcaucaagcuuaccaugagcgccaggggccccgcaaucgggauugaccuggguaccacuuacuccugcgugggcgucuuccagcacgggaagguggagaucauugccaacgaucagggcaaucggaccacgccaaguuauguagcguuuacugacaccgaacgccucaucggugaugccgccaaaaaccagguggcaaugaauccgaccaacacuauuuucgacgcaaagaggcugaucgggcggaaauuugaggaugccaccguccagagcgacaugaagcauuggcccuuccgcgugguguccgaaggcggcaaaccaaagguccagguggaguacaagggggaaacgaaaaccuuuuuccccgaggagaucaguagcaugguauugacuaagaugaaagaaauugcggaggccuaucuggguggcaaggugcacuccgcagucaucacugugccagccuacuuuaaugauagccaaaggcaggccaccaaagacgcagggaccauuacgggccucaacgugcugcggaucauuaaugaacccacugccgcggccaucgcauaugguuuggauaagaaagggugugccggcggcgagaagaacguccugauuuucgaccucggggguggcaccuuugauguguccauccugacuaucgaggacgggauuuucgaaguaaagaguaccgcaggcgauacccaucuggguggcgaggacuuugacaaucgcauggugagccaccucgccgaagaguucaaaaggaagcauaaaaaggauaucgggccaaacaaacgggccguccgcaggcugcggacugcgugcgaacgcgcaaagaggacguuguccagcaguacccaggccuccauugagaucgacagccuguacgagggcguggauuucuauacuuccauuacccgggcccgcuuugaggaacucaaugcagaccuguucagggggacccuggaaccgguggagaaggccuugcgggaugcgaaacucgacaagggucagauccaagaaaucguccuggugggcgggaguacucgcauucccaaaauccagaagcugcuccaggacuuuuucaacggcaaagagcugaauaagagcauuaacccagaugaggccguagcauacggugccgcagugcaggccgccaucuugauuggcgauaaguccgaaaauguccaagaccugcuccugcuggaugugacgcccuugagccucgggaucgagaccgcaggcggggucaugacuccacugaucaaaaggaacaccaccauucccacuaagcagacgcagaccuuuacuaccuacagugacaaccaauccagcgugcuggugcagguauaugaaggcgagcgggccaugacuaaagacaauaaccuccuggguaaguucgauuugaccgggaucccgcccgcgccaaggggcgugccccagauugaagucacguuugacaucgaugccaaugguauucugaacgugaccgcagccgacaaaaguacuggcaaggagaauaagaucaccauuacuaacgauaaagggcgccucuccaaggacgauaucgaccggaugguccaggaggccgaaagguacaaaagcgaggaugaagcaaaucgcgaccggguggcggccaagaacgcacuggagagcuauaccuacaauaucaaacaaacgguggaggaugaaaagcugaggggcaaaauuuccgagcaggacaagaacaagaucuuggauaaaugucaggaaguaauuaauuggcucgaccgcaaccagauggccgagaaggacgaauaugagcacaaacaaaaggagcuggaacgggugugcaauccaaucauuaguaaacuguaccaagggggccccggugggggcagcggcggggguggcuccggggccagcggcgguccaaccaucgaggaagucgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3293 - RNA, 2905 nt, Artificial Sequence
  mRNA product Design2 comprising derived and/or modified sequence from Homo sapiens__NP_002145.3 __HsHSPA4 (opt7)
ggggcgcugccuacggagguggcagccaucuccuucucggcaucaagcuuaccaugagcguggucggcaucgaccugggguuccaguccugcuacguggccguagcaagggccgguggcauugagaccaucgcgaacgaauauagugaucgguguacucccgccugcauuagcuuugggccaaagaaucgcuccaucggcgcagccgcaaaaagucaagugauuagcaacgccaagaauaccguccaggguuucaaaagguuucacgggcgggcguucuccgacccguuuguggaggccgaaaagagcaaccucgcauacgauaucgugcagcugcccacgggcuugacuggcaucaaagucaccuauauggaggaagaacgcaauuucaccacugaacaggugaccgccaugcugcucuccaagcugaaggaaacggccgagaguguauugaaaaagccaguggucgacuguguggugagcguccccugcuuuuacacugaugcagaaaggcgguccgugauggacgccacccaaauugcggggcugaacugucuccgccugaugaaugagacuaccgccguagcacuggccuaugguaucuacaaacaggaucucccagcacuggaggaaaagcccaggaacguggucuucguggacaugggccauagcgccuaucaggugagugucugcgccuuuaaucgggggaaauugaaggugcuggcgaccgcauucgauacgacucucggcggucgcaaauuugacgagguacuggugaaccacuucugugaagaguucgggaagaaguacaaacuggauauuaaguccaaaaucagggccuugcuccggcugagccaggaaugcgagaagcugaaaaagcucauguccgccaaugcaagugaccugccauugagcauugaguguuuuaugaacgaugucgacguguccggcaccaugaaucgcggcaaguuccuggaaaugugcaacgaccuccuggccagggucgagccgccccugcggagcguguuggaacaaacuaaacucaagaaagaggauaucuacgcgguggaaauuguagggggugccacccgcaucccagcagugaaggagaaaaucaguaaguuuuucggcaaggagcuguccaccacucugaaugccgacgaagcagucacgagggggugcgcccuccagugugccauucugagccccgcauuuaaagugcgggaguucaguaucaccgaugucgugccauaucccauuuccuugcgcuggaacagcccggccgaagagggcagcuccgacugcgaaguguuuaguaagaaccaugcggcccccuucagcaaaguacugacuuuuuacaggaaggagccauucacccucgaggcauauuacuccagcccccaggaucugccauaucccgacccagccaucgcccaguuuagugugcaaaaagucaccccgcaguccgaugguagcuccaguaaggugaaggucaaagugcgggugaauguacacggcauuuucagcgucuccagcgcaagucugguggaagugcauaaguccgaggaaaacgaggagcccauggaaacugaccagaaugcgaaagaggaagagaagaugcaagucgaucaggaggagccacacguggaggaacagcagcaacagacgcccgccgagaacaaagcagaaagcgaggaaauggagaccucccaggccgggaguaaggacaaaaagauggaucagccaccccaagccaagaaagcaaaggugaaaacuagcaccguagacuugccgaucgagaaucagcuccuguggcagaucgacagggaaaugcugaaccucuacauugagaaugaaggcaagaugaucaugcaggauaaacuggagaaggaacgcaacgacgccaagaaugcggucgaggaguauguguacgaaaugcgggauaaauuguccggggaguacgaaaaguuugugagcgaggacgauaggaacaguuucacccugaaacucgaggacacugaaaauuggcuguaugaggauggugaagaccaaccaaagcaggucuacguggauaaacuggccgaguugaagaaccugggccagcccauuaagauccgcuuccaggaauccgaggagcggcccaaacucuuugaggagcuggggaagcaaauucagcaguauaugaaaaucaucagcuccuucaagaauaaagaagaccaauacgaucaccucgacgcagccgauaugacgaagguagagaaaagcaccaacgaagccauggaguggaugaauaacaagcugaacuugcagaauaagcagagucugacuauggacccaguggucaaaagcaaggagauugaagcaaaaaucaaggagcucaccuccacuuguagucccauuaucagcaaaccaaagccgaagguggaacccccaaaagaggagcagaagaacgccgaacaaaauggccccguggacggucagggcgauaacccagggccccaggcggccgagcagggcaccgacacggcagucccguccgauagcgacaaaaagcugccagaaauggauauugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3294 - RNA, 2902 nt, Artificial Sequence
  mRNA product Design2 comprising derived and/or modified sequence from Homo sapiens__NP_055093.2 __HsHSPA4L (opt7)
ggggcgcugccuacggagguggcagccaucuccuucucggcaucaagcuuaccaugagcguggucggcaucgaccugggguuccucaacugcuacauugccguggcaagguccgguggcaucgagaccauugccaaugaauauagugaucgguguacucccgcgugcaucagccuggggucccgcaccagggccauuggcaacgcagccaagagucagaucguaacgaaugugcggaacacuauccacgguuuuaaaaaguugcaugggcgcagcuucgacgauccaauuguccaaaccgagaggauccggcugccguacgaacuccagaaaaugcccaauggcuccgcaggcgugaaggugcgcuaucuggaggaagagaggccauuugccauugagcaggucaccgggauguugcuggcgaaacucaaggaaacuagcgagaacgcccugaagaaacccguggcagacuguguaaucuccauuccaaguuucuuuaccgaugccgaacggcgcagcgugauggccgcagcccaggucgcgggucugaauugccucaggcugaugaacgagacgacugccguggcauuggccuacggcaucuauaagcaagaccugcccccacucgaugagaaaccgcggaauguggucuucauugacauggggcacuccgcauaccaggugcugguaugugccuuuaacaagggcaaacugaagguguuggccaccacuuucgaucccuaucucggugggcgcaauuuugacgaagcgcuggucgauuacuucugcgacgaguuuaaaaccaaguacaagaucaacgugaaagaaaauagcagggcacugcuccggcuguaucaggagugugaaaaguugaaaaagcugaugagugccaacgccuccgaucucccacugaauaucgagugcuucaugaacgaccuggacgugagcuccaaaaugaaccgcgcacaguucgagcaauugugugccagucuccuggcgagggucgaacccccacugaaggccgugauggagcaggcaaaucuccagcgggaagauauuagcuccaucgagauuguaggcggcgccacccgcauccccgcagugaaggaacagauuacgaaauuuuuccugaaggacaucagcacuaccuugaacgccgaugaggccgucgcaagggggugcgcccugcaaugcgcgauccucaguccggccuuuaaagugcgggaguucuccauuacugaccugguccccuacagcaucacccugagguggaagaccaguuuugaagaugguuccggcgagugugaaguguucugcaaaaaucauccagcacccuuuagcaaggugauuacuuuccacaagaaagagccauuugaauuggaggccuucuauacgaaccuccaugagguacccuacccagacgcccgcaucgggagcuuuaccauucagaauguguucccgcaguccgauggcgacaguagcaaggucaaagugaagguccgggugaacauccacgguaucuuuuccguggcaagcgcgaguguaauugaaaaacaaaaucuggagggcgaucacuccgacgcccccauggaaacugagaccagcuucaagaacgagaauaaggauaacauggacaaaaugcaaguggaccaggaagaggggcaucagaagugucacgcagaacauaccccagaggaagagaucgaucacacuggcgccaaaacgaaguccgccgucagugacaaacaggauaggcugaaucagacccucaagaaagggaaggugaaguccauugaccugcccauccaguccagcuugugccgccagcugggucaagaucuccugaacaguuauauugagaaugaaggcaaaaugaucaugcaggacaagcuggagaaagaacggaacgaugcaaagaaugccgucgaggaauacguguaugacuucagggaucgcuuggggacuguguacgagaaauuuauuaccccagaggaccuguccaagcucagcgcgguacuggaagauaccgagaacuggcucuacgaagacggcgaggaucagcccaagcaggucuauguggacaaacugcaagaauugaagaaauacggucagccgauccagaugaaguauauggagcacgaggaacggccaaaagcccugaacgaccucggcaagaagauccagcuggugaugaaagucauugaggcauacaggaauaaggaugaacgguaugaccaucuggaucccacugagauggagaaaguggaaaaguguaucuccgacgccaugaguugguugaacagcaaaaugaaugcccaaaacaagcugucccucacgcaggaucccgugguaaaagucagcgagauuguggcaaagaguaaggaacuggacaauuucugcaacccaaucauuuacaaacccaagccaaaagccgaggugccggaagauaagcccaaagcgaauagcgagcacaacgggccaauggacggccagagcgggaccgagacuaaguccgauagcaccaaggacaguagccaacauacuaaauccaguggcgaaauggaggucgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3295 - RNA, 2347 nt, Artificial Sequence
  mRNA product Design2 comprising derived and/or modified sequence from Homo sapiens__NP_005338.1__HsHSPA5 (opt7)
ggggcgcugccuacggagguggcagccaucuccuucucggcaucaagcuuaccaugaagcugagccucguggccgcaaugcuguugcugcucuccgccgcgagggccgaggaagaggacaaaaaggaagaugucggcaccgugguagggaucgaccuggguacuaccuacaguugcgugggcgucuucaaaaacgggcggguggagauuaucgcaaaugaucagggcaaccgcauuacgcccagcuauguggccuuuacuccagaaggugagagguugaucggggacgcagccaagaaucaacugaccuccaacccggagaauaccgucuucgaugcgaaacggcucauuggccgcacuuggaacgaccccagugugcagcaggauaucaaguuucugccauucaagguaguggagaaaaagaccaaacccuacauccaggucgacauuggcgggggucaaacgaagacuuuugccccagaagaaaucagcgcaauggugcugaccaaaaugaaggagacugccgaggccuaucucggcaaaaaggugacccacgcagucgugaccguacccgccuacuucaaugaugcgcagaggcaggccacgaaggacgcagggacuauugccggccugaacgugaugcggaucauuaaugaaccaaccgcagccgccaucgcguaugguuuggauaaacgcgagggggaaaagaacauucuggucuuugaccucggcggcgggacuuucgaugugucccugcugaccaucgacaaugguguguuugaggucguggcaaccaacggcgacacucaucucgggggcgaagauuucgaccagaggguaauggagcacuuuaucaaauuguacaagaaaaagacggguaaggaugugcggaaagacaaucgcgccguccaaaagcugaggcgggagguggaaaaagccaagcgcgcacugagcucccagcaucaggccaggauugagaucgaaaguuucuaugagggcgaagauuucagcgagacccucacucgggcgaaauuugaggaacugaacauggacuuguuccgcuccaccaugaagccgguccagaaggugcuggaggauagcgaccucaaaaagagugauauugacgaaaucgugcugguagggggcuccaccaggauucccaaaauccaacagcuggugaaggaguuuuucaaugggaaagaaccaagccgggguaucaaccccgaugaggccgucgcauacggcgccgcagugcaggccggggucuuguccggcgaccaagacacuggugaucucgugcugcuggacguguguccacucacgcugggcauugagaccguagggggcgugaugacuaaguugaucccccgcaacaccgucgugccgaccaagaaaagucagauuuuuagcacugccuccgauaaucagcccacggucaccaucaagguguacgaaggggagaggccacugacuaaagacaaccaccuccugggcaccuucgaucugacugguauucccccagcaccccggggcgugccacagaucgaaguaaccuuugagaucgacgucaaugggauuuugagggugacggccgaggauaaggguaccggcaacaaaaauaagaucacuauuaccaacgaccaaaaucgccucacuccggaagagaucgaacggauggugaacgaugcggagaaauucgccgaagaggacaagaagcugaaagagaggauugauacccgcaaugaacuggagagcuaugcauacagucucaagaaccagaucggggacaaagaaaagcugggcgggaaauuguccagcgaggauaaggaaacgauggagaaggccgucgaggagaaaauugaauggcuggaaagucaucaggacgccgacaucgaggauuuuaaggcgaaaaagaaagaacucgaggagaucgugcagcccauuaucuccaagcuguauggcagcgcagguccacccccaaccggggaagaggacacugccgaaaaggaugagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3296 - RNA, 2314 nt, Artificial Sequence
  mRNA product Design2 comprising derived and/or modified sequence from Homo sapiens__NP_002146.2__HsHSPA6 (opt7)
ggggcgcugccuacggagguggcagccaucuccuucucggcaucaagcuuaccaugcaggcccccagggagcuggcagugggcaucgaccucgggaccacuuacagcugcgucgguguguuccaacagggccggguagaaauucuggccaacgaucaggggaaucgcaccacgccauccuauguggcguuuacugacaccgagagguuggucggcgaugccgcaaagagucaggccgcacugaacccgcacaauaccguguucgacgccaaacggcucaucggucgcaaguuugcggauacuaccgugcaaagcgacaugaaacauuggcccuucagggucguguccgaagggggcaagccaaaaguacggguguguuaccgcggcgaggauaagacguuuuaucccgaagagauuaguagcaugguccuguccaagaugaaagagacugccgaagcauacuuggggcagccagugaagcacgccgugaucaccguccccgccuauuucaacgacagccagaggcaggcaacuaaagaugccggugcgauugccggccugaaugugcuccggaucaucaacgagccaaccgcagccgcaauugccuacgggcuggaccgcaggggcgccggugaacggaauguacugaucuuugaucucgggggcggcaccuucgacguguccguccugaguauugaugcggggguguuugaggugaaggcaacggccggugacacucauuugggcggggaggacuucgauaaccgccuggucaaucacuuuauggaagaguucaggcggaaacauggcaaggaccucagcgguaacaaacgcgcccugaggcggcugcgcaccgcaugcgaaagggccaagcggacuuuguccagcaguacccaagcgacccucgagaucgauucccuguucgaaggcguggacuuuuauacuagcauuacgagggcccgcuucgaggagcuguguuccgaucucuuucggaguacccuggaaccgguagagaaggcauugagggacgccaaacuggauaaggcacagauccacgacgugguccucgucgggggcagcacucgcauucccaaagugcagaagcugcugcaggauuucuuuaaugggaaagaauugaacaaguccaucaauccagacgaggccguggccuacggugcagccgugcaagcggccguacucaugggcgauaagugcgaaaaagugcaggaccugcugcuccuggacgucgcacccuugagccuggggcucgagaccgccggcggugugaugaccacucugauccagcggaacgccacgauuccaaccaagcaaacucagaccuucaccacuuacagugauaaucagcccggcgucuuuauccagguguaugagggggaaagggcaaugacgaaagacaacaaccuguugggccgcuucgagcucuccgggauuccgcccgcgccacggggcgugccccaaaucgaaguaaccuuugauauugacgccaaugguauccugagcgugacugcaaccgauaggaguacugggaaggccaacaaaaucaccauuacgaaugacaagggccggcuguccaaggaggaagucgagcgcauggugcacgaggccgaacaguacaaagcagaggaugaagcccagagggaccgggucgcggccaagaacagccucgaggcacauguguuccacgugaaagguagccugcaggaggaauccuugcgcgauaagaucccagaggaagacaggcggaaaaugcaagauaagugucgcgagguacuggccuggcucgaacauaaucagcuggccgagaaggaggaauaugagcaccagaaaagggaacuggagcagauuugccggcccaucuuuaguagguuguacggcgggccaggcguccccgggggcagcuccugugguacccaagcacgccagggggacccgagcacuggcccaauuaucgaagagguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3297 - RNA, 1486 nt, Artificial Sequence
  mRNA product Design2 comprising derived and/or modified sequence from Homo sapiens__P48741__HsHSPA7 (opt7)
ggggcgcugccuacggagguggcagccaucuccuucucggcaucaagcuuaccaugcaggcccccagggagcuggcagugggcaucgaccucgggaccacuuacagcugcgucgguguguuccaacagggccggguagaaauucuggccaacgaucaggggaaucgcaccacgccauccuauguggcguuuacugacaccgagagguuggucggcgaugccgcaaagagucaggccgcacugaacccgcacaauaccguguucgacgccaaacggcucaucggucgcaaguuugcggauacuaccgugcaaagcgacaugaaacauuggcccuuccaggucguguccgaagggggcaagccaaaaguaaggguguguuaccggggcgaggauaagacguuuuaucccgaagagauuaguagcaugguccuguccaagaugaaagagacugccgaagcauacuuggggcagccagugaagcacgccgugaucaccguccccacuuauuucagcaacucccagcgccaagccaccaaagacgcaggggccauugcgggccugaaggugcucccaaucaucaaugaggccaccgcagccgcaauugccuacgggcuggauaggcggggcgccgguaaacgcaacguacugaucuuugaccucgggggcggcacguucgaugugaguguccugagcauugacgcggggguguuugaagugaaggcaacugccggugauacccauuugggcggggaggacuucgacaauaggcuggucaaccacuuuauggaggaguuccggcgcaaacauggcaaggaucucuccgguaauaagagggcccugcggcgccugaggacugcaugcgagcgggccaaacgcaccccgagcaguuccacccaggcgacuuuggaaaucgacagccucuucgagggcguggauuuuuauaaguccauuacgagggcccgguucgaagaacuguguagugaccuguuuaggagcacccucgagcccguagaaaaagcacugcgcgaugccaaguuggacaaagcacagauccacgauuucgugcuggguggcgggcuccacucccauccacagggugccgaggucgccgcaggccugcugcaacggcagggggccgaacaggagcaccaacccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3298 - RNA, 2323 nt, Artificial Sequence
  mRNA product Design2 comprising derived and/or modified sequence from Homo sapiens__NP_006588.1 __HsHSPA8 (opt7)
ggggcgcugccuacggagguggcagccaucuccuucucggcaucaagcuuaccaugagcaagggccccgccguggggaucgaccuggguaccacuuacuccugcgucggcguguuccagcacgggaaaguagagauuaucgcaaacgaucaaggcaauaggaccacgccaaguuauguggccuuuacugacaccgaacggcucauuggugaugcggccaagaaccaggucgcaaugaauccgaccaacacuguguucgacgccaaacgccugaucgggaggcgguuugaugacgcagugguccagagcgauaugaagcauuggcccuucauggugguaaaugacgccggccgcccaaaagugcaggucgaguacaagggcgaaaccaaguccuuuuaucccgaggaagugaguagcaugguguugacgaaaaugaaggagauugcggaggccuaccuggggaaaacugucaccaacgcagugguaacugugccagccuauuucaaugauucccaaaggcaggccaccaaggacgcagguaccaucgccggccucaacguccugcggaucauuaaugaacccacggcggccgcaaucgccuacggguuggauaaaaaggugggcgcagagcgcaacgugcugauuuuugaccucggugggggcacuuucgaugucagcauccugaccauugaagacggcaucuuugaggugaaauccacugccggggacacccaccuggguggcgaggauuucgacaauaggaugguaaaccauuuuauugccgaauuuaagcggaagcacaaaaaggauaucagugagaauaaacgcgcggugaggcggcuccgcaccgcaugugaaagggccaagcggacucugagcuccagcacgcaggccaguaucgagauugacuccuuguaugaagggaucgauuucuacaccagcauuacucgcgcaagguuugaggagcugaacgccgaccucuuccggggcacccuggauccagucgaaaaagcgcugcgcgacgccaaguuggauaagucccagauccaugacauugugcucgucgguggcaguaccaggaucccgaaaauccaaaagcugcugcaggauuucuucaaugggaaagagcucaacaagagcauuaaccccgacgaagcaguggccuacggcgcagccgugcaggccgcaauccuguccggggacaaaagcgagaauguacaggauuugcugcuccuggacgugacuccacugaguuuggguauugaaacggccggcggggucaugaccgugcucaucaagcggaacacuaccauucccaccaagcaaacucagacguuuaccacuuauuccgauaaucagccaggcguccugauccaaguguacgagggugagagggcgaugaccaaagacaacaaucugcucggcaaguucgaacugacugggauucccccggcaccccgcggcgugccacagaucgagguaaccuuugauaucgacgccaacgggauuuugaaugugagcgccgucgauaaaaguacgggcaaggaaaacaaaaucaccauuacuaaugacaagggucggcuguccaaggaggauaucgaaaggauggugcaggaggccgagaaauauaaggcagaagacgagaaacagcgcgauaaggucagcagcaaaaacucccucgaaaguuacgcguucaauaugaaggccaccguggaggacgagaaacugcaagggaagauuaacgaugaagacaagcagaaaauccuggacaagugcaaugagaucauuaacugguuggauaaaaaucagacugcagaaaaggaggaauuugagcaccagcaaaaagagcucgaaaagguguguaaccccaucauuaccaagcuguaucagagcgccggcgguaugccaggcgggaugcccggcggguucccaggcgguggggccccgcccuccggcggcgcaagcagugggccaacgaucgaggaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3299 - RNA, 2422 nt, Artificial Sequence
  mRNA product Design2 comprising derived and/or modified sequence from Homo sapiens__NP_004125.3 __HsHSPA9 (opt7)
ggggcgcugccuacggagguggcagccaucuccuucucggcaucaagcuuaccaugaucagcgccuccagggcagccgcggcccggcuggugggcgcagccgcaagucgcgggcccaccgccgcgaggcaccaggacagcuggaacggucucucccaugaggccuuccggcuggucagucgcagggauuacgcaagcgaagccauuaagggcgccgugguagggaucgacuugggcacuaccaauuccugcguggcagucauggaggguaaacaagccaaggugcuggaaaacgcggagggggcccggacgacuccaagcguggucgcauuuaccgccgauggcgaacgccucgugggcaugccggcaaaaaggcaggccguaaccaaucccaacaauacuuucuaugccaccaagcggcugauugggcgcagguacgacgauccagaggugcagaaagacaucaagaacguccccuuuaagauugugcgggcguccaauggugaugcauggguggaggcccacggcaaauuguauaguccaagccagaucggggccuucguccugaugaagaugaaagaaacggcagagaacuaccucggccauacugccaagaaugcggugaucaccguacccgccuauuuuaacgacucccaacgccaggcaacuaaagaugccggucagauuagcgggcugaaugugcugagggucaucaacgaaccaaccgcagccgcccucgcauacggccuggacaagagugaggauaaagugauugccguguaugacuugggcggggguaccuucgauaucuccauucuggagauccagaagggcgucuuugaaguaaagagcacgaauggggacacuuuccucggcggugaggacuuugaucaagcgcugcugcggcacauugugaaagaguucaagcgcgaaaccggcguggacuugacuaaagauaacauggcccuccagaggguccgggaagcagccgagaaggccaaaugugagcuguccaguagcgugcagaccgacaucaaucugccguaccucaccauggauuccagcgggcccaagcaucugaacaugaaguugacucgcgcacaguuugaaggcaucgucacggaccugauuaggcggaccaucgcgccaugccaaaaagccaugcaggaugcagaggugaguaaguccgacauuggggaagugauccucguagguggcaugacuaggaugcccaaagugcagcaaaccguccaggaucuguucgggcgcgccccaagcaaggccgugaaccccgacgaggcagucgccauuggcgcggccauccaggguggcgugcuggcaggggaugugaccgacguauugcuccuggacgugacuccgcugagucucggcaucgaaacgcugggcggggucuucaccaaauugauuaaucggaacacuaccauccccaccaagaagucccagguguuuagcacugccgccgauggucaaacgcaggucgagauuaaagugugucagggggagagggaaauggcaggcgacaauaagcugcucggucaguucacccugaucggcauuccacccgccccacgcggggugccccaaaucgagguaacuuuugauaucgacgcgaacggcauuguccacgugagcgccaaagauaaggggaccggccgggaacagcagaucgugauucaguccaguggugggcugagcaaagacgauaucgagaauauggucaagaacgcagaaaaguacgccgaggaggacaggcgcaaaaaggaacggguggaggcagugaauauggccgaaggcauuauccacgauacugagaccaaaauggaggaguucaaggaccaauugccagcggaugaaugcaacaaacucaaggaagagauuuccaaaaugagggaacugcuggcccggaaggacagcgagacgggcgagaauauccgccaggcagccaguucccuccagcaggccagccugaaguuguuugaaauggcauauaaaaagauggccuccgagagggaagggagugguagcuccggcaccggggagcaaaaagaagaucagaaggaggagaaacagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3300 - RNA, 2410 nt, Artificial Sequence
  mRNA product Design2 comprising derived and/or modified sequence from Homo sapiens__NP_079291.2__HsHSPA12A (opt7)
ggggcgcugccuacggagguggcagccaucuccuucucggcaucaagcuuaccauggccgacaaggaggcaggcgggagcgauggucccagggaaaccgccccaacuuccgcguacaguagcccggcccggucccugggcgacaccgggaucacgccccucaguccaagccacauugugaacgauacugacuccaaugucagcgagcagcaauccuuccuggugguaguggcagucgauuuuggcaccaccaguagcgguuaugccuacuccuucacuaaagaacccgagugcauccaugugaugaggcgcugggaagggggcgacccaggcgugagcaaccagaagacccccacgacuauuuugcugaccccagagcggaaauuucacaguuucggguaugcagcccgcgauuuuuaccaugaccucgauccgaaugaggcgaagcaguggcuguauuuggaaaaauucaagaugaagcugcacacuaccggugaccucaccauggauacggaccugacugccgcaaacggcaaaaaggucaaagcccuggagaucuuugccuacgcacuccaguauuucaaggaacaagcccugaaagaguuguccgaucaggcggggagcgaguuugaaaauuccgacgugagguggguaauuaccgugcccgccaucuggaagcagccagcaaaacaguucaugcggcaagccgcauaccaggccggccuggccagucccgagaacagcgaacagcucaucauugcgcuggagccagaagcagccuccaucuacugucgcaagcugagguugcaucagaugauugagcucagcaguaaggccgcagucaaugguuauuccgggagcgacacugugggcgccggcuuuacccaagcgaaagagcacauccggcgcaacaggcagagucggaccuuccugguggaaaaugucauuggggagaucugguccgaacuggaggaaggugauaaguacgugguaguggacagcggcgggggcacugucgaucucacggugcaccagauucgccugcccgagggucauuugaaagagcuguauaaggccaccggcgggccguacggcagccucgggguggacuaugaguucgaaaaacugcuguacaagaucuuuggugaagauuucaucgagcaauuuaagauuaaaaggcccgcagccugggucgacuugaugaucgcauucgaaucccggaagcgcgccgccgcaccagauaggacuaacccccucaauauuacccugccauuuaguuucaucgacuauuacaaaaaguuucggggccacagcguggagcaugcccugcgcaaauccaacguagauuucgugaaguggagcagucaggggaugcucaggaugucccccgacgcgaugaaugcccuguuuaagccaaccauugauagcaucaucgagcacuugcgggaccuguuccagaaaccggaagucuccacugugaaguuucucuuccuggucggcgguuuugcagaggcaccccuguugcagcaagccgugcaggccgcguucggcgaccagugcaggauuaucauuccacaggauguggggcucacgauccugaaaggcgccguacuguucgggcucgaccccgcagugauuaagguccgccggaguccacugaccuacggcgugggugucuugaacagguauguggaagggaaacaucccccggagaagcugcucgugaaggauggcacucgcugguguaccgacguauuugauaaauucaucagcgccgaccaauccguggcccugggugagcuggucaagcggagcuacaccccagcaaaacccagucaguuggugaucgucauuaauaucuauuccagcgaacacgauaacguguccuuuauuacugaccccggcgugaagaaaugcgggacgcugaggcucgaucugaccggcaccagugggacugccguaccagcgcgccgggagauccagacucucaugcaguucggcgacaccgaaauuaaggccacggcaaucgauauugccaccagcaaauccgucaagguggguaucgacuuucugaacuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3301 - RNA, 2443 nt, Artificial Sequence
  mRNA product Design2 comprising derived and/or modified sequence from Homo sapiens__NP_443202.3 __HsHSPA12B (opt7)
ggggcgcugccuacggagguggcagccaucuccuucucggcaucaagcuuaccaugcuggccgugcccgagaugggccuccaggggcuguacaucgguagcuccccagaaaggaguccgguccccagcccacccggcuccccacggacccaagagaguugcgggauugcacccuugacuccaagccaguccccgaagcccgaagugcgcgccccacagcaggcgagcuucuccguaguggucgccaucgacuuuggcaccacgaguagcgguuaugcauucuccuuugccagcgaucccgaggcaauucacaugaugaggaaaugggaagggggcgacccaggcguggcccaucaaaagacucccaccugucugcuccugaccccggagggggcguuccacaguuuugguuacacugcccgggauuauuaccaugacuuggaucccgaggaagcacgcgacuggcuguauuucgagaaauuuaagaugaaaauccacuccgccaccgaucucacgcugaagacucagcuggaagccgugaacggcaagaccaugccagcacucgaggucuucgcccaugcgcugagguuuuuccgggagcacgccuugcaggaacugcgcgagcagagccccucccucccagaaaaagacacugugagguggguacugaccgugcccgcaauuuggaagcaaccagccaaacaguuuaugcgggaggcagccuaccuggccggguuggucagucgcgaaaaugcggagcagcuccugaucgcacuggagccggaagccgccagcguguauugcaggaagcuccggcugcaccaguugcuggaucucuccggccgcgcacccggugggggcaggcugggcgagcggcgcagcaucgacaguuccuucaggcaagcccgggaacagcugcgcaggagccggcauaguaggaccuucuugguggaguccggggucggugaacucugggcggagaugcaggccggcgaucgcuacgugguagcagacugugggggcgguacgguggaucugacuguccaccaacuggagcagccacauggcacccucaaagaacuguacaaggccagcgggggccccuauggggcaguggguguggacuuggccuuugagcagcugcucugccggauuuucggcgaagacuuuaucgccacuuucaaaaggcagcgcccagcagccugggucgaucugaccauugcguuugaggcccggaagaggaccgcagggccccaccgcgccggcgcccugaacaucagcuugccguucuccuuuauugacuucuaccggaagcaaaggggucacaauguggaaacugcacuccggcgcaguagcguaaacuuugugaaaugguccagccagggcaugcugaggaugaguugugaggcgaugaaugagcuguuccagccaacggucuccgggaucauucagcauaucgaagcccuccuggcacggcccgaggugcaaggcgucaaguugcuguuucucguagggggcuucgccgaaagcgccgugcugcagcacgcagugcaggccgcgcugggugcccgcggguugaggguggucgugccccaugaugucggccugaccauccucaaaggugcagugcuguuuggccaggccccaggggugguacgggugcgcaggaguccccucacuuauggcgucggggugcugaaccgguucgucccaggcaggcacccgcccgagaaguugcuggugcgcgacggucggagguggugcaccgauguguucgagcgcuuuguagccgcagaacaauccgucgcccucggggaggaagugcggaggagcuacuguccagcgcgccccggccagcggagggugcugauuaaucuguauugcugugccgcagaggacgcccgcuucaucaccgauccaggcguccggaaaugcggggcauugucccuggaacucgagcccgccgacugcggucaggauacugcgggcgccccgccagggaggcgcgagauucgggcagccaugcaguuuggcgacacggaaaucaaggugaccgccguggauguaagcacuaacaggaguguccgcgcauccauugacuuccugagcaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3302 - RNA, 1798 nt, Artificial Sequence
  mRNA product Design2 comprising derived and/or modified sequence from Homo sapiens__NP_008879.3__HsHSPA13 (opt7)
ggggcgcugccuacggagguggcagccaucuccuucucggcaucaagcuuaccauggccagggagaugaccauccugggcagcgcagugcucacucuguugcuggccggguaccucgcgcagcaauaucugcccuugccaaccccgaaggucauugguaucgaccugggcacgacuuacugcuccguggggguauucuuucccggcaccgguaaagugaaggucauuccagaugaaaacgggcacaucaguauucccagcaugguguccuucaccgacaaugauguguaugucggcuacgagaguguggaacucgccgacagcaacccacagaauacuaucuaugaugcaaaacgguuuaucggcaagauuuucaccgccgaggaacuggaggcagagaucgggcgcuaccccuuuaaaguacugaacaagaaugguaugguggaguucuccgucacgagcaacgaaacuauuaccguguccccagaauaugugggcaguaggcuccuguugaagcugaaagagauggccgaggcguaccucgggaugccggucgccaaugcagugaucagcguacccgccgaauuugaccugaagcagcggaacuccacuauugaggccgcaaaucuggccggcuugaaaauccuccgcgugauuaacgaaccaaccgcggccgcaauggccuacggucugcauaaggcagaugucuuccacgugcuggugaucgaccucgggggcggcacccuggaugucagcuugcugaauaaacaaggggguauguuucucacgagggccaugaguggcaacaauaagcucgggggccaggacuucaaccagcggcuguugcaguaucucuacaaacagaucuaucaaacuuacgguuuugugcccucccgcaaggaggaaauucauaggcugcggcaggccguagagauggugaagcugaaucucacccugcaccagagcgcgcaguuguccguccugcucacuguggaggaacaagaucgcaaagagccacauaguagcgacaccgaacugcccaaggauaaacuguccagcgcagacgaccacagggucaacaguggcuucgggcggggcuuguccgauaagaaaagcggggagagucaggugcuguucgaaaccgagaucucccgcaagcuguuugacacucugaacgaggaucucuuccagaagauucuggugccgauccaacagguauugaaagaaggucaccuggagaagacggaaauugacgaggugguccucgugggcgggagcaccaggaucccccggauccgccaggucauucaggaauuuuucggcaaagauccaaauacuagcguggaccccgaucuggccgugguaaccgguguggccauccaagcaggcauugacgggggcuccuggccacugcaggucagugccuuggagauccccaacaagcaucugcagaaaaccaauuuuaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3303 - RNA, 1912 nt, Artificial Sequence
  mRNA product Design2 comprising derived and/or modified sequence from Homo sapiens__NP_057383.2__HsHSPA14 (opt7)
ggggcgcugccuacggagguggcagccaucuccuucucggcaucaagcuuaccauggccgcaaucggcgugcaccuggggugcaccagcgccugugucgcgguguacaaggacgguagggccggcguaguggcaaacgaugccggggaccgggucacucccgcagugguggccuauuccgagaaugaagagauugucggccucgcggccaaacagagucgcaucaggaacauuagcaauaccgugaugaagguaaaacaaauccugggucgguccaguagcgauccacaggcacagaaguacauugccgaauccaaaugcuuggugaucgagaagaacgggaagcugcgcuaugaaaucgacacgggcgaggagacuaaauucgucaauccggaagauguggccaggcucauuuuuagcaagaugaaagagaccgcacauuccgugcugggcagugacgccaacgaugucgugaucaccguacccuucgacuuuggggaaaagcagaaaaaugcguugggugaggccgcacgggccgcaggcuucaacgugcugcgccucauucacgagccaagcgccgcccugcuggcguacgggaucggccaagauucccccacugguaagagcaauauucucgucuuuaaacugggcgggaccaguuugucccugagcgugauggaagugaacuccggcaucuauaggguccucaguacgaauacugacgauaacauugggggugcacauuucaccgagacucuggcccaguaccuggccagcgaauuucagcgguccuucaagcacgacgugcgcggcaaugcaagggccaugaugaaguugaccaacagcgcggagguagccaaacauagucucuccacccuggggagcgcaaauuguuuucuggauagucucuaugaaggccaggacuucgacugcaacgugucccgggcccgcuuugagcuguuguguagcccacuguucaacaagugcaucgaggcaaucaggggucuccuggaucaaaauggcuucacggccgacgauauuaacaaagucgugcugugugggggcagcucccggauccccaaguugcagcagcucauuaaagaccuguuuccagccgucgaacugcucaauaguaucccgcccgaugaggugauuccaaucggggcagccaucgaagcggguauucugaucggcaaggagaacuugcugguggaagacagccucaugauugagugcuccgcccgcgauauccugguaaaggggguggacgagagcggcgcaaguagguucacuguccuguuucccuccgguaccccauugcccgcccggcgccagcacacucuccaagccccgggcagcauuuccagugugugucuggaacuguacgagagcgaugggaaaaauuccgcaaaggaagagaccaaauucgcgcaggucgugcuccaggaccuggauaagaaagaaaacggcuugagggacauccuggccgugcucaccaugaagcgggacgggagccugcacguaacuugcacggaucaagagaccggcaagugcgaggcaaucaguauugaaaucgccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3304 - RNA, 2959 nt, Artificial Sequence
  mRNA product Design2 comprising derived and/or modified sequence from Homo sapiens__NP_006635.2 __HsHSPH1 (opt7)
ggggcgcugccuacggagguggcagccaucuccuucucggcaucaagcuuaccaugagcguggucggccuggacguggggucccagaguugcuacaucgccguagcaagggccgguggcauugaaaccaucgcgaacgaguucagcgaucgguguacucccuccgugauuaguuuugggagcaagaaucgcaccaucggcgucgccgccaaaaaccaacagauuacgcacgcaaauaacacuguguccaauuucaagagguuucauggucgggcauucaacgacccauuuauccagaaagagaaggaaaaucucagcuaugaucuggugccguugaaaaacgggggcgucggcaucaaggugauguacaugggggaggaacaccuguucuccguagagcagauuaccgccaugcuccugaccaaguugaaagagacugcggaaaauagucugaagaaacccgugaccgacugcgucaucagcgugccauccuuuuucacggaugccgagcgcaggagcgugcucgacgcagcccaaauugucggucugaacugucugcggcucaugaaugauaugacugccguggcacugaacuauggcaucuacaagcaggacuugcccagucuggaugaaaaaccacgcauuguaguguuugucgacauggggcauuccgccuuccaggugagcgcgugcgccuuuaauaagggcaaacucaaggugcuggguaccgcauucgaucccuuccugggcgggaagaacuuugacgagaaauuggucgagcacuucugugccgaauuuaagacuaaauauaagcucgaugcaaaauccaagaucagggcccugcugcggcucuaccaggagugcgaaaagcugaaaaaguugaugaguagcaauuccaccgaccugccacucaacauugaguguuucaugaacgacaaagaugugagcggcaagaugaaucgcagucaauuugaagaacugugcgccgagcuguugcagaaaaucgaaguaccgcucuauucccugcuggagcagacccaucucaagguggaagacgucagcgcgguggagaucgucgggggugcaacgaggauucccgccgugaaggaacggaucgccaaauucuuuggcaaggauauuaguacuacccugaacgcagacgaggccguggcgcgcgggugugccuugcagugcgcaauccuguccccagccuucaaaguaagggaguuuagcgugacugaugcaguccccuucccaauuagccucaucuggaaucacgacuccgaagauaccgagggcgugcacgaagucuuuagucggaaccaugccgcccccuucagcaaggugcugaccuuucugcgcagggguccguucgaguuggaagcauucuacuccgacccccaaggcgugccauaccccgaggccaaaaucgggcgguuuguagugcagaaugucagcgcgcagaaggauggcgagaagagucgcgugaaagucaaggugagggugaacacucacgggauuuucacgaucuccaccgccagcaugguagaaaaagucccaacugaggaaaaugagauguccagugaggcagacauggaaugccucaaccaacggcccccagagaauccggauaccgacaagaacgugcagcaggacaauagcgaagccgguacccagccccaagugcagacugaugcccagcagacgucccaaagcccacccaguccagagcugaccuccgaagagaacaaaauucccgacgcagauaaggcgaaugagaaaaaggucgaccagccgccagaagccaagaaacccaagaucaaaguggugaacguagagcugcccauugaagcaaaucucgucuggcagcugggcaaggauuugcugaacauguauaucgagacugaagggaaaaugaucaugcaggacaagcucgagaaggagaggaacgaugccaaaaaugccguggaagaguacguguaugaauuucgcgacaagcuguguggcccauacgagaaauucauuugcgaacaagaucaucagaacuuucugcgguugcugaccgagaccgaggacuggcucuaugaagagggugaagaucaggcaaagcaggccuacgucgacaaacuggaggagcucaugaagaucggcacucccgugaagguaagguuccaagaagcggaggaacgcccaaaaauguuugaggaacuggggcagcgguugcagcacuaugccaagauugcagccgauuucaggaauaaagacgagaaguacaaccacaucgacgagagcgaaaugaaaaagguggagaaauccgucaaugaagugauggaguggaugaacaaugugaugaacgcccaagcaaagaagagucuggaucaggacccggucgugcgcgcccaggaaauuaaaacgaagaucaaagagcucaauaacaccugugagcccguagugacucagccaaagcccaaaauugaaagcccaaagcuggagcggacccccaauggcccgaacaucgauaagaaagaagaggaccuggaggauaagaauaacuuuggggcggaaccaccccaucaaaauggcgagugcuacccaaacgagaaaaacuccgucaauauggacuuggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3305 - RNA, 3382 nt, Artificial Sequence
  mRNA product Design2 comprising derived and/or modified sequence from Homo sapiens__NP_006380.1 __HsHYOU1 (opt7)
ggggcgcugccuacggagguggcagccaucuccuucucggcaucaagcuuaccauggccgacaaggugaggcggcagcgccccaggcggcgcgucugcugggcacugguggccguacuccuggcggauuugcuggcccucagcgacacccuggcagugauguccgucgauuugggcagugagagcaugaaaguggccaucgugaagccaggggucccgauggaaauugugcugaacaaagaguccaggcggaagacucccguaaucgugacccucaaagaaaaugagcgcuucuuuggugacagugcagccagcauggcgauuaagaacccaaaggccacgcugagguacuuccaacaucugcucggcaaacaggcagauaauccccacgucgcccuguaucaggcccgguuuccagaacacgaguugacuuucgacccccagcgccaaaccgugcauuuucagaucuccagccagcugcaguucuccccagaggaagugcucgggaugguccugaacuacaguaggagccuggcagaggauuuugccgaacaaccgauuaaggacgcggugaucaccguacccguguucuuuaaucaggccgagcggcgcgcagucuugcaggccgcaaggauggccggccucaaagugcugcagcugaucaacgauaauacugccaccgcgcucuccuaugguguguuccggcgcaaggacauuaacacgacugcacaaaauaucauguuuuacgauauggggagcggcaguaccgucuguacuauugugaccuaucagaugguaaaaaccaaggaggccggcaugcagccacaacugcagaucaggggugugggguucgaccggacguugggcgggcuggaaauggagcuccgccugagggaacggcuggccggcuuguucaacgagcagaggaaaggucagcgcgcaaaggauguccgggaaaaucccagggccauggcgaagcuccugcgcgaggccaaccggcugaaaacugugcucuccgcaaaugccgaccacauggcacaaauugaggggcugauggacgaugucgacuuuaaggccaaagugaccaggguggaguucgaggaauugugcgccgaucuguuugagcgcguaccaggccccgugcagcaggcacuccagagcgccgaaaugucccuggacgagaucgagcaagucauucuggugggcggggcgacucgggucccgagggugcaggaaguguugcucaaggccguagguaaagaggaacugggcaagaacaucaaugcagaugaggccgccgcaaugggggcgguguaccaggccgcagcccugaguaaggccuucaaagucaagcccuuugugguccgggacgcagugguguauccaauccucguagaguucacccgcgaggucgaggaagaacccggcauucauagccugaaacacaacaagaggguguuguuuucccggauggguccauacccccagcgcaaagugaucaccuucaacagguacagccacgauuuuaauuuccauauuaacuauggcgaccugggguuucucggcccagaagaucugcgggucuucgggagucaaaaucugacuacggugaaguugaagggugugggcgacuccuuuaaaaaguacccggauuaugagagcaaagggaucaaggcccacuucaaccuggacgagaguggcguacucucccuggaccgcgucgaaagcguguucgagacccucguggaagauagcgcggaggaagaguccacucugaccaaauuggguaauaccauuaguagccuguuuggcgggggcacuacgcccgacgccaaggagaacgggaccgauacuguccaggaagaggaagaguccccagcagaaggcagcaaggacgagcccggugaacagguggaacucaaagaggaagccgaggccccaguagaagaugggagucagcccccgccacccgagcccaagggcgacgcaaccccagagggugaaaaagccaccgagaaggaaaauggcgauaaauccgaggcgcaaaagcccagcgagaaagccgaagcagggccagagggcguggccccggcacccgaaggggagaagaagcagaaaccagccaggaagcggaggauggucgaagagaucggcguggagcuggugguccuggacuugcccgaucugccagaagacaaacucgcgcaguccgugcaaaagcugcaggaucucacucugcgcgacuuggagaaacaggaacgggagaaggccgcaaacagucuggaagccuucaucuuugagacgcaggauaagcuguaccaacccgaguaucaggaaguaagcaccgaggaacagagggaggagauuuccgguaaacucagcgccgcaaguacuuggcuggaagacgagggggugggcgccaccacugucauguugaaggaaaaacuggcggagcuccgcaagcugugucagggccucuucuuucggguggaagagaggaaaaaguggccggagcgccuguccgccuuggacaaucugcugaaccauagcuccauguuccucaagggggcacggcugaucccagaaauggaucaaauuuuuaccgagguggaaaugacgaccuuggagaaagucaucaaugaaacuugggccuggaagaacgcaacccuggccgagcaggccaaacuccccgcaacugagaagccagugcugcugaguaaagacauugaagcgaagaugauggcccucgauagggagguacaguaccuguugaauaaagccaaguucaccaagccccgcccgcggcccaaagacaagaacgguacgagggcagaaccaccccugaaugccagcgcauccgaucagggcgagaaagugaucccacccgccgggcaaaccgaagacgcggagccaaucagcgagccggaaaaggucgagacuggcagugaacccggugauaccgagccacucgagcugggcgggcccggcgccgaaccagagcagaaagaacaguccacugggcaaaagcgccccuugaagaacgacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3306 - RNA, 2581 nt, Artificial Sequence
  mRNA product Design2 comprising derived and/or modified sequence from Homo sapiens__NP_005339.3 __HsHSP90AA1 (opt7)
ggggcgcugccuacggagguggcagccaucuccuucucggcaucaagcuuaccaugcccgaggaaacccagacucaagaccagccaauggaggaagaggaaguggagaccuucgccuuucaggcagagaucgcccagcugaugagccucauuaucaacacguucuacuccaauaaggaaauuuuucugagggaguugaucaguaacagcuccgaugcgcuggacaaaauucgguaugaaagucucacugauccgagcaagcuggacuccggcaaagaguugcacaucaaucugauccccaacaagcaagaucgcacccucaccauugucgacacugggaucgguaugaccaaagccgaucugauuaauaaccugggcacgaucgcaaagagcgggacuaaggccuucauggaggcacuccaggccggcgcggacauuuccaugaucggucaguuuggggugggcuucuacagugccuaucugguagcagaaaaagugaccgucauuacuaagcauaaugaugacgagcaguacgccugggaaagcuccgccggcgggagcuuuaccgugaggaccgauacgggugagccaaugggccgggggacuaaagugaucuugcaccugaaggaagaccaaaccgaguaucucgaggaacgcaggaucaaagagauugucaagaaacauagucaguucaucggcuaccccauuacucuguuuguggaaaaggagcgggauaaggaaguauccgacgacgaggcagaggaaaaagaggauaaggaagaggaaaaagagaaggaggaaaaagagagcgaagacaagccagagaucgaggauguggguuccgacgaagaggaagagaagaaagauggggacaagaaaaagaaaaagaagauuaaagaaaaguauaucgaucaggaggagcugaacaaaaccaagcccaucuggacccgcaauccagacgauauuacuaacgaagaguacggcgaguucuacaaaaguuugacgaaugacugggaggaucaccucgccgucaagcauuuuagcguggaaggccagcuggaguucagggcgcuccuguucgugccgcggcgcgcccccuuugaccuguucgagaacaggaagaaaaagaauaacaucaaauuguauguccggcgcguguuuauuauggacaauugcgaagaacugaucccagaauaccucaacuucauuagggguguaguggauuccgaggaccugccccugaacaucagccgggaaauguugcaacagaguaagauccucaaagucauucgcaagaaucuggugaaaaagugucuggagcucuuuaccgagcuggcagaagauaaggagaacuauaaaaaguucuacgaacaguuuuccaaaaauaucaaguuggggauucacgaggacagccaaaacaggaaaaagcugagugagcuccugcgguauuacacuuccgccagcggcgaugaaauggugagccugaaggacuauugcacccgcaugaaagagaaucagaagcacaucuacuacauuaccggggaaacuaaagaucaggucgcaaacuccgccuucguggagagguugcggaagcauggccucgaaguaaucuauaugauugagccaaucgacgaguacugugugcagcaacugaaagaauuugaggguaagacgcuggucagugugaccaaggaaggccucgagcugcccgaagaugaggaggagaaaaagaaacaggaagaaaagaaaacuaaguucgagaauuugugcaaaaucaugaaggacauucuggagaagaaagucgaaaagguggugguaagcaacaggcucgugaccuccccguguugcaucgucaccagcacuuauggguggacggccaauauggagcgcauuaugaaagcgcaggcacugcgggauaacaguaccaugggcuacauggccgccaagaaacaccuggaaaucaaucccgaccauuccauuaucgagacuuugaggcagaaggcagaagccgauaagaacgacaaaagcgugaaggaccuggucauccuccuguaugagaccgcgcuccuguccaguggguuuagcuuggaggauccacaaacucacgccaaucgcauuuaccggaugaucaaacugggucucggcauugacgaagaugaccccaccgcagaugacacguccgccgcagugaccgaggaaaugccaccccuggagggggaugacgauacuagcaggauggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3307 - RNA, 721 nt, Artificial Sequence
  mRNA product Design2 comprising derived and/or modified sequence from Homo sapiens__NG_005218__HsHSP90AA3P (opt7)
ggggcgcugccuacggagguggcagccaucuccuucucggcaucaagcuuaccauggacagcuccaagcuggauaguggcaaagggcuccacaucaaccuggugcccaauaagcagaaccaaaccuugacuauugucgacaccaggaucgguaugacgaaaacugaucugauuaauaaccucggcaccgugaccaagagcgggacuaaagccuucauggaggcacugcaggccgacgcggauaucuccaugauuggccauuuugguguaggguucuacagugccuauuugguggcaaagaaggucaccgugaucagcaaacacaauaacgacgaacaguacacgugggaguccagcgccggcggcuccuuuacugugcggaccgaugaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3308 - RNA, 2557 nt, Artificial Sequence
  mRNA product Design2 comprising derived and/or modified sequence from Homo sapiens__NP_031381.2__HsHSP90AB1 (opt7)
ggggcgcugccuacggagguggcagccaucuccuucucggcaucaagcuuaccaugcccgaggaagugcaccauggcgaggaagaggucgaaaccuucgccuuucaggcagagaucgcccaacugaugagccucauuaucaacacuuucuacuccaauaaggagauuuuucugagggaauugaucaguaacgcgagcgacgcccuggauaaaauucgguaugagucccucaccgacccaaguaagcuggauagcgggaaagaauugaagaucgacaucauuccgaauccccaggagcgcacgcugacucucguggauaccgguaucggcaugaccaaagcagaccugauuaacaaucuggggacuaucgccaaguccggcaccaaggcauucauggaggcccuccaggcgggugccgauauuagcaugaucgggcaguuuggcguaggcuucuacuccgcauaucugguggccgaaaaagucguggugauuacgaagcacaacgacgaugagcaauacgccugggaaaguagcgcaggggguuccuuuacugucagggccgaccauggcgagccaaucgggcggggcaccaaagugaucuugcaccugaaggaagaucagacugaguaucucgaggaacgcaggguaaaagagguggucaagaaacauagccaguucauugguuaccccaucacccuguaucuggaaaaggagcgggaaaaggagauuagugacgaugaggcggaagaggaaaaaggggagaaggaagaggaggacaaagacgaugaagagaagccaaaaaucgaagacgugggcuccgaugaggaggacgauagcggcaaggacaagaaaaagaaaaccaagaaaauuaaggaaaaguacaucgaucaggaggaauugaauaaaacgaagcccaucuggacucgcaacccagacgauauuacccaagaggaauacggggaguuuuauaaaucccucacuaaugacugggaggaucaccuggccgugaagcacuucagugucgaaggucagcuggaguuuagggcacuccuguucaucccgcggcgcgcccccuucgacuuguuugaaaacaaaaagaagaaaaauaacauuaagcuguacgugaggcggguauucaucauggacagcugcgaugagcucauuccagaauaucugaauuuuauccgcggcguggucgacuccgaggaucugcccuugaacaucagcagggagaugcuccagcagaguaaaauucugaaggugauccggaaaaauauugugaagaaaugucuggaacucuucuccgagcuggcagaagacaaggagaacuacaagaaauuuuaugaagccuucagcaagaacuugaaacuggggauccaugaggauaguaccaaucgcaggcggcucuccgagcugcugcgcuaccacaccagccaaagcggcgacgaaaugacuuccuugagugaguaugucagcaggaugaaggaaacgcagaaauccauuuacuacaucaccggugagagcaaggaacagguggccaacagugcguuuguagagcgggugaggaagcgcggcuucgaggucguguauaugacugaaccaauugaugaguacugcguccaacagcucaaagaauuugacgggaagucccuggugagcgugaccaaagagggccuggagcuccccgaagaugaggaagagaagaaaaagauggaagaguccaaggcaaaauucgagaaucuguguaaguugaugaaagaaauccuggacaagaaaguagagaaggugaccaucaguaaccggcucgucagcuccccgugcuguauugugacuagcacguauggguggaccgccaauauggaaaggaucaugaaagcccaggcacugcgcgauaacaguacuauggguuacaugauggccaagaagcaucuggagauuaaucccgaccacccaaucgucgagaccuugcggcagaaagcggaagccgauaagaacgacaaagcagugaaggaccuggugguacuccuguuugagaccgcccuccuguccagcggcuucuccuuggaagauccccaaacucacaguaauaggauuuaucgcaugaucaaacuggggcucggcaucgacgaggaugaaguggcagccgaggagccaaacgccgcaguccccgacgaaauuccaccgcuggagggugaugaagacgccagccggauggaggaaguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3309 - RNA, 2794 nt, Artificial Sequence
  mRNA product Design2 comprising derived and/or modified sequence from Homo sapiens__NP_003290.1__HsHSP90B1 (opt7)
ggggcgcugccuacggagguggcagccaucuccuucucggcaucaagcuuaccaugagggcccugugggugcucggccugugcugugucuugcugaccuucgggagcgugcgggcagacgaugagguagacguggaugguacugucgaagaggaccucggcaagucccgcgaagggaguaggaccgaugacgagguggugcagcgggaagaggaggccauccaacuggauggcuugaacgcgagccagauucgcgaacugagggagaaauccgaaaaguuugccuuccaggcagaggucaaucggaugaugaaacucaucauuaacagucuguacaagaauaaagagaucuuucugcgcgaacucauuagcaacgccuccgacgcacuggauaagaucagguugaucagccugacggacgagaaugcccucuccgguaacgaagaacugacugugaagauuaaaugcgauaaggagaaaaaucuguugcacguaaccgacaccggggugggcaugacucgggaggagcucgucaagaaccugggcaccaucgcgaaaagugggacgagcgaguuccugaauaagaugacugaggcccaggaagauggucaauccaccagcgagcucauuggccaguuuggggugggcuucuauagugcauuucugguggccgacaaagucaucgugacuuccaagcauaacaaugacacccagcacauuugggaaagcgauuccaacgaguucaguguaaucgccgacccccgcgguaauaccuuggggaggggcacgacuauuacccuggugcucaaggaggaagcaagcgauuaccuggagcuggacacuaucaaaaacuuggucaagaaauauucccaguuuaucaauuucccaauuuacguguggagcaguaagaccgaaaccguggaggaaccgauggaggaggaagaggccgcgaaagaagagaaggaggaauccgaugacgaggccgcagucgaagaggaagaggaggaaaagaaacccaagacuaaaaagguggagaaaacgguaugggauugggaacucaugaacgacaucaagccaauuuggcaacggcccagcaaggagguggaagaggaugaguauaaagccuuuuacaagaguuucuccaaagaaagcgacgauccaauggcauauauccauuucaccgccgagggcgaagucacuuuuaagagcauucuguucgugcccaccuccgccccacgcgggcuguuugacgaguacgguaguaaaaagagcgacuacaucaagcucuaugucaggcggguguucaucaccgaugacuuucacgauaugaugccgaaauaccugaacuucgugaagggcguaguggacuccgaugacuugccccugaaugucagccgcgaaacucuccagcagcauaaacugcugaaggugauuaggaaaaaguugguccggaaaacgcucgauaugaucaagaagauugcggacgauaaauauaacgacaccuuuuggaaggaguucgggacuaauaucaaacugggcgugauugaggaucacaguaaccgcaccaggcuggcaaagcuccugcgguuucaguccagccaccauccaaccgacaucacuuccuuggaucaauacguggaaaggaugaaagagaagcaggacaagaucuauuucauggccgguaguagccgcaaagaagccgaguccagccccuuuguagagcggcugcucaagaaaggcuacgaagugauuuaucugacggagccagucgacgaauacuguauccaggcacugcccgaguucgaugggaagagguuucaaaauguggccaaagaaggcgucaaguucgacgagagugagaagaccaaagaaucccgcgaggcgguggaaaaggaguucgaaccguugcugaacuggaugaaagauaaggcccucaaagacaagauugagaaagcagugguaagccagcggcugacugagucccccugcgcccucgucgcaagucaguacggguggagcgguaauauggaaaggaucaugaaggcccaggccuaucaaaccggcaaggauauuuccacuaacuacuaugcaagccagaaaaagaccuuugagaucaauccacgccacccccugauucgggacauguugaggcggaucaaagaagaugaggacgauaagacggugcuggaccucgccgugguccuguucgagaccgcgacucugcgcaguggguacuugcugccagauaccaaagccuauggcgacaggaucgaacggaugcuccgccugucccucaacauugaccccgaugcaaagguggaggaagaaccagaagaggagccggaagagacugccgaagacaccacggaggauaccgaacaggacgaggaugaggaaauggacguggguacugaugaggaagaggaaaccgccaaggagagcacugcagagaaagacgaacugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3310 - RNA, 2497 nt, Artificial Sequence
  mRNA product Design2 comprising derived and/or modified sequence from Homo sapiens__NP_057376.2__HsTRAP1 (opt7)
ggggcgcugccuacggagguggcagccaucuccuucucggcaucaagcuuaccauggccagggagcugcgggcacuccuguuguggggccgcaggcugcggccccuccugcgcgccccagcguuggccgcagugcccggggguaagccgauccugugcccaaggcggaccacugcccagcucggcccccgcaggaacccagcauggagccugcaagccgggcggcuguucuccacccagacggcggaagacaaagaggaaccccuccacaguauuaucagcuccacugagaguguccagggcagcaccuccaagcaugaauuucaggccgagaccaaaaagcuguuggauauuguggcacgcagccuguacuccgagaaagaaguauucaucagggagcucauuaguaaugccagcgacgcccuggaaaagcugcggcacaaguugguguccgauggucaagcacucccagagauggagauccaucugcagacuaacgccgaaaaagggaccaucacgauucaggacacuggcaucggcaugacccaggaggaacuggucagcaaucucgggacuauugcgcgcagugguuccaaggccuuucuggaugcauugcaaaaccaggccgaggcaagcuccaaaaucauuggccaguucggggugggcuuuuauagugccuucaugguggccgacagggucgaaguguacagccgguccgcggcaccggguagccugggguaucaguggcucagugauggcuccggcguauuugagaucgccgaggccagcggggugcgcaccgguaccaagauuaucauccaccugaaaagugacuguaaggaguucuccagcgaggcaaggguccgggauguggugacgaaauacagcaauuuugucuccuucccccuguauuugaacggccgcaggaugaauacucuccaagccauuuggaugauggacccaaaggaugugcgggaauggcagcaugaggaauuuuacagguauguagcgcaggcccacgacaagccccgcuacacccugcacuacaaaacugaugcaccacugaacauccggaguauuuucuaugugcccgacaugaagccgagcauguucgacgucuccagggagcucgggagcaguguggcccuguacucccgcaaaguguugauccaaaccaaggcaaccgauauucugcccaaauggcuccgguuuaucaggggcgucguggacagcgaggauaucccacugaaucugucccgcgaauugcuccaggagagugcccugauucggaagcugagggacguacuccagcagcggcugaucaaguucuuuauugaucaaagcaaaaaggacgccgaaaaauaugcaaaguucuuugaggauuacgguuuguucaugcgcgaaggcaucgugacugccacggagcaggaggucaaagaagacauugcgaagcugcucagguaugaguccagcgcccugcccagugggcagcugaccuccuugagcgaauacgcaucccggaugcgcgccggcacuaggaacaucuauuaccugugcgccccaaaucggcaucucgcagagcacagucccuacuaugaggcgaugaagaaaaaggauaccgaagugcuguuuuguuucgagcaguuugacgaacucacccuguugcaucugcgcgaguucgauaaaaagaaacucaucagcgucgaaacugacauugugguggaccacuacaaggaggagaaguuugaagauagguccccagccgcagagugccugagcgaaaaagagacggaagaacugauggccuggaugcggaacguauuggggaguagggugaccaaugucaaggugacucugcgccucgacacccacccggccauggucaccgugcuggagaugggugcagcccggcauuuccucaggaugcaacagcuggcgaaaacucaggaggaacgcgcccaguugcugcaacccacgcuggaaaucaacccacggcacgcacucauuaagaaacugaaucaguugagggccuccgagcccggccuggcccagcuccugguggaucagaucuaugaaaacgcaaugauugccgcggggcucguagacgauccacgcgccauggugggccggcugaacgaguugcuggucaaggcacuggagaggcauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3311 - RNA, 844 nt, Artificial Sequence
  mRNA product Design2 comprising derived and/or modified sequence from Homo sapiens__NP_000609.1__HsIGF1 (opt7)
ggggcgcugccuacggagguggcagccaucuccuucucggcaucaagcuuaccaugggcaagaucagcucccugcccacccaacucuucaaaugcuguuuuugcgacuuccugaaggugaaaaugcacacuaugaguagcucccauuuguuuuaccuggcccucugucuguugaccuucacgaguagcgcaacugccgggccagagacccugugcggugcggaacucgucgaugcccugcaguuuguguguggcgacaggggguucuauuuuaacaagccgaccggcuacgguuccagcucccggcgcgcaccccagacugggauuguagaugagugcuguuucaggaguugcgaccugcggcgccucgaaauguauugugccccacugaaacccgcaaagagcgccagguccgugcgggcgcagcgccacaccgauaugccaaagacgcagaaagagguccauuugaagaaugccagcaggggcagugcaggcaacaaaaauuaccggaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3312 - RNA, 925 nt, Artificial Sequence
  mRNA product Design2 comprising derived and/or modified sequence from Homo sapiens__NP_000603.1__HsIGF2 (opt7)
ggggcgcugccuacggagguggcagccaucuccuucucggcaucaagcuuaccaugggcauccccauggguaagagcaugcuggugcuccugaccuucuuggccuuugcauccugcuguauugccgcguacaggccaagugagacucugugcgggggcgaacucgucgacacccugcaguucguguguggggaucggggcuuuuauuucagccgcccggccuccaggguaagucggcgcagcagggguaucguggaggaaugcuguuuucgguccugcgacuuggcacugcucgagacguacugugccacucccgcaaaaagcgaacgcgaugucuccaccccacccaccgugcugccagacaacuuccccagguauccaguggggaaguuuuuccaauacgauacuuggaaacagaguacccagcggcugcgcaggggccucccggcccuguugcgggcgcgcaggggccacguccuggccaaggagcucgaggcauuucgggaagccaaacgccauaggccccugauugcccugccaacgcaggaccccgcacacgggggugccccacccgagauggcgagcaaucggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3313 - RNA, 1021 nt, Artificial Sequence
  mRNA product Design2 comprising derived and/or modified sequence from Homo sapiens__NP_000591.1__HsIL6 (opt7)
ggggcgcugccuacggagguggcagccaucuccuucucggcaucaagcuuaccaugaacagcuucuccaccagugccuuuggccccguggcauucagccuggggcuccuguugguccugccagccgcguuuccggcccccgugccacccggugaggacuccaaggauguagcagccccacacaggcagccccucaccaguagcgaacggaucgacaaacaaauucgcuacauccuggauggcauuuccgcauugaggaaggagacuugcaauaaaagcaacaugugugaauccaguaaggaggcccuggcggaaaauaaccucaaucugccaaaaauggccgagaaggacgggugcuuccagagcggcuuuaacgaggaaacgugucuggugaagaucauuacuggucuccuggaguucgaagucuauuuggaguaccugcagaaucgguuugaguccagcgaagaacaggcacgcgccgugcaaaugaguaccaaagugcucauccaguuccugcagaagaaagccaagaaccuggaugcaaucaccacuccggaccccaccacgaaugccuccuugcucacuaaacugcaggcgcaaaaccaguggcugcaggauaugaccacucaucucauucugaggagcuuuaaggaguucuugcaguccagucugcgggcccuccgccaaaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3314 - RNA, 1663 nt, Artificial Sequence
  mRNA product Design2 comprising derived and/or modified sequence from Homo sapiens__NP_002183.1__HsINHBA (opt7)
ggggcgcugccuacggagguggcagccaucuccuucucggcaucaagcuuaccaugccccugcucuggcugaggggcuucuugcuggccagcugcuggaucauugugcgguccaguccaaccccggggagcgagggucacuccgcagcccccgacuguccaaguugcgcgcucgccgcacugcccaaggaugucccaaacagccagcccgaaaugguggaggccgugaaaaagcauaucuugaauaugcugcaccucaaaaagcgcccagacguaacucaaccgguccccaaagcagcccugcugaacgcgauuaggaagcuccaugugggcaaggugggggaaaauggcuacgucgagaucgaagaugacauuggucggcgcgccgagaugaacgagcugauggaacagaccuccgagaucaucacguuugcagaaagcgggacugccaggaaaaccuugcacuucgagauuuccaaggagggcagugaucugagcgugguagaacgggccgagguguggcucuuucugaaagucccaaaggcaaaucgcaccaggacuaaagugaccauccggcuguuccagcagcaaaagcauccccagggcuccuuggacacgggggaagaggccgaagaggugggucucaaaggcgagcgcagcgaacugcugcucagugagaaggucguggaugcgaggaaguccacuuggcacguauuuccagugagcuccaguauucagcggcuguuggaccaggggaaaagcucccuggauguccgcaucgccugugaacaaugccaggagagcggcgcaagucucgugcugcuggguaagaaaaagaaaaaggaagaggagggggaaggcaagaaaaagggcgggggugagggcggggccggcgcagacgaagagaaagaacagucccacaggcccuucuugaugcuccaggcccggcaaagcgaggaucauccgcaccgcaggcggcgcaggggucuggagugugacggcaaggugaacauuugcuguaaaaagcaguuuuucgucaguuuuaaggauaucggguggaaugacuggauuaucgcccccuccggcuaucaugcgaacuacugcgaaggggaguguccaagccacaucgcagguaccagcggcuccagucugagcuuccacuccacugugauuaaucauuaucggaugagggggcacagccccuuugccaaccucaaaaguugcugcguaccaaccaagcugcgccccauguccauguuguacuaugacgauggccagaauaucauuaaaaaggacauccaaaacaugauuguggaagagugugguugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3315 - RNA, 1606 nt, Artificial Sequence
  mRNA product Design2 comprising derived and/or modified sequence from Homo sapiens__NP_002184.2__HsINHBB (opt7)
ggggcgcugccuacggagguggcagccaucuccuucucggcaucaagcuuaccauggacggccugcccgggagggcccucggugcagccugccuguugcugcucgcggccggcuggcuggggccagaggcauggggcagcccgacucccccacccaccccagccgcacccccaccgcccccacccccagguucccccgggggcagucaggauaccuguacgagcugcggcggguuccggcgcccggaagaguuggguaggguggacggcgauuuucuggaagccgucaagcggcacauccucucccgccugcaaaugagggggcggcccaacauuacucaugcggugccaaaagccgcaaugguaaccgcccugcgcaagcuccacgccggcaaagugagggaggacggucgggucgaaaucccccaucuggaugggcacgcaaguccaggcgccgacggccaggagcgcgugagcgagauuaucuccuucgcggaaaccgauggguuggccagcuccagggugcggcuguacuuuuucauuaguaaugaggguaaccagaaucucuuugucgugcaggcaagccuguggcuguauuugaagcuccugcccuacguacuggaaaaaggcucccgcaggaaggugcgggucaagguguauuuccaagagcaggggcauggcgaccgcuggaacaugguggagaaaagggucgaucucaagcggagcgguuggcacacuuuuccacugaccgaagccauccaggcauuguucgagcgcggcgaaaggcggcugaaucucgacgugcagugugauaguugccaagagcuggccguagugccggucuuuguggaccccggggaagagucccacaggccauucguggucgugcaggcccgccugggcgauagccggcauaggauccgcaaacggggguuggagugugacgguaggacgaaccucugcugucgccagcaguuuuucauugacuuccggcugaucggcuggaaugauuggauuaucgcgcccacuggguacuauggcaacuacugcgaagguuccuguccagcauaucuggccggcguacccgggagugccagcuccuuucacaccgcaguggucaaucaauacaggaugcggggccucaacccggggacugugaauagcugcugcauuccaaccaagcugaguaccauguccauguuguacuucgacgaugaguauaacaucgucaaacgcgacgugcccaauaugauuguggaagaguguggcugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3316 - RNA, 3841 nt, Artificial Sequence
  mRNA product Design2 comprising derived and/or modified sequence from Homo sapiens__NP_000623.2__HsITGAM (opt7)
ggggcgcugccuacggagguggcagccaucuccuucucggcaucaagcuuaccauggcccugagggugcuccuguugaccgcacugacucucugccacggcuucaaccuggacaccgagaaugccaugacguuucaggaaaacgcgcggggguucggucaaagcgucgugcaguugcagggcucccgcguaguggucggggcgccccaggagaucguggcagccaaucaaaggggcagucuguaccagugugauuauagcacugguuccugcgaaccaauucggcuccaggugccggucgaggcagugaacaugagucuggggcugagccucgccgcgaccaccuccccaccccagcuguuggccuguggccccacuguacaucaaaccugcagcgaaaauacguacgugaagggccuguguuuucucuucggguccaaccugcgccagcagccacagaaauuucccgaggcacugagggguugcccacaagaggacagugauaucgccuucuugauugacggcagcggguccaucauuccgcacgauuuucggcgcaugaaggaguucgucagcacugugauggaacagcucaaaaagaguaaaacccuguuuucccugaugcaguauagcgaagaguucaggauccauuuuacuuucaaggaguuccaaaauaaccccaauccacggucccucgugaagcccaucacccagcuguugggccgcacccacacggccacugguauuaggaaagucgugcgggaacuguuuaacaucaccaauggggcacgcaagaacgccuucaaaauucucguagugaucacugacggcgagaaguuuggcgauccacugggguacgaagacgucauucccgaggcggauagggaaggugugauccgguaugugauuggcgucggggacgccuuccgcagugagaaaagcaggcaggagcugaauaccaucgcauccaagccgccccgggaucauguguuucagguaaacaauuucgaagccuugaaaaccauccaaaaccagcuccgcgagaagauuuuugcaaucgaaggcacucagacggguagcaguuccagcuucgagcacgaaaugagucaggagggcuuuuccgccgccauuaccagcaacgggccacugcugagcacugugggcuccuacgacugggccgggggugucuuccucuauaccaguaaggagaaaagcaccuuuaucaauaugacuaggguggauuccgacaugaacgacgcauaccugggcuacgccgccgcaauuaucuugcggaauaggguccaaagccuggugcucggggcgccccgcuaucagcacaucggccugguggccauguuccggcagaacacggguaugugggaaaguaaugccaacguaaagggcacccagauuggggcauacuuuggcgccucccuguguagcguggaugucgacuccaaugggaguacugauuuggugcucaucggcgcaccacauuauuacgagcaaaccaggggugggcaggucagcgugugcccccugccacgcggccgggccagguggcagugugacgccgugcuguauggugaacagggccaaccgugggggcgcuucggcgcagcccucaccguacugggggaugugaacggcgacaaauugacugaugucgcgauuggugcccccggggaggaagacaaucggggcgcaguguaccuguuccacggcacguccgggagcgguaucaguccaucccauagccagaggauugccggcuccaagcucaguccccggcugcaguauuuugggcaaagccuguccggcggucaggauuugaccauggacgggcuggucgaucucacugugggcgcccagggccacgugcugcuccugcgcagccagccaguauugagggucaaagcaaucauggaguucaacccccgggagguggcgcgcaauguguuugaaugcaacgaccaagucgugaaggggaaggaggccggugaagugaggguaugccugcacguccagaaaaguacccgggaccgccucagggagggccagauccaguccguggugacuuacgaucuggcacuggacagcgggcggccgcauuccagggccgucuucaaugagaccaagaacagcacgcgccggcaaacccagguguugggccugacucagaccugugaaacucucaaacugcagcucccaaauugcauugaggaucccguaagucccaucgugcugagguugaacuuuagccuggucgguaccccacuguccgccuucgggaaccuccgccccgugcuggcagaagacgcccaacgguuguuuacggcgcuguucccauuugagaagaauuguggcaacgauaauauuugccaggacgaucucaguaucaccuucagcuuuaugucccuggacugucucguggucggcgggccgagggaguucaacgugacuguaaccgugcgcaaugauggugaagacagcuaccggacucaggucaccuucuuuuucccccuggauuuguccuauaggaaagugaguacgcugcaaaaccagcgcagccagcgguccuggaggcuggccugcgagagugcaagcuccaccgaagugagcggcgcccucaagaguacuuccuguagcauuaaucacccaaucuuucccgagaacuccgaagucaccuucaauauuacuuuugacguggauagcaaggccagucuggggaacaaauugcugcucaaggcaaauguaaccuccgagaacaauaugccacgcacgaacaaaaccgaguuccagcuggaacugcccgugaaguacgccgucuauaugguggugacuagccauggcgucaguaccaaauaccucaauuuuacugcguccgagaacaccagccgggugaugcaacaccaguaucagguauccaaccugggucagaggagcuugccgaucagucugguguuccucgucccagugcgccugaaucaaacugugaucugggaccggccccaggucaccuuuagcgaaaacuuguccaguacgugccauaccaaggagaggcugccaagccacuccgacuuccucgccgaacugcgcaaggcacccgugguaaauuguagcauugccgugugccagaggauccagugcgauauuccguuuuucgggauccaagaggaauuuaacgcaacucugaaaggcaaucucuccuucgacugguacauuaagaccagucacaaccaucuguugaucgucagcacugccgagauccuguucaaugauuccguguuuacccuccugcccggccagggggcguucgugcggagccagacggagaccaaagucgaaccauuugaggugcccaacccauugccccugauuguagguaguuccgugggcgggcuccugcugcucgcccugaucacugcagccuuguauaagcugggcuucuuuaaaaggcaguacaaggacaugaugagcgaagguggcccaccgggggccgagccccaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3317 - RNA, 1786 nt, Artificial Sequence
  mRNA product Design2 comprising derived and/or modified sequence from Homo sapiens__NP_002415.1__HsMMP8 (opt7)
ggggcgcugccuacggagguggcagccaucuccuucucggcaucaagcuuaccauguucagccugaagacccuccccuuucuguugcugcuccacgugcagaucuccaaagccuucccagucaguagcaaggagaaaaacacuaagaccgugcaagacuaccuggaaaaauuuuaucaguugccguccaaucaguaccagaguacgaggaagaacggcacuaauguaauuguggagaagcugaaagaaaugcaacgguucuuugggcucaacgucaccgguaagcccaaugaggaaacccuggauaugaugaaaaagccacgcugcggcgugcccgacagcgggggcuucaugcugacuccagguaaccccaaaugggagaggaccaaucucacguaucggauccgcaacuacacuccacagcuguccgaggcagaaguggagagggccauuaaggaugcguuugaauuguggagcgucgccuccccgcugaucuucacccggauuagucagggggaggcagacaucaauaucgccuuuuaucagcgcgaucauggcgacaacagccccuucgauggcccaaaugggauucucgcacacgccuuucaacccggucagggcaucgggggcgacgcgcauuucgaugccgaggaaacuuggaccaacaccuccgcaaauuacaaccuguuccugguggccgcccacgaguuuggucauagcuuggggcucgcacacaguuccgacccaggcgcccugauguaucccaauuacgcguucagggaaacgagcaacuacucccugccgcaggaugacauugauggcauccaggccauuuaugggcucaguagcaaccccauccaaccaacuggucccuccaccccaaaacccugugacccaagccugacuuuugacgcaauuaccaccuugcggggcgagauccuguucuuuaaggaucgcuacuucuggaggcggcacccgcagcuccagcgcguagaaaugaauuuuaucagucuguucuggcccucccugccaacugggauucaagccgcauaugaggacuuugauagggacuugaucuuccucuuuaagggcaaccaguacugggcccugagcgguuaugauauucugcagggcuaccccaaagacaucaguaauuauggguucccauccagcgugcaggccauugaugcggcagucuuuuaccggagcaagacguacuucuucgugaacgaccaauuuuggcgcuaugauaaucagaggcaguucauggagcccggcuacccgaaauccaucaguggggccuuuccagguaucgaaagcaagguggacgccgucuuccagcaagagcacuuuuuccauguguuuuccggcccccgguauuacgcauucgaucucauugcccagcgcguaaccaggguggcgcgggggaacaaauggcugaauugcagguauggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3318 - RNA, 2506 nt, Artificial Sequence
  mRNA product Design2 comprising derived and/or modified sequence from Homo sapiens__NP_004985.2__HsMMP9 (opt7)
ggggcgcugccuacggagguggcagccaucuccuucucggcaucaagcuuaccaugagccuguggcagccccucgugcuggucuugcuggugcucggcugcuguuucgccgcaccaaggcaacggcaguccacccugguauuguuuccgggggaccugcgcacuaaccucaccgauaggcagcuggccgaggaauaccuguaucgguacgguuauacgcgcguggcggagaugaggggcgaaaguaagagccucgggcccgcccuguugcugcuccagaaacaacugucccugccagagacuggcgaauuggacagugcaacccucaaggccaugcggacccccaggugcggugucccagaucuggggagguuccagacuuuugagggcgaccugaaauggcaccaucacaauaucaccuacuggauucagaacuauagcgaggaucucccccgggcagugaucgacgaugccuucgcgcgcgccuuugcacugugguccgccgugacgccauugacuuucaccagggucuacagccgggacgccgauauugugauccaguuuggcguagcagaacauggggacgguuauccguucgauggcaaggacgggcugcucgcccacgcguuucccccaggccccgguauucaaggggaugcccauuucgacgacgaugagcuguggucccugggcaaaggcguggucgugccaacucgcuuugggaaugcagacggugccgcaugucacuuccccuucaucuuugaaggcaggaguuacagcgccugcaccaccgaugggcgguccgacggcuugccgugguguagcacgacugccaacuacgauaccgacgaucgcuucgguuuuugccccagugagaggcucuauacucaggacggcaaugcggaugggaagccaugucaguuccccuuuaucuuccagggccaauccuacagcgcaugcaccaccgacgggcgguccgaugguuaucgcuggugugccacuacggccaacuacgacagggacaagcuguuuggcuucugcccaacccgggcagauaguacugugaugggcgggaauagcgccggugagcugugcgucuuucccuucaccuuucucggcaaagaauauuccaccuguacuagcgaggggaggggcgacgggcgccuguggugcgcgacgaccaguaacuucgauuccgacaagaaauggggcuuuuguccagaucaggguuacagcuuguuccugguggccgcacacgaguucgggcaugcccucggccuggaccacaguuccguaccggaagcacugauguaucccauguaccgguuuacugaagguccacccuugcauaaggaugacgugaauggcauuaggcaccucuacgggccacgccccgagccggagccacggccacccaccaccacuacgccccagcccaccgccccaccgacugucugccccaccggcccacccacugugcacccaagcgaaaggcccaccgccgggccgacgggcccacccagcgcagguccaaccgggcccccgacugccggccccuccaccgcgacuaccgugccacugagucccgucgaugacgccuguaacgugaauaucuucgaugcaauugccgagaucggcaaccaacuguaucucuuuaaagacgggaaguacuggcgcuucagcgaaggucggggcuccaggccacaggggcccuuucugauugccgauaaauggccagcauugccgcggaagcuggacagcguauucgaggaacgccucaguaagaaacuguuuuucuuuuccggccgccaggugugggucuauacgggugcgagcgugcuggggccccggcgcuuggacaagcugggccucggcgccgaugucgcacaggugaccggggcccugagguccggucggggcaaaaugcuccuguucagugggcgcagguuguggcgguuugacgugaaggcccaaaugguagauccaaggagcgcauccgagguggaccgcauguuccccggcgucccacuggauacucaugacguguuccaguaccgggagaaagccuauuuuugccaggauagguucuacuggcgcgucagcagucgguccgaacucaaucagguggaccaaguggguuauguaaccuacgauauccugcagugucccgaggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3319 - RNA, 1798 nt, Artificial Sequence
  mRNA product Design2 comprising derived and/or modified sequence from Homo sapiens__NP_002418.1__HsMMP13 (opt7)
ggggcgcugccuacggagguggcagccaucuccuucucggcaucaagcuuaccaugcaccccggcgugcuggccgcauuccucuuucugagcuggacccauugcagggccuugccacugccguccgggggugacgaggaugaccucagugaagaggaucugcaguucgcggaacgguacuugcgcagcuauuaccaccccacuaaccuggccggcauccucaaggagaaugcagccuccaguaugaccgaaaggcugcgggagaugcagagcuuuuucgggcuggaggucacgggcaaacucgacgauaacacucuggacgugaugaagaaaccacgcugugguguacccgaugugggggaauauaaugucuuuccaaggaccuugaagugguccaaaaugaaccugaccuaccggauugugaauuauacucccgacaugacccauagcgagguggaaaaggcauucaagaaagccuuuaaggucugguccgaugugacgccacucaacuucacucgccugcacgacggcaucgcggauauuaugaucaguuuuggcauuaaagagcauggggacuucuacccguuugauggucccagcggccuguuggcccacgcauucccacccgggccaaauuauggcggugacgcccacuucgacgaugacgagaccuggacuuccagcaguaagggguacaaccucuuucugguagccgcacaugaguucggccacucccugggccucgaucauagcaaagaccccggggcccugauguuuccgaucuacaccuauaccgguaagucccacuucauguugcccgaugacgaugugcaaggcauccagagucuguacgggccaggcgacgaggaucccaauccaaaacaccccaagacgccagacaagugcgauccgagccucucccuggacgcgauuacuagccugaggggugaaaccaugaucuuuaaagaccgguucuuuuggcgcuugcauccccagcaagucgaugccgaacucuuccugacuaagaguuuuuggccagaacugcccaacaggauugacgcagccuaugagcacccaucccaugaucucaucuucauuuuucggggccgcaaauucugggcacugaauggguacgacaucuuggagggcuaucccaagaaaauuagcgaacuggggcucccgaaggaggugaagaaaaucagugccgccgugcacuuugaagauaccgguaagacccugcuguucuccggcaaccaggucuggagguacgacgauacuaaucauaucauggacaaagauuauccacgguugauugaggaagacuuccccgggaucggcgauaagguggacgcgguauacgagaaaaacgguuacauuuacuuuuucaauggccccauccaguuugaguauagcauuuggagcaaccgcaucgugagggucaugccagcaaacuccauccucugguguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3320 - RNA, 1450 nt, Artificial Sequence
  mRNA product Design2 comprising derived and/or modified sequence from Homo sapiens__NP_001286.1__HsCCR1 (opt7)
ggggcgcugccuacggagguggcagccaucuccuucucggcaucaagcuuaccauggagacccccaacacuaccgaagacuacgauacgacuaccgaguucgacuauggcgaugccaccccaugccagaaggugaaugaaagggcauuuggggcccaacugcucccgccccuguacagcuuggucuucgugaucggucugguaggcaacauucucgugguccugguguuggugcaguauaaacggcugaagaauaugacuuccaucuaccuccugaaccuggcgauuagugaccuccuguuuuuguucacccugccauuuuggaucgauuauaaacucaaggacgauugggucuucggggacgccauguguaaaauucugagcggcuuuuacuauacgggucuguacuccgagaucuucuuuaucauuuugcucacuaucgaucgcuaccuggcaauugugcacgccguauucgcacugagggcccggaccgugacuuuuggggucaucaccaguauuaucauuugggcgcucgccauccuggcaagcaugcccggcuuguauuucuccaagacccagugggaauuuacgcaucacacuugcagccugcauuuuccacacgagucccuccgcgaguggaagcuguuccaggcccugaaauugaaucucuuuggccuggugcugccccuccuggugaugaucauuuguuacaccgggaucauuaagaucuugcugaggcggccaaacgagaaaaagaguaaagccguccgccucauuuucgugaucaugaucauuuucuuccuguuuuggacuccguauaaucugaccaucuugauuagcguauuccaagacuuucucuucacccaugaaugcgaacaguccaggcaccuggaucuggcagugcaggucacugaggugaucgccuacacgcacuguugcgugaaccccgucauuuaugcguuugugggugagcgguuccgcaaguaccucaggcagcuguuucaucggcgcguagccgugcacuuggucaaauggcugccauuccucagcguggacaggcuggaacgggucaguuccaccagccccuccacuggcgagcaugaacugagugcaggguucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3321 - RNA, 1018 nt, Artificial Sequence
  mRNA product Design2 comprising derived and/or modified sequence from Homo sapiens__NP_002598.4__HsPDGFA (opt7)
ggggcgcugccuacggagguggcagccaucuccuucucggcaucaagcuuaccaugaggacccuggccugccuccuguugcugggcuguggguaccucgcacacgugcuggccgaggaagcggagaucccccgggaagucauugagcgcuuggccaggagccagauccauuccauucgggaccugcaacgccuccuggaaaucgauaguguggguagcgaggacucccuggauaccagucucagggcacacggcguacaugccacuaagcacgugccagagaaacggccgcugcccauucgcaggaagcggagcaucgaagaggcagucccagccgugugcaaaacgcgcacugugaucuaugaaauucccaggucccaggucgacccaaccagcgcgaacuucuugaucuggcccccauguguggagguaaagcggugcaccggguguugcaauacuuccagugugaaaugucagccgagccgcguccaucacagguccgugaagguggccaaggucgaguacgugcggaaaaagcccaaacugaaggaaguacaggugcgccucgaggaacaccuggagugcgcaugugccaccacgagccugaacccagauuauagggaagaggacacuggccggccccgcgagagugguaaaaagaggaaacggaagagguugaagccaaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3322 - RNA, 1108 nt, Artificial Sequence
  mRNA product Design2 comprising derived and/or modified sequence from Homo sapiens__NP_002599.1__HsPDGFB (opt7)
ggggcgcugccuacggagguggcagccaucuccuucucggcaucaagcuuaccaugaacaggugcugggcccuguuccucagccuguguugcuacuugcggcugguguccgcagagggcgaccccaucccagaggaacucuaugaaaugcugagugaucacagcauucgcuccuuugacgauuugcagaggcugcuccauggggacccgggugaggaagauggcgccgagcuggaccugaauaugacccggagucacagcgggggcgagcucgaaucccuggcgcgcgguaggcggagcuuggggucccugacuaucgccgagcccgcaaugauugccgaauguaagacccgcacggaggucuucgagaucaguaggcggcucauugaucgcacuaacgcaaauuuucugguguggccacccugcguagaagugcaaagguguagcggcugcuguaacaaucggaacguccagugccgcccaacccaggugcagcugaggcccgugcaaguccggaaaaucgagaucgugcgcaagaaaccaauuuucaagaaagccaccguaacuuuggaagaccaucucgcguguaagugcgagaccguggccgcagccaggccggucacgcggucccccggcgggagccaggaacagcgcgccaagacuccacagaccagggugacuauccggaccgugaggguccgccggcccccaaaagguaagcacaggaaauuuaagcauacccacgauaaaacggcacugaaggagacucugggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3323 - RNA, 1420 nt, Artificial Sequence
  mRNA product Design2 comprising derived and/or modified sequence from Homo sapiens__NP_057289.1__HsPDGFC (opt7)
ggggcgcugccuacggagguggcagccaucuccuucucggcaucaagcuuaccaugagccuguucggccuccuguugcugaccuccgcccucgcagggcagaggcaagguacucaggccgagaguaaccugagcuccaaguuucaguucaguagcaauaaagaacagaacggcgugcaagacccccagcacgagcggaucauuaccgucuccacgaaugggagcauccauuccccacgcuuuccgcacacuuaccccaggaacaccguguugguauggcggcugguggcggucgaagagaauguguggauucagcucaccuucgaugaacgcuuuggccuggaggacccagaggaugacaucugcaaguaugauuucguggaagucgaggaacccagugacgguacuauucuggggaggugguguggcagcggcaccgugccagggaaacagaucuccaaggguaaccaaauccggauucgcuuuguaagcgaugaguacuuccccagugagccaggcuuuugcauccauuauaauauugugaugccgcaguucacggaagccgucucccccagcgugcucccacccuccgcacugccauuggaccugcucaacaaugccaucacugcauuuaguacccuggaggaucugauuagguacuuggaacccgagcgguggcagcucgaccuggaagaucuguaucgcccgacuuggcagcuccuggggaaagccuucguguucggcaggaaaagccgggucguggacuugaaccugcucaccgaggagguacgccuguacuccuguacccccaggaauuuuagcgugaguauccgggaggaacugaagcgcacggauacuauuuucuggccagguugcuugcucgucaagaggugugggggcaacugcgcguguugccugcacaauuguaacgaaugccaaugcgugcccuccaaggugaccaaaaaguaucaugagguccugcagcuccggccaaaaacuggcgugcgcgggcugcacaagagcuugaccgacguagcccuggaacaccaugaggagugugacugcguguguagggguaguaccggcgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3324 - RNA, 1477 nt, Artificial Sequence
  mRNA product Design2 comprising derived and/or modified sequence from Homo sapiens__NP_149126.1__HsPDGFD (opt7)
ggggcgcugccuacggagguggcagccaucuccuucucggcaucaagcuuaccaugcacaggcugaucuucguguacacccucauuugcgccaacuuuuguagcugccgggacacuuccgcaacgccccagagugccagcaucaaggcgcugcgcaaugccaacuugaggcgggaugaccuguaucgcagggaugagaccauucaagucaaaggcaauggguacgugcaguccccacgguucccgaacaguuauccccgcaaucuccuguugacuuggaggcugcauagccaggaaaacacccggauccagcucguauuugacaaucaauucggucuggaggaagcagagaacgauauuugucgcuacgacuuuguggaagucgaggauaucuccgagaccagcacuaucauuaggggccgguggugcgggcacaaggaagugccaccccgcaucaaauccaggaccaaucagauuaagaucacguucaaaagugacgauuauuuuguggccaagccaggcuucaagauuuacuauagccugcucgaggacuuucagcccgcagccgcguccgaaacuaacugggagagcgucaccaguuccaucagcgguguguccuacaauaguccaagcguaacugauccgacccugauugccgacgcauuggauaaaaagaucgccgaguucgacaccguggaagaccugcucaaauacuuuaaccccgaguccuggcaggaagaucuggagaauauguaucuggacacgccacgguaccgcgggaggagcuaucaugaucggaagaguaaagucgacuuggaucgccucaacgacgaugccaagagguacuccuguacuccccggaauuauagcgugaacaucagggaggaacugaaacuggcaaacguggucuucuucccacgcugccuccuggugcaacgguguggcggcaauugcgggugugguaccguaaacuggaggaguugcacuugcaauuccggcaagaccgugaagaaauaccacgaggucuugcaguuugaacccgggcauauuaagcgccggggcagggccaaaaccauggcgcugguggacauccagcucgaucaccacgagcgcugugacugcauuuguagcagccggccgcccaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3325 - RNA, 1060 nt, Artificial Sequence
  mRNA product Design2 comprising derived and/or modified sequence from Homo sapiens__NP_003946.3__HsSOCS3 (opt7)
ggggcgcugccuacggagguggcagccaucuccuucucggcaucaagcuuaccauggugacccacagcaaguuccccgccgcaggcauguccaggccacuggacaccagucuccggcugaaaacuuuuagcuccaagagugaguaccaguuggucgugaacgccguacgcaaacugcaagaaagcggguucuauugguccgcggugacggguggcgaggccaaucuccuguugagcgcagaaccggccgggacuuuucugaucagggauuccagugaccagcggcauuucuuuacccucagcgucaagacccaguccggcacuaaaaaccugcgcauucagugcgagggugggagcuucagucugcaauccgaucccaggagcacccagccagugccccgguuugacugugugcucaagcugguccaccauuacaugccacccccaggcgcaccguccuuccccaguccacccacggaaccaagcuccgaggugcccgagcagccgagcgcccagcccuugccaggcagucccccacgcagggcguauuacaucuauuccgggggugaaaagauuccccugguacucagccggccacugaguuccaauguggccacucugcaacacuugugccgcaaaaccgucaacggccaucucgauagcuacgagaaggugacucagcugccggggcccaucagggaauuucuggaccaguaugaugcaccacucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3326 - RNA, 865 nt, Artificial Sequence
  mRNA product Design2 comprising derived and/or modified sequence from Homo sapiens__NP_003227.1__HsTGFA (opt7)
ggggcgcugccuacggagguggcagccaucuccuucucggcaucaagcuuaccauggugcccagcgccggccagcuggcacucuucgcccuggggaucgucuuggcggccugccaagcacuggagaacuccaccaguccacucagcgccgacccgcccguggcagccgcgguagugucccacuuuaaugauuguccagacagucauacucaguucugcuuucacgguaccuguagguuccugguccaggaagauaagcccgccugcgugugucauagcggcuacgugggggcacggugcgagcacgccgacuugcuggccgucguggcagccucccagaaaaagcaagcgauuacggcccucguaguggucagcaucguggcacuggccgugcugauuaucacuuguguccucauucauugcugucaggugcgcaaacacugcgaauggugcagggcacugaucugucggcacgagaagccauccgccuugcugaaaggccgcaccgccugcugucauagugaaaccguagugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3327 - RNA, 1555 nt, Artificial Sequence
  mRNA product Design2 comprising derived and/or modified sequence from Homo sapiens__NP_000651.3__HsTGFB1 (opt7)
ggggcgcugccuacggagguggcagccaucuccuucucggcaucaagcuuaccaugcccccaagcggccugaggcuccugccguugcugcucccccuguuguggcugcucgugcugaccccagggcggcccgccgcaggucuguccacuugcaagaccaucgacauggagcucgucaaacgcaagaggauugaagccauccggggccagauucugaguaaauugcgccuggcgagcccacccucccaaggggaggugccaccgggcccccucccagaagccguacuggcacuguacaacaguacgagggaucggguggccggugagagcgcagaacccgagccagagcccgaagccgacuauuacgcgaaggaggucacucgcguguugaugguggaaacccacaaugagaucuaugauaaauucaagcaguccacccauagcauuuacauguuuuucaacacuuccgagcucagggaagccgucccggagcccgugcugcugagucgggcagaacuccgccuguugaggcugaagcucaaaguagagcagcacguggaacuguaucagaaguacagcaauaacuccuggcgguaucugagcaaucgcuugcucgccccaagugacucccccgaguggcugagcuuugaugucaccgggguggugaggcaauggcugucccggggcggcgagaucgaaggguuccgccucagugcccauuguagcugcgacuccagggauaacacgcugcaggucgacaucaaugguuuuacuaccggccggcgcggggauuuggcaacuauucacggcaugaacaggccauuccugcuccugauggccacgccccuggagcgggcgcagcauuugcagagcaguaggcaccgccgggcccucgacaccaauuacuguuuuuccagcaccgagaaaaacugcugugugaggcaacuguacaucgauuuccgcaaggaccuggguuggaaauggauucacgaaccaaagggguaucaugcaaauuuuugccucggcccgugucccuacaucuggagucuggauacucaguauuccaaaguauuggcccuguacaaccagcacaauccaggcgcaagcgccgcccccugcugugugccacaggcgcucgaaccccugccgauugucuauuacguggggcggaagccaaagguggagcaacugagcaacaugaucgucagguccugcaaaugcaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3328 - RNA, 1627 nt, Artificial Sequence
  mRNA product Design2 comprising derived and/or modified sequence from Homo sapiens__NP_003229.1__HsTGFB2 (opt7)
ggggcgcugccuacggagguggcagccaucuccuucucggcaucaagcuuaccaugcacuacugcgugcugagcgccuuccucauccugcauuuggucaccguggcacugucccucaguacuuguagcacccuggacauggaucaguuuaugaggaagcggauugaggccauccgcggccaaauuuuguccaaacugaagcucacgagucccccagaagacuauccggagcccgaagagguaccacccgaagugaucagcauuuacaacuccacuagggaucugcugcaggagaaagcgagccggcgcgccgcagccugcgagagggaacgguccgacgaggaauauuacgcaaaggaggucuauaaaaucgauaugccacccuucuuuccaagugagaaugccaucccgcccaccuucuaccgcccauauuuuaggauugugcgguucgacgugagcgcgauggaaaagaacgccuccaaucucgucaaggcagaguuucgcguguucaggcugcagaaccccaaagcccggguaccagaacagcgcaucgaguuguaccaaauucucaagagcaaagaucugaccagucccacucagagguacaucgacuccaagguggucaaaacccgggccgaaggggaguggcugagcuuugaugugacggacgcagugcacgaguggcugcaucacaaggaucgcaauuuggguuucaaaauuucccuccauuguccgugcuguacuuuuguccccaguaacaauuauaucauuccaaacaagagcgaggaacuggaagccagguucgcgggcaucgacgggaccuccacuuacaccagcggcgaucagaagaccaucaaaaguacgcggaagaaaaauuccgguaagacuccccaucugcuccugauguugcugccaagcuaucgccucgagagucagcaaaccaacaggcggaaaaagagggcccuggacgcagccuacugcuuccgcaaugugcaggacaacuguugccugcggcccuuguauauugauuuuaagagggaccucggguggaaauggauccacgaaccaaagggcuacaaugcaaacuucugugccggcgccugcccguaucugugguccagcgauacucagcacagccgcguacugucccucuacaauaccauuaaccccgaggcgagugcaagcccaugcugugugucccaggaccuggagcccuugaccauccuguacuauauugggaaaacuccaaagaucgaacaacucagcaacaugaucgucaaaaguugcaaguguuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3329 - RNA, 1621 nt, Artificial Sequence
  mRNA product Design2 comprising derived and/or modified sequence from Homo sapiens__NP_003230.1__HsTGFB3 (opt7)
ggggcgcugccuacggagguggcagccaucuccuucucggcaucaagcuuaccaugaagaugcaucugcagagggcccucgugguccuggcauugcugaacuucgccaccgugagccucucccugaguacuugcaccacguuggacuuuggccacaucaaaaagaaacggguagaggcgauucgcgggcaaauccugagcaagcucaggcugacuuccccacccgaaccgaccgugaugacccacguccccuaccaggugcuggcccucuauaauaguacucgggagcuguuggaagagaugcauggugaacgcgaggagggcuguacccaggaaaacacggagagcgaauacuaugcaaaagagauucacaaguucgauaugauccaggggcuggccgagcauaaugaacucgcagugugcccaaagggcauuacuuccaaagucuuuagguucaacgugagcuccguagagaagaaucggaccaaccuguuucgcgccgaguucagggugcugcggguccccaauccaaguagcaaacgcaacgaacaaaggaucgaauuguuucagauccuccggcccgacgagcacauugcgaagcagcgcuacaucggugggaaaaaucugccaacuaggggcaccgccgaguggcuguccuucgaugugaccgacacggugcgggaauggcuccugcgcagggagagcaacuugggccuggaaauuaguauccacuguccgugccauacuuuucagcccaauggggauauucucgagaacauccacgaagucauggagauuaaguucaaagguguggacaaugaggaugaccauggccgcggggaucugggccggcugaagaagcaaaaagaccaccacaacccacauuugauccucaugaugauucccccacacaggcuggauaaucccggucaagggggccagcggaagaaaagggcacuggacaccaacuauuguuuucgcaaccucgaagagaauugcuguguacggccgcuguacaucgauuucaggcaggacuugggcuggaagugggugcaugaacccaaaggguauuacgccaacuucugcuccgguccaugucccuaccugcgcagcgccgacacuacccacuccaccguccucggccuguauaauacucugaacccagaggcaagugccagccccugcugcgugccacaggauuuggaaccgcucacgauccuguacuauguggggcggacccccaaggucgagcagcuguccaauauggugguaaagagcuguaaaugcaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3330 - RNA, 1768 nt, Artificial Sequence
  mRNA product Design2 comprising derived and/or modified sequence from Homo sapiens__NP_001057.1__HsTNFRSF1B (opt7)
ggggcgcugccuacggagguggcagccaucuccuucucggcaucaagcuuaccauggcccccguggcagucugggccgcgcuggccgugggccucgagcugugggcagccgcacacgccuugccagcgcagguagccuucaccccguacgcacccgaaccagggagcacuugcaggcugcgggaguauuacgaccaaaccgcccagauguguugcuccaaguguagucccggucagcaugccaaaguguuuugcacgaagacuagcgauaccgucugugacuccugcgaagauaguaccuauacucagcucuggaacugggugccagagugucugagcugcggcucccgcuguagcuccgaccaaguggaaacccaggcaugcacgagggagcagaaucggaucugcacuugucgccccgggugguacugcgccuugaguaaacaggagggcuguaggcugugcgcgccacuccggaagugucgcccggguuucggggucgccaggcccggcaccgaaacuagcgaugugguaugcaaaccaugugcacccggcaccuuuuccaacaccacgagcaguacugacauuugccggccacaccaaaucuguaauguggucgccauucccgggaacgcauccauggaugccgugugcaccagcacuuccccgacccgcaguauggcccccggugcggugcaucugccacagcccgucagcaccaggucccagcacacucagccaacgcccgagccaagcaccgcaccgaguacuuccuuccugcuccccaugggcccaagucccccagccgaagggagcaccggcgacuuugcccugcccguggguuugaucguaggggugaccgcacugggccuccugauuaucggcgucgugaauugcgugaucaugacucaagucaagaagaaaccgcuguguuugcagcgggaggccaaggugccacaucuccccgcggauaaagcccgcgggacgcagggucccgagcaacagcaucugcugauuaccgcaccauccagcagcuccaguagccucgaauccagcgccagugcacuggacaggcgggcccccacucgcaaccagccacaggccccgggcguagaggcauccggggccggcgaagcgagggccagcaccgguuccagugauagcucccccggcgggcacggcacccaagugaaugucacuugcaucgugaacgucuguagcaguuccgaccacagcucccagugcaguagccaggcauccagcacgaugggggauaccgacaguuccccaagcgagucccccaaggacgaacaggugccauucagcaaagaggagugugccuuucggagucaauuggaaacucccgagacccugcucgguagcacugaagagaagccgcugccacugggcgugcccgaugccgggaugaaaccauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3331 - RNA, 895 nt, Artificial Sequence
  mRNA product Design2 comprising derived and/or modified sequence from Homo sapiens__NP_002623.2__HsPGF (opt7)
ggggcgcugccuacggagguggcagccaucuccuucucggcaucaagcuuaccaugcccgugaugaggcuguucccaugcuuucuccagcuguuggccggccuggcacucccggccgugcccccacaacagugggcgcugagcgccgggaacgguuccagugaggucgaaguagugcccuuccaggaggucuggggccggagcuacugucgcgcauuggaaaggcugguggacguggucuccgaguauccaagugaaguggagcacauguuuagccccuccugcguaagccuccugcgguguaccgggugcuguggcgaugagaaucugcauugcgugccagucgaaacugccaacgugaccaugcagcuccugaagauccgcuccggugacaggccgaguuacguggaguugacguucagccaacacguccggugugaaugccgcccccugagggagaaaaugaagccagagcggcgcaggcccaaagggcggggcaagcgcaggcgggaaaaacagcgcccaacugauugucaucucugcggcgacgcagugcccaggcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3332 - RNA, 1621 nt, Artificial Sequence
  mRNA product Design2 comprising derived and/or modified sequence from Homo sapiens__NP_001020537.2__HsVEGFA (opt7)
ggggcgcugccuacggagguggcagccaucuccuucucggcaucaagcuuaccaugaccgacaggcagacugauaccgcccccagcccauccuaccaucugcucccgggccggcgcaggacgguggacgcagccgcgagucgggggcaaggucccgagccagcccccggcgggggcgucgaaggugugggggcacgcggcguagcccugaaguuguucgugcagcugcucggcugcagcagguuugggggugcagucgugcgggccggcgaggcggaaccauccggggccgcacgcagugccagcuccggcagggaggaaccccagccagaggagggugaagaggaagaggagaaagaagaggaacgggggccgcaguggcgccugggcgccaggaagcccggcagcuggacuggggaggcagccgugugugcggauuccgccccagcagcccgggcaccccaagccuuggcccgcgcgagugguaggggcgggcgggucgcacgcaggggcgccgaagagagcgguccaccccacuccccgagccggcgcggcagugccuccagggcagggcccggccgggccagcgagaccaugaacuuccugcucuccugggugcacuggagucuggcgcugcuccuguauuugcaucacgccaaauggagccaggcagccccaauggcagaaggggguggccagaaucaucacgagguagugaaguuuauggacgucuaccagagguccuauugccaccccaucgaaacccugguggauauuuuccaagaguacccagacgaaaucgaguauauuuuuaaacccagcugugugccacucaugcgcugcgggggcuguugcaacgaugagggucuggaaugugucccgacugaggaaaguaauaucaccaugcagauuaugcggaucaagccccaucagggccagcacaucggggagauguccuuccugcaacauaacaagugcgaauguaggcccaaaaaggaccgcgcccggcaggagaaaaagagcgugaggggcaaagggaagggccagaaacgcaagcggaagaaaaguagguacaaguccuggagcguauaugugggugcccggugcugcuugaugccauggagccucccagggccccacccguguggcccaugcuccgagcgcaggaaacaccuguuuguccaagauccccagacguguaagugcaguuguaaaaauacugacagccggugcaaggcacgccagcuggaacucaacgagaggaccugucggugcgauaagcccaggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3333 - RNA, 1081 nt, Artificial Sequence
  mRNA product Design2 comprising derived and/or modified sequence from Homo sapiens__NP_001165094.1__HsVEGFA (opt7)
ggggcgcugccuacggagguggcagccaucuccuucucggcaucaagcuuaccaugaacuuccugcucagcugggugcacuggucccuggccuugcugcucuaccugcaucacgcaaaguggagucaggccgcgcccauggccgagggcgggggucaaaaucaucacgaagucgugaaauuuauggacguauaucagaggagcuacugccauccaaucgagaccuugguggauauuuuccaggaauauccggacgagaucgaauacauuuuuaagcccuccugugucccacugaugcggugcggcggguguugcaacgaugagggccucgagugugugcccacugaagagaguaauaucaccaugcagauuaugcgcaucaaaccacaccaaggucagcacaucggggaaaugagcuuccugcagcauaacaagugcgaguguaggcccaaaaaggaccgggcacgccaggagaagaaauccgugaggggcaagggcaaagggcaaaagcggaaacgcaagaaaagcagguauaaguccuggagugucuacgugggugcccggugcugucugaugccauggagccucccgggcccccacccaugcgggcccugcuccgaacgcaggaagcaucuguuuguacaggauccacagacguguaaaugcagcuguaagaauacugacagucggugcaaagcacgccaguuggagcugaacgaaaggaccugucggugcgauaagcccaggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3334 - RNA, 1006 nt, Artificial Sequence
  mRNA product Design2 comprising derived and/or modified sequence from Homo sapiens__NP_003368.1__HsVEGFB (opt7)
ggggcgcugccuacggagguggcagccaucuccuucucggcaucaagcuuaccaugagcccccugcucaggcggcuguugcuggccgcacuccugcaguuggccccagcgcaagccccggugucccagcccgacgcaccaggccaccagcgcaaggucgugaguuggaucgauguauacaccagggccacuugccagccccgggagguggucgugccacugaccguggaacucauggggacggucgcaaaacaacuggugcccagcuguguaacugugcagcgcugcgguggcuguugcccagacgaugggcuggagugugucccgaccggccagcaucaggugaggaugcaaauucucaugauccgguaucccuccagucagcugggugaaaugagcuuggaggaacacucccagugcgagugucgcccaaagaaaaaggacagcgccgugaaacccgauagggcggccaccccacaucaccggccccagccgcgcuccguccccgggugggacagugcaccaggcgcccccagcccagccgauauuacucaucccaccccagcaccgggccccuccgcccacgcggccccaagcacgaccagugcacugacucccgggccagccgcagccgccgcggacgcagccgccuccagcguggcaaaggguggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3335 - RNA, 1642 nt, Artificial Sequence
  mRNA product Design2 comprising derived and/or modified sequence from Homo sapiens__NP_005420.1__HsVEGFC (opt7)
ggggcgcugccuacggagguggcagccaucuccuucucggcaucaagcuuaccaugcaucugcucggcuucuuuagcguggccugcucccuguuggcagccgcgcugcuccccgggccaagggaggccccggcagccgcagccgcguucgaaaguggucuggacuugagcgaugccgagcccgacgcaggcgaagccaccgccuacgcauccaaggaucuggaggaacagcuccggagugucagcuccguggacgagcugaugacuguacuguauccagaguacuggaaaauguauaagugucaacuccgcaaagggggcuggcagcacaacagggaacaggccaaucugaacagccggaccgaggaaacgaucaaguuugcggccgcacacuacaauacugagauuuugaaauccaucgauaacgaguggcgcaagacccagugcaugcccagggaaguguguauugacgucgguaaggaguucgggguggccaccaauacuuucuucaaaccacccugcgugagugucuaucgguguggcggcugcuguaacagcgaagggcugcaaugcaugaauaccuccacgagcuaccucaguaagacucuguuugagaucaccgugccacugucccaggguccgaaacccguaacuauuagcuucgcaaaccauaccuccugucgcugcaugaguaaguuggauguguauaggcagguccacagcaucauccggcgcucccucccagccacccugccccagugccaagccgcgaauaaaacguguccaacuaacuacauguggaauaaccauauuuguaggugccuggcacaggaagacuuuauguucagcagugaugccggcgacgauuccaccgacggguuucacgauaucugcggccccaauaaggagcucgacgaggaaacuugucagugcgugugucgggccggucugcgcccggcaagcugcgggccccacaaagaguuggacaggaacaguugucagugcgugugcaagaauaagcuguucccaucccaauguggcgccaaccgggaauuugaugagaauaccugccagugugucugcaaacgcaccugucccaggaaccagccacucaaccccggcaagugcgcgugugaaugcacugagagcccacaaaaaugucugcugaaggggaaaaaguuucaucaccagacgugcagcuguuaccggcgcccgugcaccaauaggcagaaggccugcgagcccgguuucuccuauagugaagaggugugucggugcguaccaagcuacuggaaaaggccccagauguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3336 - RNA, 1447 nt, Artificial Sequence
  mRNA product Design2 comprising derived and/or modified sequence from Homo sapiens__NP_004460.1__HsVEGFD (opt7)
ggggcgcugccuacggagguggcagccaucuccuucucggcaucaagcuuaccauguacagggaguggguggucgugaacguauucaugaugcuguaugugcagcucguccaaggcagcuccaaugaacacgggcccgugaagcggaguagccaguccacccuggagcgcagugaacagcagaucagggccgcaagcuccuuggaggaacugcuccggauuacucauagcgaggacuggaaacuguggcgcugcagguugcggcugaaguccuuuaccaguauggauagccgcuccgccagccacaggaguacgcgguucgcggccacuuuuuacgacaucgagacccucaaagugauugaugaagaguggcaacgcacccaguguuccccaagggaaacuugcgucgagguggcaagcgagcuggguaaguccaccaacacguucuuuaaaccgcccuguguaaauguguuccggugcggcggguguugcaacgaagagagucugaucuguaugaauacuagcaccuccuauauuagcaagcagcucuuugaaaucagugucccacugacuuccgugcccgaguuggugccagucaagguggccaaccauaccggcugcaaaugucugcccaccgcaccacgccacccguacagcaucauuaggcggaguauccagauucccgaagaggaccgcugcucccauagcaagaaacucugcccaaucgauaugcugugggacagcaauaaguguaaaugcguacugcaagaggaaaaccccuuggccgguacggaggaucacucccaccuccaggaaccagcgcugugugggccccauaugauguucgacgaggauaggugcgaaugugugugcaagacuccgugucccaaagaccugauucagcacccaaagaauugcaguuguuuugagugcaaggagagccucgaaaccugcugucagaaacauaagcuguuccaccccgauacuugcuccugugaggaccggugcccauuucacacccgccccugugccagcggcaaaaccgcaugcgccaagcauuguagguucccaaaagaaaagcgggccgcacaaggcccgcacaguaggaagaaccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3337 - RNA, 1012 nt, Artificial Sequence
  mRNA product Design2 comprising derived and/or modified sequence from Homo sapiens__NP_061986.1__HsFGF21 (opt8)
ggggcgcugccuacggagguggcagccaucuccuucucggcaucaagcuuaccauggacuccgacgaaaccggcuucgaacacuccggccucugggucuccguccucgccggccuacuacuaggcgccugccaagcccaccccauccccgacucauccccacuucuacaauucggcggacaagucagacaacgauaccucuacaccgacgacgcccaacaaacagaagcccaucucgaaauaagagaagacggcaccgucggcggcgccgccgaccaaucccccgaaucccuacuccaacucaaagcacucaaacccggcgucauccaaauccucggcgucaaaaccucccgcuuccuaugccaacgccccgacggcgccuuauacggcucccuacacuucgaccccgaagccugcucuuuucgcgaacuccuacucgaagacggcuacaacguauaccaauccgaagcccacggccuaccccuacaccuccccggcaacaaaucaccccaccgcgacccagccccacguggccccgcacgcuuccucccacuaccaggccucccacccgcccuccccgaaccacccggcauccucgcaccccaaccacccgacguaggcuccucagacccccucuccauggucggccccucccaaggccgcucacccucauacgccucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3338 - RNA, 1792 nt, Artificial Sequence
  mRNA product Design2 comprising derived and/or modified sequence from Homo sapiens__NP_002412.1__HsMMP1 (opt8)
ggggcgcugccuacggagguggcagccaucuccuucucggcaucaagcuuaccaugcacuccuucccaccccuccuccuacuucucuucuggggcguaguaucccacuccuuccccgccacacuagaaacccaagaacaagacguagaccugguccaaaaauaccuagaaaaauacuacaaccucaagaacgauggacgacaagucgaaaaacgccgcaacuccggcccggucguagaaaagcuaaaacaaaugcaagaguucuucggccuaaaagucacuggcaaaccagacgccgaaacccucaaagucaugaaacaaccacgaugcggcgucccagacgucgcacaauucguccucacagaaggcaacccccgaugggaacaaacccaccucaccuaccgaauugaaaacuacacaccugaccugcccagagccgacguagaccacgccauagaaaaagccuuucaacucuggucaaacgucacaccccucaccuuuaccaaagucucggaaggccaagccgacauaaugauuagcuucguucgaggcgaccacagagacaacucccccuucgacggacccggcggcaaccucgcccacgccuuccaacccggcccggguauaggcggagaugcacauuucgacgaagacgaacgcuggacaaacaacuucagagaauacaaccuccaccguguagcagcccacgaacuaggccacucacucggacucucacacagcaccgacaucggagcccuaauguacccauccuacacuuucuccggagacguucaacucgcccaagacgacaucgacggcauccaagcaaucuacggccgcucccaaaacccaguacaacccaucggaccacagacucccaaagccugcgacuccaaacucaccuuugacgcaaucaccaccauccgaggcgaagucauguucuucaaagaccgcuucuacaugcgcacgaaccccuucuacccagaagucgaacucaacuucauaucagucuucuggccccaacuaccaaacggccuugaagcagcauacgaauuugccgacagagacgaaguccgcuucuucaaaggaaacaaauacugggccguccaaggccaaaacguccuucacggcuaccccaaggacauauacuccuccuucggcuucccccgaacagucaaacacaucgacgcggcacuguccgaagaaaauaccggcaagacauacuucuucgucgccaacaaauacuggcgguacgacgaauacaaacgauccauggaccccggcuaccccaaaaugauagcacacgacuucccgggaaucggccacaaagucgaugcaguauucaugaaagacggauucuucuacuucuuccacggcacacgccaauacaaauucgaccccaaaacaaaacgcauccucacccuccagaaagccaacagcugguucaauugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3339 - RNA, 1552 nt, Artificial Sequence
  mRNA product Design2 comprising derived and/or modified sequence from Homo sapiens__NP_002412.1__HsMMP1(1-19,100-469) (opt8)
ggggcgcugccuacggagguggcagccaucuccuucucggcaucaagcuuaccaugcacuccuucccuccccuacuacuccuacuauucuggggagucguaucacacuccuucguccucaccgaaggcaacccucgaugggaacaaacccaccucacuuaccgaaucgagaacuacacccccgaccucccacgagccgacgucgaccacgccaucgaaaaagccuuucaacuaugguccaacgucacaccccucaccuucacuaaaguaagcgaaggccaagccgacaucaugaucagcuucguccgcggagaccaccgagacaauucccccuucgacggcccaggaggcaaccuagcccacgccuuucaaccaggacccggcauaggaggcgacgcccacuucgacgaagacgaacgauggacaaacaacuuccgcgaauacaaccuccacagaguagccgcccacgaauuaggccacucccuaggacucucacacucaaccgacauaggugcccucauguaccccuccuacaccuucagcggcgacguccaacuagcccaagacgacaucgacggcauacaggccaucuacggccgaucucaaaauccaguccaacccauaggaccacagacaccaaaagccugugacuccaaacucaccuucgacgccaucaccaccauacgcggagaagucauguucuuuaaagacagauucuacaugcguaccaaccccuucuacccagaaguagaacuaaacuucauaucugucuucuggccacaacuccccaacggccuagaagcagcauacgaauuugcugacagagacgaaguacgauucuucaaaggcaacaaauacugggccguccaaggccaaaacguacuacacggcuacccaaaagacaucuacuccuccuucggcuucccccgcacagucaaacacaucgaugccgcacucagcgaagaaaacaccggaaaaaccuacuucuucgucgccaacaaauacuggcgauacgaugaauacaaacgauccauggaccccggauaccccaaaaugaucgcccacgacuuccccggaauaggccacaaagucgacgcaguuuucaugaaagacggcuucuucuacuucuuccacggaaccagacaauacaaauucgaccccaaaaccaaacgcauccucacccuccaaaaagccaacuccugguucaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3340 - RNA, 3739 nt, Artificial Sequence
  mRNA product Design2 comprising derived and/or modified sequence from Clostridium histolyticum__BAA77453.1__ColG (opt8)
ggggcgcugccuacggagguggcagccaucuccuucucggcaucaagcuuaccaugaagaaaaacauccucaaaauacucauggacucguauucuaaggaauccaaaauccaaaccgucagacgcgucacuagcgucucccuccucgcgguguaccuaacuaugaauacguccagccuaguccucgcaaagccuaucgagaacaccaacgacaccagcauuaaaaacguugagaagcuacgcaacgcgccaaacgaggaaaacucaaagaaagucgaagacagcaaaaaugacaaaguagagcacguuaaaaacauagaagaagccaagguggaacaaguagcaccggaagucaaaagcaaaaguacccuacgcagcgccagcauugccaacaccaacagcgaaaaguacgacuucgaguaucuuaacgggcucagcuacacagaacuaacaaaccugaucaaaaacauaaaauggaaccaaauaaacgguuuguucaacuacagcacagggucacaaaaauucuucggcgauaaaaaccgcguccaggccaucauaaacgcccuacaagaaagcggccgcacauacaccgcgaacgacaugaagggaauagaaaccuucacggagguauuaagggcgggguucuaccuaggcuacuacaaugacggacucucauaccuaaacgaccgcaacuuccaagacaagugcauccccgccaugauagccauacagaaaaacccaaauuuuaaacucggcacggccguccaagacgaaguuauaacauccuuagggaaacucaucggaaacgccucggccaacgccgaaguggugaacaacugcguccccguacuuaagcaauuccgcgaaaaccuaaaccaauacgcacccgacuacguuaaggggaccgcggucaacgaauugauaaaaggaaucgaguucgacuuuagcggagcagcauaugaaaaggacgugaagacaaugcccugguacggcaagauugauccguucauuaacgaacucaaggcccucggacuauacggaaacauaaccucagcaaccgagugggcuucagauguaggcaucuacuaccugagcaaguucggccuauacagcaccaaccgcaacgacauugugcaaaguuuagaaaaagcagucgacauguacaaguacggcaagauugcauuuguagcgauggaacgaauaacgugggacuacgacggcaucggcuccaacggaaagaaagucgaccacgacaaguuccuggaugacgccgagaagcacuaccuccccaagacauacaccuucgacaacggcaccuucaucauccgagccggcgacaaaguaucggaagaaaagaucaagagacuauacugggccuccagagaagucaaaucccaauuccaccgagucgucggaaacgacaaggcccuagaaguaggaaacgccgacgacguauuaacuaugaaaauuuuuaacagcccagaagaauacaaauucaacaccaauauuaacggcguaucaacagacaacggaggacuguacauagaaccccgagggacauucuacacauacgaacggaccccacaacaauccaucuuuagccuggaagaacucuucagacacgaauacacccacuaccuacaggccagauaccuagucgacgguuuauggggacaaggccccuucuacgagaaaaaccgacucacaugguuugacgagggcacagccgaguucuucgcaggaucaacaagaaccagcggcgugcucccgcgaaagucgauccuuggcuauuuagcgaaagacaaaguagaccacagauacagccuaaagaaaacacugaacucaggcuacgacgauagcgacuggauguucuacaacuauggcuucgcaguagcgcacuaccuuuacgaaaaagacaugccgacguucaucaagaugaacaaagcaauacuaaacaccgacguuaaaucguacgacgaaauaaucaaaaagcuguccgacgaugccaacaaaaacacagaauaccaaaaccauauccaggaacucgcggacaaguaccagggggcaggaaucccccuagucucggacgacuaccuaaaagaccacggcuacaagaaagcaagcgaaguauacagugagaucagcaaagccgccucccuaacgaacacaucagugacugcugagaaaagccaguacuucaacaccuucacacuccgaggaacuuacacgggagaaacaucaaaaggcgaguucaaagacugggacgaaaugagcaagaaauuagacggcacccuagaaucacuagcgaaaaacucuuggagcggauacaagacccuuaccgcauacuucacgaacuacagggucaccagugacaacaaagugcaguacgacgucguguuccacggaguucuaacagacaacgccgacaucuccaauaacaaagcaccaaucgccaaggugacggggccaagcacaggagccgucggacgaaacauagaguucucaggcaaagacagcaaggacgaagacgggaagauaguaaguuacgacugggacuucggugacggagcaacaucccgcgguaagaacagugugcacgcauauaagaaggccggaacauacaacguaacccuaaagguaacggacgacaaaggagcgacagcgaccgaaucguuuacuaucgaaauaaagaacgaagacacgaccacuccaauaacaaaagaaauggaaccaaacgaugacaucaaagaagccaacggcccuauagucgaagguguaaccguaaaaggcgaccucaacggcuccgacgacgcagacacguucuacuucgacgugaaagaagacggggacguaacaaucgaacuccccuacuccggcuccucaaacuucaccuggcuaguauacaaggaaggggacgaucaaaaccacaucgcaagcggaaucgauaaaaacaauaguaaaguagggaccuucaaaucgacaaagggaaggcacuacgucuucauuuacaagcacgacagcgccagcaacauaaguuacuccuuaaacaucaaaggacuaggcaacgaaaaacuuaaggaaaaagagaacaacgacucaagcgacaaagcgacuguaaucccaaacuucaauacgacaaugcaagguucccuccucggagacgacucacgggacuacuacagcuucgaagucaaggaagaaggcgaagugaacaucgaacuggacaaaaaggacgaguucggcguaaccuggacccugcaccccgaaagcaacaucaacgacaggaucaccuacggccaaguagacggcaacaaagucagcaacaaagucaaacuccgccccggcaaguacuaccuacuggucuacaaguacagcggcucaggaaacuacgaacuccgcgucaacaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3341 - RNA, 3463 nt, Artificial Sequence
  mRNA product Design2 comprising derived and/or modified sequence from Clostridium histolyticum__BAA77453.1__HsALB(1-18)_ColG(111-1118) (opt8)
ggggcgcugccuacggagguggcagccaucuccuucucggcaucaagcuuaccaugaaaugggucaccuucauaagccuccucuuucuguucagcagcgcauacucaauagccaacaccaacucagaaaaauacgacuucgaauaccuaaacggccuaagcuacaccgaacuaaccaaccucaucaaaaacauaaaauggaaccaaauaaacggccuauucaacuacagcaccggcagucaaaaguucuucggugacaagaaccgcguccaggcgauaaucaacgcccuacaagaauccggccgcaccuacacagccaacgacaugaaaggcauagaaacauucacggaaguacuacgugcuggauucuaucuaggcuauuauaacgacggacugagcuaccuaaacgacaggaacuuucaagacaaaugcauccccgccaugauagcaauccagaaaaaucccaacuuuaaacucggaacggcgguccaagacgaggugaucacgucacuuggaaaacucauaggaaacgcgagcgccaacgccgagguaguaaauaacugcguaccaguccugaagcaauuccgugaaaaucuuaaccaauacgccccagacuacguaaaaggaacugcggucaacgagcucauaaaaggaauagaguucgacuucagcggagccgcauaugaaaaagacguaaagaccaugcccugguacggcaaaauagacccguucaucaacgaacucaaggcacuaggccuauacggcaacaucacaagcgccaccgaaugggccucagacgucgggaucuacuaccuaucaaaauucggacucuacagcacaaaccgaaacgacaucguacaaucccuagaaaaagcagucgacauguacaaauacggaaagaucgcauucgucgccauggagcgcaucacgugggauuacgacggaauaggcucaaacggaaagaaagucgaccacgacaaauuccucgacgacgcagaaaaacacuaccugccgaaaacuuauacguuugacaacggcaccuucauuauccgcgcgggcgacaaaguaucugaggaaaagaucaaacgacuauacugggcuagccgagaaguaaaaagccaguuccaccgaguagucggaaacgauaaggcgcucgaaguaggaaacgccgacgacguccuuacuaugaagaucuucaacagccccgaagaauacaaauucaacacuaacaucaacggcguauccacagacaacggaggccuauacaucgaaccuaggggcaccuucuacaccuacgaacgcaccccacaacaaucaaucuucucucuugaagaacucuuccggcacgaguacacccacuaccuacaagcacgauaccucgucgacggccuauggggccaaggaccauucuacgagaaaaacagacucaccugguuugacgaagggaccgcugaguucuucgccggcagcacaagaacaucaggaguccucccccgaaagagcauccuaggauaccuggccaaggacaagguagaucaccgcuacagccuaaagaagacacuaaacagcggcuacgacgacuccgacuggauguucuauaauuacggcuucgcgguagcacacuaccuguaugaaaaagacaugccaaccuucaucaaaaugaacaaagcaauacuaaacaccgaugucaaaagcuacgaugaaauuaucaaaaagcugagcgacgacgcaaauaaaaacaccgaauaucaaaaccacauccaggaacucgccgacaaauaccaaggcgcagggaucccccuggugucagacgacuaccuaaaagaccacggcuacaagaaagccucggaagucuacuccgaaaucaguaaagcagccagccuaaccaauacaucaguuacagccgaaaagagccaguacuucaacacauucacacugaggggcaccuacacaggcgaaacuuccaaaggggaguucaaggacugggacgaaaugagcaagaagcucgacggcacccucgaaucacucgcuaaaaauucauggucgggauacaagacuuuaacggcauacuucacgaacuaccgagugacaagcgacaacaaaguccaauacgacgucgucuuucacggcguccugaccgacaacgcagacauauccaacaacaaagcaccgaucgcaaaagucaccggaccgagcaccggggcagucgggagaaacaucgaguucucaggcaaagacuccaaggacgaggacggcaaaaucgucagcuacgacugggacuucggagacggcgcaacaagccggggcaagaacucaguccacgccuacaagaaagcaggaaccuacaacguaacacuaaaaguaaccgacgacaaaggggcaacagccaccgaaucguucaccauagaaaucaaaaacgaagacaccaccacccccauuacgaaagagauggaaccgaaugacgacaucaaagaggcuaacggcccuaucgucgagggcguaaccguaaaaggcgaccuuaacggaucggaugacgcagacaccuucuacuucgacguaaaagaagauggcgacgucacuaucgagcucccauacuccggcuccagcaacuucaccuggcucguauacaaggaaggugacgaccagaaccacaucgcuucggggauagacaaaaauaacucuaaaguuggcacauucaagagcacaaaaggccggcauuacguuuucauauacaagcacgacuccgcuucaaacaucaguuacagccucaacaucaagggacugggaaaugagaagcucaaagagaaagagaacaacgacuccuccgacaaagccacgguaauacccaacuucaauacgaccaugcaagguucucuacucggcgacgacagcagggacuacuacucguuugaggucaaggaggaaggcgaaguaaacauagagcuugacaagaaagacgaguucggugugacguggacacuacacccagaguccaacauaaaugacagaauaacauacggccagguagacggcaacaaggugagcaacaaagucaaacuccgacccgguaaauacuaccuauuagucuacaaauacuccggaagcgggaacuacgagcuacgcgucaauaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3342 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt8)
ggggcgcugccuacggagguggcagccaucuccuucucggcaucaagcuuaccaugaaauggguaaccuucauaucccuccuguuccuauucucaucagcauacagcaugaagaaaaacauccucaaaauccuaauggauagcuacucaaaggaaaguaaaauccagacgguucgccgagugacguccgucucccuucuagcaguauaccucacuaugaacacaagcucccuaguccuggccaaacccauugaaaacaccaacgacaccucuauaaagaacguagaaaaacuccgaaacgccccaaacgaggaaaacucaaagaaaguagaggauucuaaaaacgacaaaguagaacacgucaaaaacauagaagaggccaaaguagaacaagucgccccggaagucaaauccaaaagcacgcugcggucggcgucucgccggcgacggaaacgcauagcaaacacaaacucggaaaaauacgacuucgaauaccucaacggacucagcuacaccgaacugacgaaccucaucaaaaacaucaaauggaaccaaaucaacggacuguucaacuacuccacaggaucccaaaaguucuucggcgacaaaaaccgaguacaggcgaucauaaaugcccugcaggaaagcggcagaacuuauaccgcaaaugacaugaagggcaucgaaacguucaccgagguccugagagcgggcuucuaccuaggauacuacaacgacggacucagcuaccucaacgaccgcaacuuucaggauaaaugcauaccggcaaugaucgcaauccagaaaaaccccaacuucaaacuuggaacagcgguacaagaugaggucaucacaucgcugggaaagcuaauaggaaacgccuccgcaaacgccgaaguagucaacaacugcgucccuguauuaaaacaauuccgugagaaccucaaccaauacgcccccgacuacgucaaaggcaccgccgucaacgaacugauaaagggcauagaguucgacuucaguggagcagcauacgaaaaagacgucaagaccaugcccugguacggcaaaaucgaucccuucaucaaugaacucaaagcgcuuggccucuacggaaacauaaccucugccacagaaugggcaagcgacgucggaauauauuaccuauccaaauucggccucuacagcacaaacagaaacgacauaguacagucacucgaaaaagcugucgacauguacaaauacggaaagauagcauucgucgcaauggaacgcauaacaugggacuacgacggcauaggguccaacggcaagaaaguagaccaugacaaguuccuagacgacgcagaaaaacacuaccugcccaagaccuacaccuucgacaacggaaccuucauaauccgagcaggcgacaaaguaagcgaagagaaaauaaaacgccuauacugggccagucgagaagucaaaucacaauuccaccgagucguaggcaacgacaaggcacuagaagugggaaacgccgacgauguccuaacuaugaaaaucuucaacagcccggaagaauacaaauucaacaccaacaucaacggggucucaaccgacaacggcgggcuguacauagagccgcgcggcacguucuacacguacgagcgcacaccccaacaaagcaucuuuucgcuagaagaacuuuuccgacacgaauauacccacuacuuacaggcucgauaccucguagauggccuauggggccaaggcccauucuacgaaaagaacagacucaccugguucgacgaaggaaccgcagaguucuucgcaggaucgaccaggacgagcggcguccucccaaggaaauccauacuuggauaccucgcaaaagauaagguagaccaccgguacucacuuaaaaagacucucaacucaggauacgacgacuccgacuggauguucuacaacuacggcuuugccguggcucacuaucuguacgaaaaggacaugcccaccuucaucaagaugaacaaagccauccucaacaccgacguaaaaagcuacgacgaaauaaucaagaaacucucagacgacgcgaauaaaaacacagaauaccaaaaucacauacaagagcucgccgacaaauaccagggcgcggggauaccgcucgucucugacgacuaccucaaagaccacggguacaagaaagccagcgaggucuacagugaaaucagcaaagccgccucgcuaaccaacaccagcguaacggcggagaaaagccaguacuucaacaccuucacacuaagaggaaccuauaccggugagaccagcaaaggcgaguucaaggacugggacgaaauguccaagaaauuagacgggacccuagaaucgcuggccaaaaacuccuggaguggguauaagacccuuaccgcguacuucacaaacuacagagugaccagcgacaauaaaguccaguacgaugucguguuccacggcgugcuaacagacaaugcagacaucucaaacaacaaagccccaaucgccaaagucacgggacccagcacaggcgccguaggccgcaacaucgaauuuucagguaaggauucaaaagacgaagacggcaagaucgucagcuacgacugggacuucggagacggcgccaccagcagagggaaaaacucaguacacgcguacaagaaggccgggaccuacaacgucacccuaaaaguuacggaugacaaaggcgccacagccacggaauccuucaccauagaaaucaagaacgaggacacaacuacccccauaaccaaagagauggagccaaacgaugacauaaaagaagcuaacggcccaaucguggaaggcguuacugucaaaggggaccuaaacggcucagacgacgccgacaccuucuacuuugacguaaaagaagacggggacgucacaauagaacucccauacuccggaaguagcaacuucaccuggcuaguguacaaggaaggggaugaucaaaaccacauagcauccggcauagacaagaacaacucaaaaguugggaccuucaaaucgaccaaaggccggcacuacguauucaucuacaaacacgacuccgcaaguaauauaucauacagccuaaacauaaaggggcugggaaaugaaaaacuuaaggaaaaagaaaacaacgacaguagcgacaaagcaacagugauccccaacuucaauacaaccaugcaaggcucacuccucggagaugacucaagggacuacuacucauucgaagugaaggaagaaggcgaagucaacaucgaacucgacaagaaggacgaguucggcgucaccuggacccuccacccugaaucaaacauaaacgacaggaucaccuacggccaaguagacggaaacaaagugucaaacaagguaaaacucagaccggggaaauauuaccuacugguguacaaauauucuggaagcggaaacuacgaacuacgagucaacaaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3343 - RNA, 3487 nt, Artificial Sequence
  mRNA product Design2 comprising derived and/or modified sequence from Clostridium histolyticum__BAA34542.1__ColH (opt8)
ggggcgcugccuacggagguggcagccaucuccuucucggcaucaagcuuaccaugaacuuccucaaaauaauccuaaaccgaggcaaaaccaugaagcgcaaaugccucagcaagagacucaugcucgcaaucaccauggcuacaaucuucacaguuaacucaacucuccccaucuacgccgcgguagacaaaaacaacgcaaccgccgccguccaaaaugaaucuaaacgauacacagucagcuaccuaaaaacccuuaacuacuacgaccucguagaccugcucgugaaaaccgaaaucgagaaccucccggaccuguuccaauauuccagcgaugccaaagaguucuacgggaacaaaacacgaaugucguucaucauggacgaaaucggacgccgagcgccccaauacaccgagauugaucauaagggaaucccgacgcucgucgaagucguccgagccggguucuaucucggcuuccacaacaaggaacucaacgagauaaacaaacgcucuuucaaggaacgcgucauaccguccauacuugccauacagaaaaaccccaauuucaagcucggaacagaaguacaagacaaaaucguauccgccaccggccugcuagccggaaacgaaaccgcaccaccagaagucgucaacaacuucacucccauccuucaagacugcaucaagaacaucgacagauaugcauuggacgaccuaaaaucaaaagcacuguucaacguucuagccgcgcccacauaugauauaaccgaauaccucagagcaacaaaggagaaacccgaaaacacucccugguacggcaaaaucgacggcuucaucaacgaacuaaagaaacucgcauuauacggcaaaaucaacgacaacaacaguuggaucauagacaacggcauauaccacaucgcgccacuaggaaaacuacacucuaacaacaaaaucggaaucgaaacacuaaccgaagucaugaagguauaccccuaccugagcaugcaacaccuucaaucugcagaucaaaucaaacgacacuacgacagcaaagacgccgagggaaacaagaucccauuagacaaauucaagaaagaaggaaaagagaaauacugcccaaagaccuacacguuugaugauggcaaaguaaucauaaaggccggcgcacgcgucgaggaagaaaaagucaaacgccuguacugggcgucaaaagaagucaacucccaauucuuccgagucuauggcaucgacaaaccccucgaggaaggcaaccccgacgacauacugacaauggucauuuacaacucgccugaggaauacaaacugaacucagugcuauacggcuacgacaccaacaacggcggcauguacaucgaacccgaaggcacuuucuucacuuacgagagagaggcccaagaauccacguacacacuagaagaacuuuuccgacacgaguacacccacuaccuccaaggccguuacgcagucccgggacaauggggacgaacgaaacucuacgacaacgacaggcugaccugguacgaagagggcggggcggaacuauucgcagggagcaccaggacaucggggauacuucccaggaaauccaucgucuccaacauccacaacacaacacgaaauaaucgguauaaacugagcgauaccguccacucaaaauacggcgcgucauucgaguucuacaacuacgccuguauguucauggacuacauguacaacaaagauaugggaauccucaacaaauuaaacgaccucgcuaagaacaacgacguagacggcuacgacaacuacauaagagaccuauccucaaacuacgcucugaacgacaaauaccaagaccacaugcaggaacgaaucgacaacuacgaaaaccucaccgucccguucgucgccgacgacuaccucgugagacacgccuacaaaaaccccaacgaaaucuacagcgagaucagcgaagucgccaaacucaaggacgcaaaauccgaggucaaaaagucucaauacuucagcaccuucacucuacgcggcucauacacgggcggcgccuccaaaggcaaauuagaagaccaaaaagccaugaacaaguuuaucgacgacagccucaagaaacuugacaccuacucguggaguggcuacaaaacucuaaccgccuacuuuacaaacuacaaagucgacucguccaaccgcgugacauacgacguagucuuccacggguaccuaccgaacgagggagacagcaaaaacagccuccccuacggaaaaauaaacggcacauacaagggaaccgaaaaagagaaaauaaaauucuccuccgaaggcucguucgaccccgaugguaagauaguauccuacgaaugggacuucggagacggcaauaaaagcaaugaggaaaacccagaacacucauacgacaaaguagggaccuacaccguuaaauuaaaagucacggacgacaaaggagagucgagcgucucaaccaccaccgccgagauaaaagaccuauccgaaaacaaacuacccguaaucuauaugcacgucccaaaaucaggcgcacucaaucaaaagguugucuucuauggaaaaggcaccuacgacccggacggcagcauagcgggcuaccaaugggacuuuggcgacgguucggacuucucgucagagcaaaacccuagccauguauacaccaagaaaggagaauacaccguaacccugcgagugauggauucaucuggccaaaugucugagaaaacaaugaaaauaaaaaucaccgacccaguauaccccaucgguaccgaaaaagaaccuaacaacaguaaagaaacugcaagcggacccaucguccccggcauuccugucucaggaaccaucgaaaacaccagcgaucaggacuacuucuacuuugauguaaucacccccggcgaagucaaaaucgacaucaacaaacuaggauacggcggagccacauggguggucuacgacgagaacaauaacgccgucucuuacgcaaccgacgauggacaaaaccucagcgguaaauuuaaagcagacaagcccggacgcuacuacauccaccuauacauguuuaacggcuccuacaugcccuaucgaauuaacauugagggcucaguaggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3344 - RNA, 3448 nt, Artificial Sequence
  mRNA product Design2 comprising derived and/or modified sequence from Clostridium histolyticum__BAA34542.1__ColH (opt8)
ggggcgcugccuacggagguggcagccaucuccuucucggcaucaagcuuaccaugaaaagaaaaugccuauccaaacgccucaugcuugcaauaacaauggccacaauauuuaccgucaacuccacccuaccaaucuacgccgccguagauaaaaacaacgcaacagcagccguccaaaacgagagcaaacgauacaccguaucauaccucaagacccuaaacuauuacgaucuaguggaccuccucguaaagacggagaucgaaaacuuaccggaucuauuucaauacuccuccgacgcaaaagaguucuacgguaacaagacacgaauguccuucaucauggacgaaaucggacggcgcgcaccccaauacaccgaaaucgaccacaaaggcauacccacccuugucgaaguuguacgagccggcuucuacuuaggauuccacaacaaggaacucaacgaaaucaacaaacgcuccuucaaagaacgagucauccccuccauccucgcuauucagaagaacccaaacuucaagcucgggaccgagguacaagauaagauagucagcgccaccggccugcuggccggcaaugagaccgcgcccccagagguaguaaacaauuucaccccaauccuacaagauugcaucaagaauaucgaccgcuacgcccuggacgaccuaaaauccaaggcccucuucaacgugcuggccgcgcccaccuacgauaucaccgaauaccucagagcuaccaaagagaaacccgagaacacucccugguauggcaagauagacggcuuuauaaacgaacucaaaaagcuagcacuguacggcaagaucaaugauaacaauucauggaucaucgacaacgggauauaccacauugccccguuagguaaacugcacagcaacaauaaaauaggaaucgagacccuaacugaggucaugaaaguauaucccuaucuuagcaugcaacaccuacaauccgcggaccaaaucaagcgccacuacgacagcaaagacgcugaggggaacaaaaucccccuggacaaguucaagaaagagggcaaggagaaauacugcccaaaaaccuacaccuucgacgacggcaaagucauaaucaaagccggcgcgagaguagaggaagaaaaaguaaagcggcucuacugggccagcaaagaagucaacagucaauucuuccgcgucuacggcaucgauaaaccacuagaagagggaaaucccgacgacauacuaacaaugguaauauacaacagcccagaggaguacaaacugaacuccguccuuuacggauacgauacaaacaacgggggaauguauauagaaccggaaggcacauuuuucaccuacgaacgcgaggcccaggaaucaacauauacacucgaggaguuauuccgccacgaauacacccacuaccuacagggacgcuacgcaguaccagggcaguggggccgcacaaagcucuacgauaacgaccgccuaacgugguacgaagaagggggcgccgaacucuucgccggauccacccgcaccagcgggauccuaccgcgaaagaguauagugagcaacauccauaacaccacgcgcaacaaccgcuacaagcucucagacacaguccacagcaaguacggagcaucguucgaguucuacaacuacgcauguauguucauggacuacauguacaacaaagacaugggcauccucaacaaacucaacgaucucgcgaaaaauaacgacgucgacggauacgacaacuauauccgcgaccucucauccaacuacgcacucaacgacaaauaccaagaccacaugcaggaacgaauagacaacuacgaaaauuuaaccguaccauucguagccgacgacuaccuaguacgacacgccuacaaaaacccuaacgaaaucuacuccgagaucuccgaaguugccaaacucaaagaugccaaaucagaagucaagaaaucccaguacuucagcacauucacucugagaggcagcuacacgggcggcgcguccaaaggaaaacuagaagaucagaaagccaugaacaaauucaucgacgacucucuaaagaaacucgacacauacucguggagcgguuacaaaacacugacugccuacuuuaccaacuacaaagucgacaguucaaaucgagucaccuacgacgugguauuucacgguuaccuacccaacgaaggggacuccaaaaacucacuaccuuacggaaaaauaaaugggaccuacaaaggcacagaaaaagagaaaaucaaauucuccuccgaaggcagcuucgacccugacggaaagaucgugagcuaugaaugggacuucggcgacggcaacaaaucaaacgaagaaaaccccgagcauucauaugacaagguaggaaccuacacagucaagcugaaaguaaccgacgacaaaggggaaucaagcguaagcacuaccaccgccgagaucaaggacuuaagcgaaaacaaacugccaguaauuuauaugcacgucccaaaaucaggcgcccuaaaccagaaggugguauuuuacgguaaagggacguacgaucccgacggcagcaucgccggcuaucagugggacuucggugacggcagcgacuucucaagcgaacaaaaccccagccacguuuacacgaaaaagggcgaauacacagugacacuuagagucauggauagcucgggucaaaugagugagaaaacgaugaaaauaaagaucaccgaccccguguaccccaucggcaccgaaaaggaaccgaacaacucaaaagaaaccgccuccgggcccaucguacccgggaucccuguaucuggcacaauagaaaacacaagcgaccaagacuacuucuacuucgacgucauaacccccggcgaagucaaaaucgauaucaacaaacucggauacggcggagcgacauggguaguguacgacgaaaacaacaacgcaguauccuacgccacagacgacggccaaaaccucuccggcaaauucaaggccgacaagcccggacgauacuacauacaccucuacauguucaacggaucauacaugcccuaccggauaaacaucgaaggaucggugggacgguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3345 - RNA, 3382 nt, Artificial Sequence
  mRNA product Design2 comprising derived and/or modified sequence from Clostridium histolyticum__BAA34542.1__HsALB(1-18)_ColH(41-1021) (opt8)
ggggcgcugccuacggagguggcagccaucuccuucucggcaucaagcuuaccaugaaaugggucacauuuaucagccuccuuuuccuuuucagcucggccuacagcguccaaaacgaaaguaaaagauauaccguauccuaucucaaaacuuuaaacuauuacgaccuaguagaccuccugguaaagacugaaauagaaaaccugccagaccuauuccaauacagcuccgacgcuaaggaguucuacgggaacaaaacccgcauguccuucaucauggacgaaaucgggcgacgcgcaccacaguacaccgaaauagaccacaaagggauucccacucuagucgaggugguacgagccggauuuuaccuuggauuccacaacaaagaacucaacgaaauaaauaagcgaucauucaaagagcggguuaucccaagcauacuggcaauccaaaagaauccaaacuucaaacuuggcacagaaguccaggacaaaauagucuccgccaccgggcuccucgccgggaaugaaaccgcacccccagaagucgugaauaacuucacccccauucuccaggacuguauaaagaacaucgaccgcuacgcacucgacgaccuuaagucaaaagcgcucuuuaacguccucgcggcgccuacauacgacaucacagaauaccuucgcgcgaccaaggaaaagccagaaaacaccccaugguacggaaaaauagacggguucaucaacgaacuaaagaaacuagcgcuauacggcaaaaucaacgacaacaacagcuggaucauugacaacggcauauaucacauagcaccccugggaaaacuccacagcaauaacaagaucggcaucgaaacccuaaccgaaguaaugaaagucuacccguaccucuccaugcagcaucuccagagcgccgaccagauaaaacgacacuacgacucaaaagacgcagaagguaauaagaucccacuggacaaguucaaaaaggagggcaaagaaaaauacugcccuaaaacauacaccuucgacgacggaaagguaauaauuaaagccggagcacgaguagaagaagaaaaaguaaaacgccucuacugggccucaaaggaaguuaauucacaguucuuccgaguguacgguauagacaaaccacuggaggagggaaacccagaugacauacugacgaugguaauauacaacuccccggaagaauacaaacuaaauucaguacuguacggauacgacaccaacaaugggggaauguacaucgaaccagaaggcaccuucuucaccuacgagcgcgaagcccaggagucgacauauacccuagaagaacuguuucgccacgaguacacgcacuacuuacaagggcgcuacgccguccccgggcaguggggccgaaccaaacuguacgacaacgaccgccucaccugguacgaagaagggggagcagaacucuucgcaggaucgacccgcaccagcggaauacucccccgcaagaguauagucagcaacauccacaacaccaccaggaacaacagauacaaacuuucagacaccguucacagcaaguacggggccuccuucgaguuuuacaacuacgcaugcauguucauggauuauauguacaacaaagacaugggaauacuaaacaaacucaaugaccucgccaaaaacaacgacgucgacggcuacgacaacuacauccgagaccucagcagcaacuacgcccuaaacgacaaauaucaagaccacaugcaggagaggauagauaacuacgaaaaucucaccgugccauucguagccgacgacuaccucguacgucacgccuacaaaaaccccaacgaaaucuacagcgagaucucggaaguagcaaaacuaaaagaugcuaaaucagaggugaagaaaucccaauacuucucgaccuucacucuccgcggcuccuacacaggaggagccagcaaagguaaacuagaggaccaaaaagcaaugaacaaauucaucgacgacucccucaagaaacucgauaccuacagcuggagcggauacaaaacguuaaccgcauauuucaccaauuacaaaguggacaguuccaaccgaguaaccuacgauguaguguuccauggcuaccuacccaacgagggcgacagcaaaaacucacuccccuacggaaagaucaacgggacauacaagggcacggaaaaagagaaaaucaaauucagcucagaaggcuccuucgaccccgacggcaagauugucuccuacgagugggacuucggggacggcaacaaaucgaacgaggagaacccagaacacagcuacgacaaggucggcacguacaccgucaagcucaaaguaacagacgacaagggggaauccagcguaagcacgacaacagcagaaaucaaggaccuauccgaaaauaaacuaccggugauauacaugcaugucccuaaauccggcgcucugaaucagaaggugguauucuacgggaagggcacguacgaccccgacggauccauagcaggcuaccaaugggacuucggcgaugguucggacuuuucguccgagcagaacccaagccacguauacacaaagaaaggggaguauaccgucacacuucgagucauggacagcaguggccagaugagugagaaaacaaugaaaaucaaaaucacagaucccguuuacccgaucggcacagaaaaagaaccaaacaauuccaaagagacggcgucaggcccaaucgugcccggaauccccguuucgggaaccauagagaacacaagcgaccaagacuacuucuacuucgacgucaucaccccaggcgagguaaaaauagacauaaacaaacuaggauacggaggcgcaacaugggugguauacgacgaaaacaacaacgcggucagcuaugcaacggacgacggccaaaaccuaucaggaaaguucaaggccgacaagcccggaagguacuauauacauuuguacauguucaacggcagcuacaugcccuacagaaucaacaucgaaggcagcgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3346 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt8)
ggggcgcugccuacggagguggcagccaucuccuucucggcaucaagcuuaccaugaaaugggugaccuucauaucacuccuuuuccuauucucaucagcauacucgaugaaacgcaaaugccucagcaaacgacucaugcuagcuaucaccauggccacaauauucaccguaaacuccacccuacccaucuacgcggcaguggacaaaaacaacgccaccgccgcacgucgccgccggaaacgcguccaaaacgaaaguaagcgcuauacggugagcuaccucaaaacucucaacuacuaugaucuaguagaccuccuagucaaaacggaaauugaaaaccuccccgaccuauuccaguacucaucagacgcgaaagaguucuacggcaacaaaacccggauguccuucauaauggacgaaaucggaaggcgagcaccccaguauaccgagaucgaccacaagggcauccccacgcucguagaaguaguuagagcaggcuucuaccucggguuccacaacaaagaacuaaaugagaucaacaaacgcuccuucaaagaacgcgucauccccucaauacuagcaauccagaaaaaccccaauuucaaacuaggcaccgagguacaagauaaaaucguguccgcaacaggccuccuggcagguaaugaaaccgcgccgccagaaguagucaacaacuucacacccauccuucaggacugcaucaaaaacauagacagauacgcacucgacgaccucaaaagcaaagcacuauucaacguccucgcagcacccacauaugacauaacggaauaccuuagagcaaccaaagaaaaacccgaaaacacacccugguaugggaaaauagacggcuucaucaacgagcuuaaaaagcuggcacuuuacgggaaaauaaacgacaacaacagcuggaucauagacaacggcauuuaccacaucgcaccccuggggaaauugcacagcaacaacaaaaucggcauagaaacccucacggaggucaugaaaguuuacccauaccugucaaugcaacaccuccaauccgccgaccagaucaaacgacacuacgacagcaaagacgccgaaggcaacaagauaccacuagacaaguucaagaaagaaggcaaagaaaaauauugcccuaaaaccuacacauucgacgacggaaaaguaaucauuaaagccggcgcccguguagaagaagaaaaggucaaacgccuauacugggccagcaaagaaguaaauagccaauucuuccgcguauacgggauagacaaaccgcuagaagaaggaaaccccgacgacauacugaccaugguaauauauaacucaccggaagaauacaaacucaacagcguacuauacggcuaugacaccaauaacggaggaauguacaucgagccagaaggaacauucuucacguacgaacgugaagcacaagaauccacauacacccucgaggaacucuuccgucacgaguacacccacuaccuacaggggcgauacgccguacccggccaauggggccgcaccaaacuguaugacaacgaccggcucaccugguacgaagaagggggcgccgaacucuucgccgguucgaccaggacuucaggaauacugccccgcaagagcaucguaagcaacauccacaauacaacccgcaacaaccgcuacaaacuaucagacacaguccacuccaaauacggagcgucauuugaguucuacaacuacgcuugcauguuuauggauuauauguacaacaaagauauggggauccugaauaaacuaaacgaccuagcgaaaaacaacgacguugacggcuacgacaacuacauacgugaccucucaucaaacuacgcccuaaacgacaaauaccaggaccacaugcaagaacgcaucgacaauuacgaaaaccuaacagugccuuuugucgccgacgacuaccucguacggcacgcuuacaaaaaccccaacgaaaucuauucagaaaucucagaagucgccaaauuaaaagacgcuaaauccgaagucaagaagucccaauacuucuccacauuuacccucagaggcucauacaccggaggcgcauccaaaggcaaacuggaggaccaaaaagccaugaacaaauucaucgaugacagucuaaagaaacucgacaccuacuccugguccggauacaaaacgcuaacagccuacuucacaaacuacaaaguagacagcuccaaccgagucaccuacgacgucgucuuccaugguuaccuccccaacgaaggugacagcaaaaauucacuccccuacggcaaaauaaacggcaccuacaaaggcaccgaaaaggagaaaaucaaauucucaucggaaggcagcuucgacccagacgggaagauaguaucguaugaaugggacuucggggacggcaacaaauccaaugaagagaaccccgaacauuccuaugacaaaguggggaccuacacaguuaagcuaaaaguaaccgacgacaaaggcgaaucauccguaucaaccacaacggccgagauaaaagaucuaagcgaaaacaaacuccccguaauauacaugcacgucccuaaaucgggagcucucaaccaaaaagucguauucuacggaaaaggaacauacgacccugacggcuccauagccggcuaccaaugggacuuuggcgacggcagcgacuucuccagugagcaaaaccccucacacgucuacacgaaaaagggcgaauacaccgugacacuucgcguaauggacagcagcggccagauguccgagaaaaccaugaaaaucaagauuaccgacccagucuaccccauaggcaccgaaaaggaaccgaacaauagcaaggaaacagccagcggcccaauagucccggggauccccgucuccggcacgaucgaaaacacuuccgaccaggacuacuucuacuucgacguaauaacccccggcgaaguaaaaaucgacaucaacaaacuaggauacggaggcgccaccugggucgucuacgaugaaaacaacaacgccguauccuaugccacagacgauggccagaacuugucaggcaaguucaaagcugacaagcccggacgcuacuacauccaccuguacauguucaauggcuccuacaugccauaccgaauaaacaucgaaggaucggucggacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3347 - RNA, 958 nt, Artificial Sequence
  mRNA product Design2 comprising derived and/or modified sequence from Homo sapiens__NP_001133.1__HsAMELX (opt8)
ggggcgcugccuacggagguggcagccaucuccuucucggcaucaagcuuaccaugggcaccuggauccuauucgcaugccuccucggagccgccuucgccaugccccuccccccccaccccggccaccccggcuacaucaacuucucuuacgaaguccucaccccccuaaaaugguaccaaucaauucgcccccccuauccauccuacggcuacgaacccaugggcggcuggcuacaccaccaaauaauacccguccucucccaacaacacccccccacccacacccuccaaccccaccaccacauccccgucguccccgcacaacaacccgucaucccccaacaaccaaugaugccagucccaggccaacacucuaugacccccauccaacaccaccaacccaaccuccccccccccgcacaacaaccauaccaaccccaacccguccaaccacaaccccaccaacccaugcaaccccaaccccccguccaccccaugcaaccccucccaccccaaccaccccucccccccauguuccccaugcaaccccucccccccaugcuacccgaccuaacccucgaagccuggcccuccacagacaaaacaaaacgagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3348 - RNA, 517 nt, Artificial Sequence
  mRNA product Design2 comprising derived and/or modified sequence from Homo sapiens__NP_001133.1__HsAMELX-TRAP (opt8)
ggggcgcugccuacggagguggcagccaucuccuucucggcaucaagcuuaccaugccccucccaccccaccccggccaccccggauacauaaacuucuccuacgaaguccuaacaccccuaaaaugguaccaauccauacgcccacccuaccccuccuacggcuacgaacccaugggcggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3349 - RNA, 550 nt, Artificial Sequence
  mRNA product Design2 comprising derived and/or modified sequence from Homo sapiens__NP_001133.1__HsAMELX-LRAP (opt8)
ggggcgcugccuacggagguggcagccaucuccuucucggcaucaagcuuaccaugccccucccaccccaccccggccaccccggcuacauaaacuucuccuacgaaguccucacaccacucaaaugguaccaauccauccgcccaccacccaugcuccccgaccucacccucgaagccuggcccuccaccgacaaaacaaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3350 - RNA, 589 nt, Artificial Sequence
  mRNA product Design2 comprising derived and/or modified sequence from Homo sapiens__NP_001133.1__HLA-A2-SP_HsAMELX(17-60) (opt8)
ggggcgcugccuacggagguggcagccaucuccuucucggcaucaagcuuaccauggccgucauggcaccccgaacccuaguccuacuccuauccggcgcccuagcccucacccaaaccugggccaugccacuaccaccccacccaggccaccccggcuacaucaacuucuccuacgaaguacucacaccacuaaaaugguaccaauccauccgaccacccuaccccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3351 - RNA, 622 nt, Artificial Sequence
  mRNA product Design2 comprising derived and/or modified sequence from Homo sapiens__NP_001133.1__HLA-A2-SP_HsAMELX(17-47,168-191) (opt8)
ggggcgcugccuacggagguggcagccaucuccuucucggcaucaagcuuaccauggccguaauggcaccccgaacacucguacuccuccucuccggagcacuagcccucacccaaaccugggccaugccccuccccccacaccccggccaccccggcuacauaaauuucuccuacgaaguccucaccccccucaaaugguaccaauccauccgccccccccccaugcuccccgaccuaacacucgaagccuggcccucaaccgacaaaacaaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3352 - RNA, 961 nt, Artificial Sequence
  mRNA product Design2 comprising derived and/or modified sequence from Homo sapiens__NP_001134.1__HsAMELY (opt8)
ggggcgcugccuacggagguggcagccaucuccuucucggcaucaagcuuaccaugggcaccuggauccuauucgcaugccuagucggcgccgccuucgccaugccccucccaccccaccccggccaccccggcuacaucaacuucuccuacgaaguacucaccccacucaaaugguaccaauccaugauacgcccacccuacuccuccuacggauacgaacccaugggcggcuggcuccaccaccaaauaauccccgucguuucccaacaacacccccucacccacacccuccaaucacaccaccacauccccguaguccccgcccaacaaccccgaguccgccagcaagcccucaugcccguaccaggccaacaaucaaugacccccacccaacaccaccaacccaaccucccccuccccgcccaacaacccuuccaaccccaacccguccaaccccaaccacaccaaccaaugcaaccccaaccacccguccaacccaugcaaccccuucucccccaaccuccccuaccacccauguucccccuccguccucucccacccauccuccccgaccuccaccucgaagccuggcccgccaccgacaaaaccaaacaagaagaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3353 - RNA, 520 nt, Artificial Sequence
  mRNA product Design2 comprising derived and/or modified sequence from Homo sapiens__NP_001134.1__HsAMELY-TRAP (opt8)
ggggcgcugccuacggagguggcagccaucuccuucucggcaucaagcuuaccaugccccuaccaccccaccccggccaccccggcuacauaaacuucuccuacgaaguccucaccccacucaaaugguaccaaucaaugauacgaccacccuacuccucauacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3354 - RNA, 553 nt, Artificial Sequence
  mRNA product Design2 comprising derived and/or modified sequence from Homo sapiens__NP_001134.1__HsAMELY-LRAP (opt8)
ggggcgcugccuacggagguggcagccaucuccuucucggcaucaagcuuaccaugccccuccccccacaccccggccaccccggcuacauaaacuucuccuacgaaguccuaacaccacucaaaugguaccaauccaugauccgccccccccccauacuccccgaccuccaccucgaagccuggcccgccacagacaaaaccaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3355 - RNA, 592 nt, Artificial Sequence
  mRNA product Design2 comprising derived and/or modified sequence from Homo sapiens__NP_001134.1__HLA-A2-SP_HsAMELY(17-61) (opt8)
ggggcgcugccuacggagguggcagccaucuccuucucggcaucaagcuuaccauggccgucauggccccacgcacacucguccuccuacucucaggagcccucgcacucacacaaaccugggccaugccacucccaccacaccccggccaccccggcuacaucaacuucucauacgaaguccucaccccacucaaaugguaccaaucaaugauacgcccacccuacuccuccuacggcuacgaacccaugggcggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3356 - RNA, 625 nt, Artificial Sequence
  mRNA product Design2 comprising derived and/or modified sequence from Homo sapiens__NP_001134.1__HLA-A2-SP_HsAMELY(17-48,169-192) (opt8)
ggggcgcugccuacggagguggcagccaucuccuucucggcaucaagcuuaccauggcagucauggcaccccgcacccucguccuacuacucuccggcgcccucgcccucacccaaacaugggccaugccacucccaccccaccccggacaccccggcuacaucaacuucucauacgaaguccucaccccacucaaaugguaccaauccaugauccgacccccacccauccuacccgaccuccaccucgaagccuggcccgccaccgacaaaaccaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3357 - RNA, 952 nt, Artificial Sequence
  mRNA product Design2 comprising derived and/or modified sequence from Sus scrofa__NP_999071.1__SsAMELX-001-1 (opt8)
ggggcgcugccuacggagguggcagccaucuccuucucggcaucaagcuuaccaugggcaccuggauccucuucgcaugccuccucggcgccgccuucuccaugccucuaccaccccaccccggccaccccggcuacauuaacuucuccuacgaaguccuaacuccccuaaaaugguaccaaaacaugauccgacaccccuacaccuccuacggauacgaacccaugggcggauggcuccaccaccaaaucauccccgucgucucccaacaaacaccccaaucccacgcccuacaaccccaccaccacauccccaugguacccgcccaacaacccgguauaccccaacaacccaugaugccccuccccggccaacacucaaugacccccacccaacaccaccaacccaaccuaccccuacccgcacaacaacccuuccaaccccaaccaguccaaccccaaccccaccaaccacuccaaccccaaucccccaugcaccccauccaaccccuccucccacaaccaccccucccacccauguucuccaugcaaucacuccuccccgaccucccccucgaagccuggcccgcaaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3358 - RNA, 520 nt, Artificial Sequence
  mRNA product Design2 comprising derived and/or modified sequence from Sus scrofa__NP_999071.1__SsAMELX-TRAP (opt8)
ggggcgcugccuacggagguggcagccaucuccuucucggcaucaagcuuaccaugccccuaccaccccacccaggccaccccggcuacaucaacuucuccuacgaaguccucacaccacucaaaugguaccaaaacaugaucagacacccauacaccucauacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3359 - RNA, 553 nt, Artificial Sequence
  mRNA product Design2 comprising derived and/or modified sequence from Sus scrofa__NP_999071.1__SsAMELX-LRAP (opt8)
ggggcgcugccuacggagguggcagccaucuccuucucggcaucaagcuuaccaugccacuacccccacaccccggccaccccggcuacauaaacuucucauacgaaguacucaccccacucaaaugguaccaaaacaugauccgacaccccucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3360 - RNA, 592 nt, Artificial Sequence
  mRNA product Design2 comprising derived and/or modified sequence from Sus scrofa__NP_999071.1__HLA-A2-SP_SsAMEL(17-61) (opt8)
ggggcgcugccuacggagguggcagccaucuccuucucggcaucaagcuuaccauggcagucauggcaccccgcacacucguccuccuacuaucaggagcccucgcacucacacaaacaugggccaugccccuaccaccccaccccggacaccccggcuacauaaacuucuccuacgaaguccuaacaccccuaaaaugguaccaaaacaugauccgacaccccuacaccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3361 - RNA, 625 nt, Artificial Sequence
  mRNA product Design2 comprising derived and/or modified sequence from Sus scrofa__NP_999071.1__HLA-A2-SP_SsAMEL(17-49,167-189) (opt8)
ggggcgcugccuacggagguggcagccaucuccuucucggcaucaagcuuaccauggccgucauggccccacgcacccuaguccuccuccuauccggcgcacucgcacucacacaaaccugggccaugccccucccaccacaccccggccaccccggcuacaucaacuucuccuacgaaguccucacaccccucaaaugguaccaaaacaugauccgccacccaucacuccucccagaccucccacucgaagccuggcccgccaccgacaaaaccaaacgcgaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3362 - RNA, 916 nt, Artificial Sequence
  mRNA product Design2 comprising derived and/or modified sequence from Sus scrofa__P45561-2__SsAMELX-001-2 (opt8)
ggggcgcugccuacggagguggcagccaucuccuucucggcaucaagcuuaccaugggcaccuggauacucuucgcaugccuccucggcgccgccuucuccaugccccucccaccccaccccggccaccccggcuacaucaacuucuccuacauccgccacccauacaccuccuacggcuacgaacccaugggcggcuggcuacaccaccaaaucauccccgucgucucccaacaaacaccccaaucccacgcccuacaaccccaccaccacaucccaaugguccccgcccaacaaccaggcaucccacaacaacccaugaugccccuacccggccaacacucaaugaccccaacucaacaccaccaacccaaccuaccccuacccgcccaacaacccuuccaaccccaacccguccaaccccaaccccaccaaccccuccaaccccaaucccccaugcaccccauccaaccccuccuaccccaaccaccccucccacccauguucucaaugcaaucccuacuccccgaccuaccccucgaagcauggcccgcuacagacaaaacaaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3363 - RNA, 952 nt, Artificial Sequence
  mRNA product Design2 comprising derived and/or modified sequence from Sus scrofa__NP_998965.1__SsAMELX-001-3 (opt8)
ggggcgcugccuacggagguggcagccaucuccuucucggcaucaagcuuaccaugggaaccuggaucuucuucgccugccuccucggcgccucccucgcaaugccccucccaccccaccccggccaccccggcuacaucaacuucuccuaugaaguacucacaccccucaaaugguaucaaaacaugauccgccaccccuacacauccuacggcuacgaacccaugggcggcuggcuacaccaccaaaucauacccgucgucucacaacaaacaccccaaucacacgcccuccaaccccaccaccacauccccaugguccccgcccaacaacccggcaucccccaacaacccaugaugccccuaccaggacaacacuccaugaccccaacccaacaucaccaaccuaaucucccccuccccgcccaacaacccuuccaaccccaacccguccaaccccaaccccaccaaccccuccaaccccaaucccccaugcacccuauccaaccccuccucccccaaccaccccucccacccauguucuccaugcaaucacuccuacccgaccucccccucgaagccuggccugccaccgacaaaacaaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3364 - RNA, 601 nt, Artificial Sequence
  mRNA product Design2 comprising derived and/or modified sequence from Sus scrofa__K7GPB2__SsAMELX-002 (opt8)
ggggcgcugccuacggagguggcagccaucuccuucucggcaucaagcuuaccaugggcaccuggauacucuucgccugccuccucggcgccgcauucucaaugccccucccaccacacccaggccaccccggauacaucaacuucuccuacgaaguacucaccccacucaaaugguaccaaaacaugauccgacaccccucacuccuccccgaccucccccuagaagccuggccagccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3365 - RNA, 994 nt, Artificial Sequence
  mRNA product Design2 comprising derived and/or modified sequence from Sus scrofa__K7GLD0__SsAMELX-003 (opt8)
ggggcgcugccuacggagguggcagccaucuccuucucggcaucaagcuuaccaugggcaccuggauccucuucgccugccuccuaggcgcugccuucuccaugccacucccaccccaccccggccaccccggcuacaucaacuucuccuacgaagaccuauaccucgaagccauacgcaucgaccgcaccgcauuuguccuaaccccacucaaaugguaccaaaacaugauccgacacccauacaccuccuacggcuaugaacccaugggaggcuggcuacaccaccaaaucaucccagucgucucacaacaaaccccucaaucucacgcccuccaaccacaccaccacauccccaugguccccgcccaacaacccggcaucccccaacaacccaugaugccccuccccggccaacacuccaugacccccacccaacaccaccaacccaaccucccccuccccgcacaacaacccuuccaaccccaaccaguccaaccccaaccacaccaaccccuucaaccccaaucccccaugcaccccauccaaccccuccuaccacaaccacccuuaccucccauguuuucuaugcaaucccuccuccccgaccucccccucgaagccuggcccgccaccgacaaaacaaaacgcgaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3366 - RNA, 880 nt, Artificial Sequence
  mRNA product Design2 comprising derived and/or modified sequence from Sus scrofa__K7GPE9__SsAMELX-004 (opt8)
ggggcgcugccuacggagguggcagccaucuccuucucggcaucaagcuuaccaugggaaccuggauccuauucgccugccuccuaggagccgccuucucaaugccccuaccaccccaccccggccaccccggcuacaucaacuuuuccuacgaaguccucaccccacucaaaugguaccaaaacaugauacgccaccccacaccccaaucccacgcccuacaaccccaccaccacauccccaugguccccgcccaacaacccggcaucccccaacaacccaugaugccccuccccggccaacacuccaugacccccacccaacaccaccaacccaaccucccccuccccgcccaacaacccuuucaaccccaacccguccaaccccaaccacaccaaccacuccaaccccaaucccccaugcacccaauccaaccccuccucccccaaccaccccucccacccauguucucaaugcaaucacuacuccccgaccucccccucgaagccuggcccgccaccgacaaaaccaaaagagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3367 - RNA, 904 nt, Artificial Sequence
  mRNA product Design2 comprising derived and/or modified sequence from Sus scrofa__J9JIM4__SsAMELX-201 (opt8)
ggggcgcugccuacggagguggcagccaucuccuucucggcaucaagcuuaccaugccucucccaccccaccccggccaccccggcuacaucaacuucuccuacgaaguccucacaccccucaaaugguaccaaaacaugauccgccaccccuacaccucauacggcuacgaacccaugggcggcuggcuccaccaccaaaucauccccgucgucucccaacaaacaccccaaucacacgcacuccaaccccaccaccacauccccaugguccccgcccaacaacccggcaucccccaacaacccaugaugccacuccccggccaacacucaaugacccccacccaacaccaccaacccaaccucccacuccccgcacaacaacccuuccaaccacaacccguacaaccccaaccccaccaaccacuccaaccccaaucccccaugcaccccauccaaccccuacucccccaaccaccccuacccccaauguucucaaugcaaucccuccuccccgaccucccccucgaagcauggccagccacagacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3368 - RNA, 3343 nt, Artificial Sequence
  mRNA product Design2 comprising derived and/or modified sequence from Homo sapiens__NP_006120.1__HsBMP1 (opt8)
ggggcgcugccuacggagguggcagccaucuccuucucggcaucaagcuuaccaugccaggcguugcaagacuaccacuacucuuaggacuacuacuacuaccgcgaccaggacgaccccucgaccuagcagacuacaccuaugaccucgccgaagaagaugauagcgaaccgcuaaauuacaaagacccguguaaagcagcagcuuuucuaggcgacauagcccuggacgaggaagaccuucgggcguuccaaguacaacaggcaguagauuuacgccgacacacggcucgaaaaucaucaaucaaagcagccguuccaggaaacacgucaaccccaagcugucagucaacaaaugggcaaccccaacgcggagcgugcggacgauggcgaggccgcagcaggucccgcagagcagccaccucccgccccgaaagagucuggcccgauggaguaauaccguucguaauaggcggcaauuucaccggaucccagcgcgcggucuuccgccaagccaugagacacugggagaaacauaccugcgugacauuccucgaaagaacagacgaagacucauacauaguauucaccuaccgaccgugcggcugcugcagcuacguaggccgcagaggcggcgggccacaagcgaucagcaucggcaaaaacugcgacaaauucggaauagucguccacgaacucggccacguaguaggcuucuggcacgagcacacccgaccugaccgagaccgacacgucagcaucguaagagaaaacauacaaccagggcaagaauacaacuuccugaaaauggagccccaagaaguggaauccuuaggagaaaccuacgacuuugacucaaucaugcacuacgcaaggaacacauucucacgaggaauauuccucgacacaauaguucccaaguacgaagugaacgggguuaaaccuccgauuggccaaaggacaagacuaucaaagggcgacaucgcacaggcacgaaaacuguacaaaugccccgcaugcggggagacacuacaagacagcaccgggaacuucucaaguccggaauacccaaacggauacagugcucacaugcacugcguauggcggauaagcgucaccccgggcgagaaaauaauacuaaacuucacaagucuggaccuauaccggagccgccuuugcugguacgauuacguagaaguccgcgacggauucuggcgcaaagcgccacugaggggacgcuucugcggaucaaaacucccggaaccgauaguaucaaccgacucacgccucugggucgaguucagaagcagcucaaacugggucggaaaaggauucuuugcaguguacgaagcuaucugcggaggagacguaaagaaagacuaugggcacauacaaagccccaacuaccccgacgacuaccgcccuagcaaaguuugcaucuggcgcauacaagucagcgaaggcuuccacgucggccugacauuccagaguuucgaaauagaacgccaugacagcugcgccuacgauuaccucgaaguccgcgacggccacucggaaagcagcaccuuaaucggcagguacugcgguuacgaaaaaccagacgacauaaagagcaccucgagccgacucuggcuaaaauucguaagcgacggcagcauaaacaaagcgggcuuugcaguuaacuucuucaaagaaguggacgaaugcuccaggccaaaccgaggcgggugcgaacaaagaugucuaaauacacucggcagcuacaaaugcagcugcgacccgggauacgaacucgcccccgacaaaagaaggugcgaagccgccugcggaggguuccucacaaaacuaaacgggagcaucacuucaccgggauggccaaaagaauacccaccaaauaagaacugcaucuggcaacucgucgcacccacccaauaccgcaucagccuacaauucgacuucuucgaaaccgaaggcaacgacgucugcaaauacgacuucguugaaguccgcuccggacuaacagcagacagcaaacuacacgguaaauucugcggcuccgaaaagccagaagucauaacaagccaauacaacaauaugagagucgaguucaagagcgacaacaccgucagcaaaaagggauuuaaggcacacuucuucucagacaaagacgaaugcucaaaagacaacggcggcugccaacaagacugcguuaacacauucggcucauacgaaugccaaugcagaucagguuucgugcugcacgacaacaaacacgacugcaaagaagccggcugcgaccauaaaguuaccagcaccaguggaaccauaacaagccccaacuggccagacaaauacccaucgaagaaagaaugcacgugggcuaucuccagcacacccgggcaccgggucaaacucaccuucauggaaauggauaucgaaagccaaccggaaugcgcauacgaccaucuagaagucuuugacggccgagacgccaaagccccaguacucggcagauucugcggauccaagaaaccagaaccaguacucgcgaccgggagccgaauguuccuccgcuucuacagcgacaacuccgugcaacgcaaaggcuuccaagccucccaugcgacggaaugcggcggacaaguucgcgcggacgucaaaaccaaagacuuauacagccaugcacaguucggugacaacaauuaccccggaggcguagacugcgaaugggucauaguagccgaagaaggauacggcgucgagcucguauuccagacauucgaaguagaagaagaaaccgacugcggcuacgauuacauggaacuuuucgacggguacgacagcacagcgccacgccucggacgcuacugcggaucaggcccgccagaagaaguauacagcgcaggcgacuccguccuagucaaauuccauucugaugacaccaucacaaagaaaggcuuccacuugagauacacaaguacaaaauuccaagacaccuuacauucaagaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3369 - RNA, 1573 nt, Artificial Sequence
  mRNA product Design2 comprising derived and/or modified sequence from Homo sapiens__NP_001191.1__HsBMP2 (opt8)
ggggcgcugccuacggagguggcagccaucuccuucucggcaucaagcuuaccauggucgccggaacucgcugccuccuagcccuccuacucccccaaguacuacucggcggcgccgccggccucguucccgaacucggacgacgaaaauucgccgccgcauccucuggaaggcccagcucccaacccuccgacgaaguucucuccgaguucgaacuccgccuccucucaauguucggccucaaacaacgccccacaccaucacgcgacgcagucgucccgcccuacaugcucgaccuauaccgucgucacucaggccaacccggaucccccgcccccgaccaccgucucgaacgcgcagccucgcgcgccaacacaguccgcuccuuccaccacgaagaaucccucgaagaacuacccgaaaccuccggcaaaacaacccgacgcuucuucuucaaccucagcuccauccccacagaagaguucauaaccuccgccgaacuacaaguauuccgcgaacagaugcaagacgcccucggaaacaacagcucauuccaccacagaaucaacauuuacgaaauaaucaaacccgccaccgcgaacagcaaauuucccgucacccgucuccucgacacccgccucgucaaccaaaacgccucccgcugggaaucuuuugacguaacacccgcagucaugcgcuggacagcacaaggccacgccaaccacggauucgucguagaaguagcccaccuagaagaaaagcaaggaguauccaaacgucacguacgaauaucacgcucccuacaccaagacgaacacuccuggucccaaauccgaccccuacucgucaccuucggccacgacggaaaaggacacccccuucacaaaagggaaaaacgccaagccaaacacaaacaacgcaaacgacucaaauccucaugcaaaagacacccccucuacguugauuucucagacgucggcuggaacgacuggaucguagccccacccggcuaccacgccuucuacugccacggcgaaugccccuucccccucgcagaccaccuuaauucaaccaaccacgcaaucguccaaacccucgucaacuccgucaacucaaaaauccccaaagccugcugcguccccaccgaacuaucagccaucuccauguuauaccuagacgaaaacgaaaaagugguccucaaaaacuaccaagacauggucgucgaagguugcggcugccgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3370 - RNA, 1609 nt, Artificial Sequence
  mRNA product Design2 comprising derived and/or modified sequence from Homo sapiens__NP_001193.2__HsBMP4 (opt8)
ggggcgcugccuacggagguggcagccaucuccuucucggcaucaagcuuaccaugauacccggcaaccgcaugcucauggucguccuccucugccaaguacuccucggaggagccucacacgccucacucauaccagaaacuggcaaaaaaaaagucgcugaaauccaagggcacgccggcggccgccgcuccggccaaucccacgaacuucuuagagacuucgaagccacccuacuccaaauguucggacuccgccgccgcccccaacccuccaaaucugcaguuauacccgacuacaugcgcgaccuauaccgucuacaaucaggcgaagaagaagaagaacaaauccauaguaccggccucgaauaccccgaacgccccgccucccgcgcaaauacaguccgcucauuccaucacgaagaacaccucgagaacauccccggaacguccgaaaacuccgccuuccgauuccucuucaaccuaucauccauccccgaaaacgaagucaucuccuccgccgaacuccgccuuuuccgcgaacaagucgaccaaggccccgacugggaacgcggcuuccaccgcauaaacaucuacgaaguaaugaaaccacccgccgaggucguccccggacaccuuaucacacgccuccucgacacccgacuaguccaccacaacgucacccgaugggaaaccuucgacguaucccccgcaguccuccgcuggacccgcgaaaaacaacccaacuacggacucgccauagaaguuacacaccuccaccaaacccgaacacaccaaggccaacacguccgaaucucccgcucccucccacaaggcuccggcaacugggcccaacuccgcccccuccucguaaccuucggacacgacggacgcggacacgcccucacccgacgccgccgagccaaacgcucccccaaacaccacucacaaagagccaggaaaaaaaauaaaaauugccgccgccacucacucuacguagacuucagcgacgucggcuggaacgacuggauagucgccccccccggcuaccaagcauucuacugccauggcgacugccccuucccacucgccgaucaccuaaacagcaccaaccacgccauaguccaaacccuaguaaacuccgucaacuccagcauacccaaggcaugcugcguacccacagaacugagcgcaaucuccauguuauaccucgacgaauacgacaaaguaguacucaaaaacuaccaagaaaugguaguagaaggaugcggcugccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3371 - RNA, 1924 nt, Artificial Sequence
  mRNA product Design2 comprising derived and/or modified sequence from Homo sapiens__NP_001709.1__HsBMP6 (opt8)
ggggcgcugccuacggagguggcagccaucuccuucucggcaucaagcuuaccaugcccggauuaggucgccgagcacaguggcucugcuggugguggggacuccucuguagcugcugcggaccccccccccuacgcccaccucuccccgccgcugccgccgccgccgccggcggccaacuacucggagacggcggaucacccggccgaacugaacaaccaccccccucaccccaauccucaagcggguuccucuaccgucgccugaaaacccaagaaaaacgcgaaaugcaaaaagaaauccuauccguccucggccucccccaccgcccccgcccccuacacggacugcaacaaccccagccaccagcccuacgucaacaagaagaacagcagcaacaacaacaauuaccaagaggagaaccacccccuggccgacugaaauccgccccacuauucaugcucgaccuauacaacgcacucagcgcagacaaugacgaagacggcgcaucagaaggagaaagacaacaaucauggccacacgaagcagccucaagcucccaacgaagacaaccaccacccggagcagcgcacccccuaaaccgcaaaucccuacuggcccccggauccggcagcggcggcgccuccccacuaaccagcgcccaagacucugcauuccuuaacgacgcagacauggucaugucauucguuaaccuggucgaauacgacaaagaauucucgccccgacaacgacaucacaaggaauucaaauucaaccucagccagauacccgaaggcgaaguagucaccgccgccgaguuccgcaucuauaaagacugcgucaugggaucauucaaaaaccaaacauuccuaaucuccaucuaccaaguacuccaagaacaccagcaccgcgacagcgaccucuuccuauuagacacccgcguagucugggccucagaagaaggcuggcucgaauucgacauaacugccaccucaaaucuuugggucgucacaccacaacacaacaugggccuccaacucuccguagucacccgugacggaguccacguacacccccgagcugccggccucgucggacgagacggccccuacgacaaacaacccuucauggucgcauucuucaaagucuccgaaguccacguccgaaccacccgcucagccuccucccgucgcaggcaacaaucccgaaaccgauccacacaaucccaagauguagccagaguauccuccgccuccgacuauaacuccuccgaacucaaaacagcaugccgcaaacacgaacucuauguauccuuccaagaccuuggauggcaagacuggaucaucgccccaaaaggauacgccgccaacuacugcgacggcgaauguucauucccucuaaacgcccacaugaacgcaaccaaccacgccaucguacaaacacuuguccaccucaugaaucccgaguacguccccaaacccugcugcgcacccaccaaacucaacgccauaucagucuuauacuucgacgacaacucaaacguaauccugaaaaaauaccgcaacauggucguucgcgcaugcggcugccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3372 - RNA, 1678 nt, Artificial Sequence
  mRNA product Design2 comprising derived and/or modified sequence from Homo sapiens__NP_001710.1__HsBMP7 (opt8)
ggggcgcugccuacggagguggcagccaucuccuucucggcaucaagcuuaccaugcacguccguucccugagagccgccgccccccacucguuugucgcccuaugggcaccccuauuccuccuucgaucagcacuugcagacuucucccuugacaacgaaguccacucguccuucauccaccgccgccucagaucacaagaacgacgagaaaugcaacgcgaaauacuuagcauccuaggccucccccaccguccccgaccacaucuccaaggcaaacacaacucagccccaauguucaugcucgaccucuacaacgccauggccgucgaagagggcggcggacccggcggucaaggcuucuccuacccauacaaagccgucuucagcacucaaggaccaccccucgcuucccuucaagacucccacuuccuaaccgacgcagauauggucauguccuucgucaaccuagucgagcacgacaaagaauucuuccacccccgcuaccaccaccgagaauuccgcuucgaccucuccaaaauacccgaaggcgaggccgucacagcugccgaauuccgcaucuacaaagacuacauccgcgaacgcuucgacaacgaaaccuucaggaucucagucuaucaaguccuacaagaacaucucggccgcgaauccgacuuauuccuccuagacucacgcacccucugggccucagaagaaggauggcucguauucgacaucacagccacaucaaaccacugggucgucaacccccgccacaaccucggccugcagcuaucaguagaaacccucgacggacaauccaucaaccccaaacucgccggucucaucggccgacacggcccacaaaacaaacagcccuucauggucgccuucuucaaagccaccgaaguccacuuccgaagcauccgcuccaccggauccaaacaacgcucccagaaucguuccaaaaccccgaaaaaccaagaggcccuacgcauggccaacgucgcagaaaacuccucaucagaccaacgccaagccugcaaaaaacacgaacuauacgucuccuuccgcgaccucggauggcaagacuggaucaucgcaccagaaggcuacgccgccuacuacugugaaggagaaugcgccuuuccucucaacuccuacaugaacgccaccaaccacgcaauuguacaaacccuaguucacuucaucaacccagaaacagucccaaaacccugcugugcccccacacaacuaaacgcaauauccguccucuacuucgacgauuccucgaacguuauccucaaaaaauaccgcaacaugguaguccgagccugcggaugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3373 - RNA, 682 nt, Artificial Sequence
  mRNA product Design2 comprising derived and/or modified sequence from Homo sapiens__NP_006264.2__HsCCL7 (opt8)
ggggcgcugccuacggagguggcagccaucuccuucucggcaucaagcuuaccaugaaagccucagccgcccuccucugccuccuccucacagcagccgccuucuccccccaaggccucgcccaaccagucggcaucaacaccuccacaaccugcugcuaccgcuucauaaacaaaaaaauacccaaacaacgccuagaauccuaccgcagaaccacauccucacacugcccccgcgaagccgucaucuucaaaaccaaacuagacaaagaaaucugcgccgaccccacccaaaaauggguccaagacuucaugaaacaccuagacaaaaaaacacaaacccccaaacucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3374 - RNA, 4006 nt, Artificial Sequence
  mRNA product Design2 comprising derived and/or modified sequence from Homo sapiens__NP_001954.2__HsEGF (opt8)
ggggcgcugccuacggagguggcagccaucuccuucucggcaucaagcuuaccaugcuguuaacgcuaaucauccuacuaccagucguaagcaaguucucuuuugucucccugagcgcgccccagcauugguccugcccagaaggcacccucgcaggcaauggaaacagcacaugcguaggcccggcuccauuccuaaucuucagccauggcaacagcaucuuuagaaucgacaccgagggcaccaacuacgaacaacucgugguagaugccggagugagcguaauaauggacuuccacuacaacgaaaaacgcauauauugggucgaccuagaacggcagcuccuccaaaggguauuucucaacggaucccgacaggagcgggugugcaauaucgagaaaaacgucuccggaauggcaaucaacuggaucaacgaagaagucaucuggagcaaucagcaggaaggaaucauaacagucacugauaugaagggcaauaacucccacauacuacucucagcacuaaaauaccccgccaacguagcaguagauccuguggaacgcuucaucuucuggagcucagagguagccgguagccucuacagagcggaucuugacggagugggugugaaagcacuuuuagaaacaagcgagaaaauaaccgcaguaucccuugacgugcucgacaaacgacuauuuuggauucaguacaaucgggaaggcucgaacucccuaauaugcucgugcgauuacgacggcggaagcguacacauaagcaagcaccccacgcagcacaaccucuuugcaaugucccuguucggugaccgaaucuucuacuccaccuggaaaaugaagaccauauggaucgcgaacaaacauacagggaaagauauggucagaaucaaccuacacagcuccuucgucccccuaggagaacuaaaggucguacauccacucgcccaacccaaagcggaagacgacaccugggaaccggaacaaaaauugugcaaauuaagaaaggguaauugcuccagcacugucugcgggcaagaccuccaaucacaccucugcaugugcgcggaaggguaugcccugagccgggaccgcaaauauugcgaagacgucaaugaaugcgccuucuggaaccacggauguacgcuugguugcaaaaacacacccgggagcuacuacuguaccugccccguaggcuucguccuacugccggacggcaagcggugucaucagcuagucaguugcccacgcaacguuucagaaugcagccacgacugcguccuaacauccgagggaccacucuguuucugcccagaaggcucagugcuagaaagagacggaaaaacaugcagcgggugcucaagcccagauaauggcgggugcucgcaacuaugugugccacuauccccugucuccugggaaugcgacugcuuccccggauacgaucuccaacucgacgaaaagucaugcgccgccaguggcccccaacccuuucuucuauucgccaacagccaagacauucgccacaugcacuucgacggaacagacuacggaacccucuuaucucaacagaugggcaugguuuacgccuuagaucacgacccuguggaaaacaaaauauacuucgcccacacagcacuaaaauggaucgaaagagcaaauauggacggcucacaacgagaacgccucauagaagagggcguagacguacccgaaggccuagcgguugacuggauaggcagaagguucuacuggacugaccgaggcaagucucugauagggcgcucggaccugaacggcaaacgcuccaaaaucauaacaaaggagaacaucucccaacccagaggaaucgcaguucacccaauggccaaacgacuguucuggaccgacacuggaaucaacccgcggaucgaaucuuccagucuacaggggcuggggcgucucguuauugcaucgagcgaccugauauggcccagcggcauaacgauagacuuccugacagacaaacuguacuggugcgacgcaaaacaaagcgugaucgaaauggccaaucucgacggaucaaaaagacgcagacucacacagaacgacgugggccacccuuucgcuguagccguauucgaagacuacgucugguucucagacugggccaugcccagcguaaugcgaguuaacaaacgcaccgguaaagacagaguccgucuccaaggcucaaugcuaaagccuaguucccuuguaguaguacauccacuagcuaaacccggugcagacccgugccuauaccagaacgguggaugugaacacauuugcaaaaagcgauugggaaccgccuggugcagcuguagagaaggauucaugaaagcgagugacggaaaaacaugccucgcacucgacggccaccagcuccuagccggaggggaaguagaucucaaaaaccaagugacgcccuuagacauacuaagcaaaaccagaguaucggaggacaacaucacggagagccaacacaugcuuguagcugaaaucaugguaagcgaccaagacgauugcgcgccagucggaugcagcauguacgcacggugcaucuccgaaggugaagaugcuaccugccagugccuaaaaggauuugcgggagacggcaaacuauguagcgauaucgacgaaugcgaaaugggagucccugucuguccgccagcaagcuccaaaugcaucaacaccgagggagguuacguaugccgaugcuccgagggauaucaaggagacggcauacacugccucgacauagacgaaugccaacugggagagcacuccugcggcgaaaacgcaagcuguaccaacacagagggcggcuacacaugcaugugcgccggccgccuaucugaacccggacucaucugccccgacucgaccccuccuccgcaccuacgugaggacgaccaccauuacagcgugcgaaauuccgacucggagugcccccuaucccacgacggauacugccuucaugacggcgucugcauguauaucgaagcccuagacaaauacgcguguaauugcguugucggcuacaucggggaacgaugccaguaccgcgaccuaaaauggugggaacuaaggcacgccgggcauggccagcagcagaaagucauagucguggcagucugcguaguggugcucgucaugcuacuccuacuaucacucuggggagcgcacuacuaccgcacccaaaaacuucuaagcaaaaaucccaaaaacccauacgaggaaucaagccgggauguucgaucgaggcgaccagcggacacagaagauggcaugagcucgugcccgcagcccugguucguggugaucaaggagcaucaagaccugaaaaacgggggacaaccaguagccggugaagacggccaagcagccgacgguagcaugcagccaaccucauggagacaagaaccacaacucugcgguaugggcacagaacagggcugcuggauucccgucucauccgacaagggcagcugcccccaaguaauggagcgauccuuccacaugccaagcuacggaacgcagacccuagaaggcgggguagaaaagccgcauucccugcugucugccaacccccuguggcaacagcgcgcacucgacccaccucaccagauggaacucacacaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3375 - RNA, 892 nt, Artificial Sequence
  mRNA product Design2 comprising derived and/or modified sequence from Homo sapiens__NP_001423.1__HsEREG (opt8)
ggggcgcugccuacggagguggcagccaucuccuucucggcaucaagcuuaccaugaccgccggccgacgaauggaaaugcucugcgccggccguguccccgcacuucuccucugccucggauuccaccuacuccaagccguccucuccaccaccgucauccccucaugcauccccggagaauccuccgacaacugcaccgcccuaguacaaacagaagacaacccccgcgucgcacaaguuuccaucaccaaaugcuccucagacaugaauggcuacugccuccacggacaaugcauauaccuagucgacaugucccaaaacuacugccgcugugaagucggauacacaggcguccgcugcgaacacuucuuccucaccguccaccaaccccuauccaaagaauacgucgcccucaccgucauccucauaauccuauuccucaucacaguugucggcuccaccuacuacuucugccgcugguaccgcaauagaaaauccaaagaaccaaaaaaagaauacgaacgcguaaccucaggcgaccccgaacucccacaagucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3376 - RNA, 850 nt, Artificial Sequence
  mRNA product Design2 comprising derived and/or modified sequence from Homo sapiens__NP_000791.1__HsFGF1 (opt8)
ggggcgcugccuacggagguggcagccaucuccuucucggcaucaagcuuaccauggcagaaggcgaaauaaccacauucaccgcccucaccgaaaaauucaaccuccccccaggcaacuacaaaaaaccaaaacuccuauacugcuccaacggcggacacuuccuccgcauccuccccgacggcacagucgacggaaccagagaccgcucagaccaacacauccaacuccaacucuccgccgaaucagucggagaaguauacaucaaaagcaccgaaaccggacaauaccuagccauggacaccgacggcuuacucuacggcucacaaacccccaacgaagaaugccucuuccucgaacgccucgaagaaaaccacuacaacacauacaucuccaaaaaacacgcagaaaaaaacugguucgucggccucaaaaaaaacggcuccugcaaacgcggcccccgcacccacuacggccaaaaagccauacucuuccucccccuccccgucucaucagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3377 - RNA, 1249 nt, Artificial Sequence
  mRNA product Design2 comprising derived and/or modified sequence from Homo sapiens__NP_001997.5__HsFGF2 (opt8)
ggggcgcugccuacggagguggcagccaucuccuucucggcaucaagcuuaccaugguggggguagggggaggggauguggaggauguaacgccgaggccagggggaugccaaauaaguggaagaggggccaggggauguaacgggaucccgggagcggcagcgugggaggcagcgcugccgagaaggagaccgagaaggcacccgagugugaacccgaggagcagggcggcagggagcccgagaacaagagggagaaggacagaggaaagaccaucggggagcagguugggggaucgagggcgaggaagggcgcugccgggagggagauugggagggagagggagggggagagcgccagagagggugggaggaagggggagaggaagagggacggcggcaccgagggcggcgccggcggcaaggggaagcagaccagggccggcgggaacgauggcggcggggagcauaacgacgcuaccagcauugcccgaagacggaggaucgggcgcauucccgccagggcauuuuaaagauccgaagaggcuguacuguaaaaauggaggguucuuucugagaauacauccggauggacggguagauggagugagagagaagagugacccgcacauaaaguugcaacugcaagcggaagagagaggaguagugagcauaaaagggguaugugccaacagauaucuagcaaugaaggaagauggaaggcuacuggcaagcaaguguguaacggacgagugcuuuuucuucgaaaggcuagagaguaacaacuauaacacguacagaagcaggaaauauacaaguugguauguggcgcuaaagaggacgggacaauacaagcuggggagcaagacagggccggggcaaaaggcaauacuguuuuuaccaaugagugcgaagaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3378 - RNA, 967 nt, Artificial Sequence
  mRNA product Design2 comprising derived and/or modified sequence from Homo sapiens__NP_002000.1__HsFGF7 (opt8)
ggggcgcugccuacggagguggcagccaucuccuucucggcaucaagcuuaccaugcacaaauggauccuaaccuggauccuacccacccuucucuaccgauccugcuuccacaucaucugccuaguaggaaccaucucacucgcaugcaacgacaugacacccgaacaaauggccaccaacgucaacugcuccuccccagaacgccacacacgcagcuacgacuacauggaaggcggagacauccgcguccgccgccucuucugccgaacacaaugguaccuccgcaucgacaaacgcggcaaaguaaaaggcacacaagaaaugaaaaacaacuacaacaucauggaaauacgcacaguagccgucggaaucguagcaaucaaaggcgucgaauccgaauucuaccucgccaugaacaaagaaggcaaacuauacgccaaaaaagaaugcaacgaagacugcaacuucaaagaacucauccuagaaaaccacuacaacacauacgcaucagccaaauggacccacaacggaggcgaaauguucgucgcccucaaccaaaaaggcauccccgucagaggcaaaaaaaccaaaaaagaacaaaaaacagcacacuuccuccccauggccaucaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3379 - RNA, 1009 nt, Artificial Sequence
  mRNA product Design2 comprising derived and/or modified sequence from Homo sapiens__NP_001936.1__HsHBEGF (opt8)
ggggcgcugccuacggagguggcagccaucuccuucucggcaucaagcuuaccaugaaacuacuccccuccgucguccuuaaacucuuccucgccgccguacucuccgcacucgucacaggcgaaucacucgaacgacuccgccgaggccucgccgcaggcaccucaaaccccgaccccccaaccguguccacagaccaacuacuaccacucggcggaggacgcgaccgcaaaguccgcgaccuccaagaagcagaccuagaccuccuccgagucacccucuccuccaaaccccaagcccuagccacccccaacaaagaagaacacggcaagcgaaaaaaaaaaggcaaaggccuaggcaaaaaacgcgacccaugccuacgcaaauacaaagacuucugcauccacggcgaaugcaaauacguaaaagaacuccgagccccaucaugcaucugccaccccggcuaccacggagaacgcugccacggccuaucccuacccgucgaaaaccgccucuacaccuacgaccacacaacaauccucgccgucgucgcagucguccucucauccguaugccuccucgucaucgucggccuacucauguuccgcuaccaccgacgaggcggcuacgacgucgaaaacgaagaaaaagucaaacucggaaugacaaacucccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3380 - RNA, 2569 nt, Artificial Sequence
  mRNA product Design2 comprising derived and/or modified sequence from Homo sapiens__NP_000592.3__HsHGF (opt8)
ggggcgcugccuacggagguggcagccaucuccuucucggcaucaagcuuaccaugugggucaccaagcuacuccccgcucuccugcuacaacacguccugcuccaccuccuacuccuccccauagccauaccauacgccgaaggacaacgcaagcgccguaauacaauacaugaguucaagaaaagcgccaaaaccacccuuaucaaaaucgaccccgcccuaaaaaucaagaccaaaaaggugaacaccgccgaccaaugcgccaacagaugcaccagaaacaagggccuccccuucacaugcaaagccuucguauucgacaaggcccgcaaacaaugccuaugguucccauucaacuccauguccuccggcgucaagaaagaguucggccacgaauuugaccucuacgaaaauaaagacuacauccgaaacugcaucaucggcaaaggacgcucauacaaaggcaccguauccaucaccaaaucaggcauaaaaugccaacccuggagcucaaugaucccccacgaacacucauuucuaccauccuccuaccgaggcaaagaccuccaggaaaauuacugcaggaacccgcgcggggaagaaggcggacccuggugcuuuaccuccaaccccgaaguacgguacgaagucugcgacauaccccaaugcuccgaaguagaaugcaugacaugcaacggagaauccuaucggggccucauggaucacacagaaucagguaaaaucugccagcgcugggaccaccagaccccucaccgccauaaauuccucccagaacgcuacccagacaaaggguucgacgacaacuacugcagaaacccugacggccagccacgcccaugguguuacacacuagacccccacacccgaugggaauacugcgccaucaaaacaugugcagacaauacaaugaaugacaccgacgucccacucgaaaccaccgaaugcauccaagggcagggagaaggauaccgaggcacggucaacaccaucuggaacggcauacccugccaacggugggacagccaauauccgcacgaacacgacaugacuccagaaaacuucaaaugcaaagaccucagagagaacuacugcagaaaucccgacggauccgaaucacccuggugcuucaccacggaccccaacauccgcguaggcuacugcucacaaauaccaaacugcgauaugagccacggucaagacugcuaucgcggcaacggcaaaaacuacaugggaaaccucucacagacccgcucaggccuaacguguagcaugugggacaaaaacauggaggaccuucaucggcacaucuucugggaacccgacgcauccaaacuuaacgagaacuacugccgaaacccagacgacgacgcccacgggccauggugcuacacaggcaacccacucaucccgugggacuauugccccauaagccgcugcgagggcgacacaaccccaacaaucgugaaccuggaccacccugucaucucgugcgcaaaaacaaaacagcuucgggucgucaacggcaucccaacacgaacaaacauaggguggauggucucucuacgcuacagaaacaaacacaucugcggcggcucacucaucaaagaaagcuggguccucacagcucgccaaugcuucccaucaagagaccucaaagauuacgaagccuggcuaggcauacacgacguacauggaaggggagacgaaaaaugcaaacaaguacuuaacguaagccaacucgucuauggcccagaaggaagcgaccucguccucaugaaacuagcacgcccagccguccucgacgacuuuguaagcaccauagaccuccccaacuauggcugcaccaucccagagaaaacgaguugcucagucuacggcuggggauacacgggacugaucaauuacgacggacuacuccgggucgcacaccucuacaucaugggcaacgaaaaaugcucccaacaccaccgcggcaaaguaacucucaacgaaagcgaaaucugcgccggagccgagaaaaucggcucaggcccaugcgaaggcgacuacggcggaccccuuguuugcgaacaacacaaaaugaggaugguacucggcguaauaguucccggcagggggugcgccaucccaaaccgacccggaauauuugucagaguagcauacuacgcgaaauggauucacaaaaucauacuaaccuacaaagucccccagucguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3381 - RNA, 2308 nt, Artificial Sequence
  mRNA product Design2 comprising derived and/or modified sequence from Homo sapiens__NP_005336.3 __HsHSPA1A (opt8)
ggggcgcugccuacggagguggcagccaucuccuucucggcaucaagcuuaccauggccaaagccgccgcaaucggcauagaccucgguacgacguacagcugcguaggcgucuuccaacacggcaagguggaaauaaucgcuaacgaccaaggcaacagaaccacaccgucguacgucgcauucaccgacaccgaacgacucaucggggacgcggccaaaaaccaagucgcacuaaacccccaaaacacaguguucgacgccaaacgacucaucgggagaaaauucggcgaccccguaguccaguccgacaugaaacacuggcccuuccaaguaaucaacgacggagauaaacccaaaguacaagucagcuacaaaggagagaccaaggccuucuacccagaggaaaucucaagcauggugcugacaaaaaugaaagaaaucgcagaagccuaccuaggauacccagucacgaacgccgucaucaccguccccgcauacuucaacgacagccaaagacaggccaccaaagacgccggagucaucgcaggacucaauguccuacgaauaauaaacgagccaaccgcagccgccauagcauacggacucgaccgaacaggcaaaggagaacgcaacguccuaaucuucgaccucgggggcgggaccuucgacgucuccauccuaacaauagaugacggcaucuucgaagugaaagccaccgccggcgacacacaccucgggggagaagacuucgacaaccgccucguaaaccacuucgucgaagaauuuaagcgaaaacacaagaaagacaucagccaaaauaagcgcgcggugcgacgccugagaaccgcaugcgagcgagccaaacgaacgcucucauccucaacccaagcgucacucgaaaucgacucacucuucgagggaaucgacuucuacaccucaaucacgcgagcccgcuucgaagaauuaugcucagaccucuuccgaucaacacuagaacccgucgaaaaagcccucagagaugcaaaacuggacaaagcacaaauccaugaccuuguccuaguaggaggcucaaccaggauccccaaaguacaaaaacugcuccaagacuucuucaaugggcgagaccucaacaaguccauaaaccccgacgaagcagucgcauacggggcagcaguccaagcagcaauauuaaugggcgacaagucggaaaacguccaagaccuccuacuacuagacgucgcgccacuaagucuagggcucgaaaccgcgggaggcgucaugacugcccuaaucaaacgcaacuccaccauccccacaaaacaaacccaaauauucaccacauacuccgacaaccaaccaggaguacugauacaaguauacgaaggcgaacgagccaugaccaaagacaacaaccuacuaggacgcuucgaacucagcggaaucccacccgcccccagaggaguaccccaaauagaagucacauucgacaucgacgcaaacggcauccuaaacguuacagcgaccgacaaauccaccggaaaagcaaacaagauaacgaucacaaacgacaaaggcagacucuccaaagaggagaucgagagaaugguccaagaagcagagaaauacaaagcagaagacgaaguccaacgugaacgcgucagcgccaagaacgcacucgagucguacgccuucaacaugaaaagcgccgucgaggacgaaggacucaaggggaaaaucucagaagccgacaaaaagaaaguacucgacaaaugccaagaaguaaucagcuggcuagaugccaacacacucgccgaaaaagacgaguucgaacacaaacgcaaagaauuagaacaagucuguaaccccaucaucuccggacucuaccaaggcgcaggcggaccaggccccggcggcuuuggcgcacaaggccccaaaggcggcagcgguuccggccccacaauagaagaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3382 - RNA, 2308 nt, Artificial Sequence
  mRNA product Design2 comprising derived and/or modified sequence from Homo sapiens__NP_005337.2 __HsHSPA1B (opt8)
ggggcgcugccuacggagguggcagccaucuccuucucggcaucaagcuuaccauggcaaaagcggcagcaaucggaaucgacuuaggcaccaccuacucgugcgugggagucuuccaacacggcaagguggaaaucaucgcaaacgaccagggcaaccgcaccacccccagcuacguagccuucacagacaccgaacgccugauaggagacgcagcgaaaaaccaggucgcacucaacccacaaaacacagucuuugacgcaaaacggcucauaggaagaaaauucggcgacccggugguccagagcgacaugaaacacuggcccuuccaggugauuaacgacggagacaagccgaaaguccaagucucguacaaaggcgaaaccaaggcauucuacccggaagaaaucuccuccaugguccuaaccaaaaugaaagaaauagccgaagcauaccucggcuaccccgucaccaacgcgguaauaaccguccccgcauacuuuaacgacagucaacgucaggccaccaaagacgcaggggucauagcagggcucaacguccuccgaaucaucaacgaacccaccgcagcagccauagcauacggucucgaccgcacaggcaaaggcgaacgaaacguccuaaucuucgaccuaggugggggcaccuucgacgucucaauccuaacaauagacgacggcauauucgaaguaaaggcaaccgcaggcgacacccaccuaggcggcgaagacuucgauaaccggcucgugaaccacuucgucgaagaguucaaacgcaagcacaagaaagacauaucgcaaaacaaacgagcaguaaggcgacuccgaaccgcgugcgaacgagcaaaaagaacccuaagcucgagcacgcaggccagccucgaaauagacucccucuucgaagggaucgacuucuacacaucaauaacacgagcacgauucgaagaacucugcagcgaucuauuucgcucaacccucgagccggucgaaaaagcccuccgcgacgcgaaacuagacaaagcccagauacacgaccuaguccuaguagggggaucaaccaggauaccaaaaguacaaaaacuacuccaagacuucuucaacgggcgcgaccugaacaaaucuaucaacccagacgaagccgucgcguacggcgccgcuguccaagccgcaauucugaugggagacaaaagugaaaacguacaagaucuccugcuacuagacguagccccacuaucacugggauuagaaaccgcgggcggagucaugaccgcccuaauaaaaagaaacucaacaaucccaacgaaacaaacacaaaucuucaccaccuacagcgacaaccaacccggagugcucauccaaguguacgaaggcgaacgcgcaaugacaaaagacaacaaccuccuaggaagauucgaacuauccggcaucccaccagccccacgcggagucccacagauagaagucacauuugacauagacgcgaacggaauacuaaacguaacagcgaccgacaaaucgacgggcaaggcaaauaaaauaaccaucacgaaugacaaagggcgccuaagcaaggaagagaucgaaagaauggugcaggaagccgaaaaguacaaggccgaggacgaaguccaaagagaacgggucagcgccaaaaacgcacuagaaucguacgccuucaacaugaaauccgcggucgaagacgaaggacucaaaggaaaaauaagcgaagcugacaaaaagaaaguacucgacaaaugccaagaaguaaucuccuggcucgacgcaaacacauuagccgagaaggacgaguucgaacacaaacgaaaagaacuugaacaaguaugcaaccccauuauuucaggccuauaccaaggagcaggagggcccgggcccggaggcuucggcgcgcaaggcccaaaaggaggauccggaagcggaccgacaaucgaagaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3383 - RNA, 2308 nt, Artificial Sequence
  mRNA product Design2 comprising derived and/or modified sequence from Homo sapiens__NP_005518.3 __HsHSPA1L (opt8)
ggggcgcugccuacggagguggcagccaucuccuucucggcaucaagcuuaccauggcaaccgccaagggcaucgccaucgggauagaccucggaacaaccuacucaugcgucggagucuuccaacacggcaaaguggagauaaucgccaacgaccaaggaaaccgaacgacacccucauacguggcguucacagauacagagcgguuaaucggcgacgcagccaaaaaccaagucgccaugaacccacaaaacacggucuuugacgccaaaaggcuaauuggcagaaaauucaacgaccccguaguccaggccgacaugaaacucuggcccuuccaagucauaaacgaaggcggcaaacccaaaguccuagucucauacaaaggcgaaaacaaagcauucuacccggaagaaaucucgagcauggucuuaacaaaauuaaaagaaacggccgaagcauuccuuggacaccccgucacgaacgcaguaaucacaguccccgcauacuucaacgacucccaacgccaggcgacaaaagacgccggggucauagccggccuaaacguucugaggauaaucaacgagccgaccgccgcagccauagcguacggacuugacaaaggaggacaaggcgaacgccacguacucaucuucgaccugggcggcggcaccuuugacgucuccaucuuaaccaucgacgacggcaucuucgaaguaaaagccacggccggagacacacaccuuggcggagaagacuucgacaaccggcucgucagucacuuugucgaagaguucaagcgcaaacacaagaaagauaucucgcaaaacaaaagagcaguccgaagacuccgcaccgccugcgaacgcgccaagagaacacucagcagcucaacacaggcaaaccuggaaaucgacucacucuacgaaggcauagacuucuacaccucaauaacacgagcgcgcuucgaagaacuaugcgccgaccucuucagagggacccuggaaccggucgaaaaagcccuccgagacgccaaaauggacaaagcaaaaauccacgacauaguccuaguaggugggucaacccgaauccccaaagugcaacgacuccuccaagacuacuucaacgggcgcgaccucaauaaaucaaucaaccccgacgaagcaguagcauacggcgcagcaguccaagcagcgauccuaaugggggacaagagcgaaaaaguccaggaucuccuccuccuugacgucgcaccucuaucucuaggacuagaaaccgcaggggguguaaugacagcacucaucaaaagaaacucaacaauacccaccaaacaaacacaaaucuucacaaccuacuccgacaaccaaccaggaguacuaauacaagucuacgaaggggaacgcgccaugaccaaagacaacaaccuccugggccguuucgaccuaaccgguaucccaccagcaccacgcggaguaccgcaaauagaagugacguucgacauagacgcaaacggaauccucaacgucaccgcgaccgacaaaucaaccggcaaagugaacaaaaucaccaucacaaacgacaaagggcgauuaagcaaagaagaaaucgaacgaaugguccucgacgcagaaaaauauaaggccgaagacgaaguccaacgagagaaaauagccgccaaaaacgcauuagaaucauacgccuucaauaugaaaagcguaguaucagacgaaggccuaaaaggcaaaaucagcgagagcgacaaaaacaagauacuagacaaaugcaacgaacuccuaagcuggcucgagguaaaccaacucgcagaaaaggacgaguucgaccacaaaagaaaagaacuagagcaaauguguaacccaaucauaacaaaauuauaccaaggaggcugcacggggcccgccugcggaacaggcuaugucccaggaagacccgccaccggccccacgauagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3384 - RNA, 2302 nt, Artificial Sequence
  mRNA product Design2 comprising derived and/or modified sequence from Homo sapiens__NP_068814.2 __HsHSPA2 (opt8)
ggggcgcugccuacggagguggcagccaucuccuucucggcaucaagcuuaccaugagcgcccggggacccgcaaucggcaucgaccuaggaaccacauacagcugcguaggcguguuccaacacggaaaagucgagauaaucgccaacgaccaaggaaaccgaaccaccccaucauacguagcguucaccgacaccgaaagacucaucggggaugcagcgaagaaccagguggcuaugaaccccacaaacacaaucuucgacgccaaacgccuaauagggagaaaauucgaagacgcaacaguccaaucagacaugaaacacuggcccuucagggucgucucagaaggaggaaaacccaaaguacaagucgaauacaaaggcgaaacaaaaacguucuucccagaagagaucucauccaugguccucacaaagaugaaggaaauagccgaagccuaccuaggcggcaaaguccacagcgcagucauaaccguaccagcauacuucaacgacagccaacggcaagccacaaaagacgcaggaaccaucaccggguuaaacguacuacgaauaauaaacgaacccacagcagcagccaucgcguacggccucgacaagaaaggcugcgccggaggcgagaaaaacguacucaucuucgaccucggcggaggcacauucgacguaucgauacucacaauagaagacggcauauucgaagucaaaucaaccgccggagauacacaccuuggaggggaggacuucgacaacagaauggugagccaccuagcagaggaguucaaacgaaaacacaagaaagacauaggacccaacaaaagggccguacgcagacucagaacagcaugcgaaagagccaaacgaacacuaucauccuccacacaggccagcauagaaauagacucacuauacgaaggagucgacuucuacaccagcaucacacgcgccagauucgaagaacucaacgccgaccuauuccgaggcacccucgagccggucgagaaagcgcuccgagacgcaaaacucgacaaaggacaaauacaagaaauaguccucgucggaggcuccacccgaaucccuaaaauacaaaaacuacuccaagacuucuucaacggaaaagaacuaaacaaaucaaucaaccccgaugaagccguugcauacggcgccgcuguccaagcagcaauccuaauaggagauaaaagcgaaaacguacaagaccuccugcuacuagacgucaccccacucucacucggaaucgagaccgccggcgguguaaugaccccacucauaaaacgaaacaccaccauccccaccaaacaaacacagacguucaccaccuacuccgacaaccaaucauccgugcuagugcaagucuacgaaggcgaaagagccaugaccaaagacaacaaucuccucggcaaauucgaccugacgggcauacccccagccccacgaggcgucccccaaaucgaggucaccuucgacauagacgcgaacggcauccucaacgucacugcugcagacaaaucgacaggaaaggaaaacaaaaucaccaucacaaacgacaaggggcgccucagcaaagacgacaucgaccgaaugguacaagaagcagaacgcuacaagagcgaagacgaagccaacagagaccgcgucgccgccaaaaacgcccucgaauccuacacauacaacauaaaacaaaccgucgaagacgaaaaacuacgcggaaaaauaagcgagcaagacaaaaacaaaauauuagacaaaugccaagaaguaaucaacuggcucgaccgcaaccaaauggccgaaaaagacgaauacgaacacaaacaaaaagaacucgaacgaguaugcaacccgauaaucaguaagcuguaucaaggaggcccaggaggcggaagcggcggcggagguucgggcgcguccggaggcccaacaauagaagaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3385 - RNA, 2905 nt, Artificial Sequence
  mRNA product Design2 comprising derived and/or modified sequence from Homo sapiens__NP_002145.3 __HsHSPA4 (opt8)
ggggcgcugccuacggagguggcagccaucuccuucucggcaucaagcuuaccaugagcgugguaggcauagaccugggcuuccagagcuguuaugucgcaguagcccgcgcaggcggcauagaaacaaucgcaaacgaguacagcgaccgcugcacaccggcaugcaucucguucggacccaaaaaccguagcaucggcgcggcagcgaaaagccaggucauaagcaaugcgaaaaacacaguccagggauucaaacgcuuccacggccgagcauucuccgacccauucgucgaagcagagaaaagcaaccuggcauacgacaucguccaguuaccgaccggccuaaccgggaucaaagucaccuacauggaagaggaacgcaacuucaccacagaacaagucaccgccaugcugcuaagcaaacugaaagagacugcagaguccguacucaagaaaccagugguggacugugucguaagcgugccgugcuucuacacggacgccgaacgacguagcgugauggacgcaacacaaauagcgggacugaacugucuccgccuaaugaaugaaacgacagcaguagcccucgcuuacggaauauacaaacaagaccuacccgcgcucgaagagaaaccccgcaacgucgucuucguggacaugggacacucggccuaccaagucuccgucugcgccuucaaccggggcaaacugaaaguccucgccaccgcauucgacaccacacuuggaggccgaaaauucgacgaaguucucgucaaccacuucugcgaagaguucgggaagaaauacaaacuugacauaaaauccaaaauccgagcacugcuccgacucagucaagaaugcgaaaaacuaaagaagcucauguccgcgaacgccagcgaccucccccuauccaucgaaugcuuuaugaacgacgucgacgucuccggaaccaugaaccgagggaaauuccuagaaaugugcaacgacuuacuagcgagaguagaaccaccccuacgaagcguacuagaacagaccaaauuaaagaaagaagauaucuacgcaguagaaauagugggcggagcaacccgcauacccgccguaaaagagaaaaucucaaaauucuuuggcaaagaacucucgacaacacuaaacgccgacgaagcagugacccgcgggugcgccuugcaaugcgcaauucucagccccgcuuucaaaguaagagaauuuucaauaacagacgucguaccauaccccauaucacuccgcuggaacuccccagcagaagaaggaagcuccgacugcgaagucuucuccaaaaaccacgcagcccccuucucuaaaguccucaccuucuaccggaaagaacccuucacccuagaagccuacuacucgucaccacaggaccuaccauaucccgaccccgcaaucgcgcaauucuccguccaaaaaguaacaccccagagcgacgggagcagcagcaaaguuaaaguaaaaguacguguaaacguacacggaaucuucucagucuccucagccucccucgucgaaguccacaaaagcgaagaaaacgaagaaccaauggaaaccgaccagaaugcaaaagaagaagagaaaaugcaagucgaccaagaagaaccccacgucgaggagcaacaacaacaaacuccagccgaaaacaaggccgaaucagaagaaauggagaccucacaagccgggucaaaagacaagaaaauggaucaaccgccccaagcgaagaaagcgaaagucaaaacauccacagucgaccuccccauagagaaccaacugcucuggcaaaucgaccgcgagaugcucaaccucuacaucgagaacgaaggaaaaaugaucaugcaggacaaacuagaaaaagaaaggaacgacgccaaaaacgccguggaagaguacgucuaugaaaugcgcgacaaauuaagcggagaguacgagaaauuugucuccgaagacgacagaaacuccuucacacuuaaacucgaagacaccgaaaacuggcuauacgaagacggcgaggaccagcccaaacaaguauacguggacaaacucgcagagcugaaaaaccuaggacaacccaucaaaauccgauuucaagaaagcgaagaacgccccaagcuguucgaggaacucggaaaacaaauccaacaauacaugaaaaucauaucauccuucaaaaacaaagaggaccaauacgaccaccucgacgccgcagauaugacgaaaguagaaaaguccaccaacgaagcgauggaauggaugaacaacaaacucaaccuacaaaacaaacaaucgcucacaauggaucccgugguaaagagcaaggagaucgaggcaaaaauuaaagaacucacauccacaugcagccccauaaucucaaaacccaaaccaaaggucgaaccgccaaaagaagaacagaagaacgccgagcaaaacggcccaguagacggccaaggcgacaacccaggcccccaagcagcggaacagggaaccgacacggccguccccucagauucggacaagaaacucccagaaauggacaucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3386 - RNA, 2902 nt, Artificial Sequence
  mRNA product Design2 comprising derived and/or modified sequence from Homo sapiens__NP_055093.2 __HsHSPA4L (opt8)
ggggcgcugccuacggagguggcagccaucuccuucucggcaucaagcuuaccaugucaguggucggcaucgaccuaggcuuccucaacugcuacaucgccgucgcccgcuccggcgggauugaaacaaucgcaaacgaguacucggacaggugcacacccgcuugcauaucacugggaucgcggacgcgcgccauaggaaacgcagccaaaagccagaucguaacaaacgugcgcaacaccauccauggcuuuaaaaagcuccacggcaggagcuucgacgaccccaucguucaaaccgagcgcaucagacuaccauacgaauuacagaaaaugcccaacggcagcgccgggguaaaaguccgcuaccucgaagaagaacgaccuuucgcgaucgaacaaguuaccggaauguuacuagcaaaacugaaggaaaccucagagaacgcccucaagaaacccguggcagacugcguaauaucaaucccuagcuucuucacagacgcagaaagacguucaguaauggcggcagcccaaguagcagggcucaacugccuccgacuaaugaacgaaacaacagccguggcccucgccuacggcauauacaaacaagaccugccgccacuagacgaaaagccccgcaacgucguguucauagacaugggacacagcgccuaccaaguccucgucugcgccuuuaacaagggcaaacucaaaguccucgccacgacauucgaccccuaccugggcggacgcaauuucgacgaagcucucguagacuacuucugcgacgaguucaaaacaaaauacaaaaucaacgucaaggaaaacucaagagcccugcuccgacuauaucaagaaugcgagaaacuaaagaaacucauguccgcgaacgccagcgaccucccacuaaacaucgaauguuuuaugaacgaccuggacgucagcuccaaaaugaaccgcgcccaguucgaacaacucugcgccagccuacuagcacgcguggagccaccccucaaagccguaauggaacaagcgaaccuccagcgcgaggacauaucaagcaucgagauaguaggcggcgcgacgcgcauccccgccguaaaagagcaaaucacaaaauucuuccucaaagacauuucaacaacacuuaaugcagacgaagcaguagccaggggaugcgcucuacaaugcgccauccucagcccggcauucaaaguacgcgaguucuccaucacagaccuaguccccuacucaaucacacucagauggaaaaccucauucgaagacgggagcggagaaugcgaaguauucugcaaaaaccacccugccccauucagcaaagugauaacguuccacaagaaagaacccuucgaacuugaagcguucuacacaaaccuucacgaaguccccuacccugaugcgcgaaucgguucauucacaauacagaacguauucccccaaagcgacggcgacucgagcaaaguaaaagucaaaguccgcguaaacauccacggcaucuucucaguagcaagugccagcgugaucgaaaaacaaaaccucgaaggcgaccacagcgacgcccccauggagacagaaacaucguucaaaaacgaaaacaaagacaacauggacaaaaugcagguagaccaagaagaaggccaccagaagugccacgccgaacacacacccgaagaagaaaucgaccacaccggcgccaaaacaaaaucggcagucuccgacaaacaagaccggcuaaaccaaacccucaagaaaggcaaaguaaaaucaaucgaccuacccauacaguccucacucugccgccaacugggccaagaucuccuaaacucauacaucgaaaacgaaggaaaaaugauaaugcaagacaaacucgaaaaagaacggaacgacgccaaaaacgcgguagaggaguacgucuacgacuuucgggaccgacugggcacgguuuacgaaaaauucaucacacccgaagaccuaagcaagcuaucugcgguccuggaagauaccgagaacuggcucuacgaagacggcgaagaccaaccaaaacaaguguacguagacaagcugcaggaacugaagaaauaugggcaaccaauccaaaugaaauacauggaacacgaagaaaggcccaaagcacugaacgaccuaggcaagaaaauucaauuagucaugaaagugaucgaagcguacagaaacaaagacgaaagauacgaccaccucgacccuacagagauggagaaaguagagaagugcauaucagacgccauguccuggcuaaacagcaagaugaacgcccaaaacaaacucagccuuacgcaagaccccguggucaaagucucagaaauaguugcgaaaucaaaggagcuagauaacuucugcaaccccauaauauacaaaccgaagcccaaagccgaaguccccgaagacaagcccaaagccaacagugaacauaacgggccgauggacggacagucaggcacugagaccaaaagcgacucgacaaaagacagcagucaacacacaaagucguccggagagauggaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3387 - RNA, 2347 nt, Artificial Sequence
  mRNA product Design2 comprising derived and/or modified sequence from Homo sapiens__NP_005338.1__HsHSPA5 (opt8)
ggggcgcugccuacggagguggcagccaucuccuucucggcaucaagcuuaccaugaaacucagccuagucgcagccaugcugcugcuccucagcgcagcacgggcagaagaggaagacaagaaagaagacgugggaacaguaguaggcauagaccucggaacgacauacagcugcguagggguauucaaaaacggacgagucgagaucauagccaacgaccagggcaacagaauaaccccaaguuacguagcguucacacccgagggugaacgacugaucggagacgcagcgaaaaaccaacucacaagcaaccccgaaaacacaguauucgacgcaaagcgacuaauaggccgcaccuggaacgaccccucgguccagcaagacaucaaauuccugccauucaaagucgucgagaagaaaacaaaacccuacauacaaguagacauagggggcgggcagacgaaaacguucgcgccagaagaaauaagcgcaaugguacugacgaaaaugaaagagaccgcagaagcguaccugggcaagaaagucacccacgcagucguaacagugccagccuacuucaaugacgcgcaacgacaagcaacaaaggacgcaggaacaaucgcgggacugaacgugaugcgaaucauaaaugaacccaccgccgccgcaauagcguacggacuagacaaacgggaaggcgagaaaaacauccuagucuucgaccugggcggagguaccuucgacguaagucuccugacaaucgacaacggcguauucgaagucguagcaacaaacggggacacacaccugggaggagaagacuucgaccagcgaguaauggagcacuucauaaaacuauacaagaagaaaaccggaaaagacguaaggaaagacaacagagccguacaaaaacucaggcgggaggucgaaaaagccaaacgcgcccuauccagccaacaccaagcgcgcaucgaaauagaaucauucuacgagggggaagacuucagcgaaacccuaacacgcgcaaaauucgaagaacugaacauggaccuauuccgcagcacgaugaaaccaguacaaaaaguccuagaggacagcgaccuaaagaaaagcgacauagacgaaauaguauuagugggcggcucgaccaggauaccaaaaauacaacaacugguaaaagaguucuucaacggcaaagaaccaucgcgagggaucaacccagacgaagccgucgcauacggagccgcaguucaagcaggaguacugagcggcgaccaagacacaggagaccucguacuacuggacgugugcccacucacccuaggcauagaaacaguaggcgggguaaugacaaaacucauaccaagaaacacggucgugcccaccaagaaaagccagauauucagcacggcaagcgacaaccaacccaccguaacgaucaaagucuaugaaggagaacgaccccucacaaaagauaaccaccuacugggcaccuucgaucuaacaggcauaccaccagccccaagagggguaccacaaauagaagugacauuugaaaucgacguaaacgggauucuccgagugaccgcggaagacaaaggaaccggaaacaaaaacaaaauaacgauaaccaacgaccaaaacagacucacaccggaagaaaucgaaagaauggucaacgacgcagagaaauuugccgaagaggacaagaaauugaaagagcgaauagacaccagaaacgaacucgaaagcuacgccuacucacucaaaaaccagauaggugacaaagaaaaacuaggagggaaacuaagcagugaagacaaagaaaccauggaaaaagccgucgaagagaaaaucgaauggcuagaaucacaccaagacgcagacauagaagacuucaaagccaaaaagaaagaacuagaagaaauaguacaaccaaucauauccaaacuauacggaagcgcagggcccccacccacaggagaagaggacacagcggaaaaagacgaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3388 - RNA, 2314 nt, Artificial Sequence
  mRNA product Design2 comprising derived and/or modified sequence from Homo sapiens__NP_002146.2__HsHSPA6 (opt8)
ggggcgcugccuacggagguggcagccaucuccuucucggcaucaagcuuaccaugcaagcaccccgggagcucgcagucggcauugaucucggaacaacauacuccugcguaggaguguuccagcaagggcgcguggaaauacucgcaaacgaccaaggcaaccggaccaccccaagcuacguggccuucaccgacacagagcggcugguaggagacgcagcaaaaagccaagccgcgcugaauccccacaacacagucuucgacgcaaaaaggcuaauuggaagaaaauucgcagacacaacaguacaaagcgacaugaaacauuggcccuuccgagucgucucagaagggggcaaacccaaggucagagucugcuacagaggugaagacaaaacauucuaccccgaagagauaucaagcauggugcucagcaaaaugaaagagacggccgaggcauaccucgggcaaccggucaaacacgcgguaauaacagucccagcauacuucaacgauagccaacgccaagccacaaaagacgccggagcaaucgccgggcucaacguccuacgaauaaucaacgaaccaacagcggcagcaaucgcuuacgggcuagacagaagaggcgcaggcgaacggaacguccugauauucgaccuaggaggaggaacauucgacguaucagugcuaagcaucgacgcaggaguauucgaagucaaagccacggcaggagacacacaccugggcggggaagacuucgacaacaggcuaguaaaccacuucauggaagaguuccggcgcaaacacgggaaagaccuaucagggaacaaaagagcccugcgaaggcugagaacagccugcgaacgcgcaaaaaggacacuaagcagcuccacacaagcaacacuagaaauagacucccucuucgaaggagucgacuucuauaccucgaucacgcgcgcacgauucgaagaacuaugcagcgaccucuuccgaucgacccuggaaccgguagaaaaagcccuaagagacgcgaagcuagacaaggcccaaauacacgacguaguccucguaggaggaucgacacgcaucccaaaaguacaaaaacuccuacaagacuucuucaacgggaaagaacucaacaagucaauaaaccccgacgaagcaguggccuacggugccgcaguucaggccgcaguccugaugggcgacaagugcgaaaagguucaagaccuacuacuccuagacguggcaccccucucccucggacuagagacagcgggcggagucaugacuacacuaauccaaagaaacgcaaccaucccaacaaagcaaacacaaacauucacaaccuacucagacaaccaaccaggcguauucauccaagucuacgagggcgaacgcgcaaugaccaaagauaacaaccuacugggccgauucgagcucucaggcauacccccagcaccccgaggagucccacaaauagaaguuacauucgacaucgacgccaacgggauauugagcgugaccgcaacagaccgcucaaccggaaaggcaaacaaaauaacaauaacaaacgauaaaggacgacuaagcaaagaagaaguggagcgcaugguacacgaggcggaacaauacaaggccgaggacgaagcccaacgggacagaguagccgccaaaaacagccuggaagcgcacgucuuccacgucaaaggaucacuacaggaagaaucccuccgagacaaaauacccgaggaagacagacgaaaaaugcaagacaagugccgagaaguccuagccuggcucgaacacaaccaacuggccgaaaaagaagaauacgaacaccaaaagcgagaacuagagcaaauaugcagaccaauauucucgagacuauacggcgggccgggcguaccuggcggaucgagcugcggcacccaagcccgacaaggcgacccaucaaccgggccuauaaucgaggaaguggacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3389 - RNA, 1486 nt, Artificial Sequence
  mRNA product Design2 comprising derived and/or modified sequence from Homo sapiens__P48741__HsHSPA7 (opt8)
ggggcgcugccuacggagguggcagccaucuccuucucggcaucaagcuuaccaugcaagcaccacgcgaacucgcagucggaaucgaccuaggcaccacauacucaugcgucggcguauuccaacaaggaagagucgaaauccucgccaacgaccaaggaaaccgaaccacgccaagcuacgucgcauucacagacacagaacgccuggucggcgacgcagccaaaagccaagccgcacucaacccacacaacacaguauucgacgcaaaacggcucauaggccgcaaauucgccgacaccaccguccaaagcgacaugaaacauuggccauuccaagucguaagcgaaggcggcaaacccaaaguccgagucugcuacagaggcgaggacaaaacauucuacccagaagaaaucuccagcaugguacuaaguaaaaugaaagaaaccgcagaagcauaccuaggccaacccguaaaacacgcaguaauaaccguaccaaccuacuucucaaacagccaacgccaagcaacaaaagacgcaggagccaucgccggccucaaaguccucccaauaauaaacgaagcaaccgcagccgcaaucgccuacggacucgaccgacgaggcgccggcaaacgaaacguacucauauucgaccucggcggcggcaccuucgacguaagcguacuaagcaucgacgcaggagucuucgaagucaaagcaacggccggcgacacacaccuuggaggagaagacuucgacaacagguuagucaaccacuucauggaagaguuccgccgcaaacacggaaaagaccucucaggaaacaaacgcgcacugcgacggcuacgaacagcgugcgaacgcgcaaaacgcacccccuccagcagcacacaagccacucucgaaaucgacucacuguucgaaggcgucgacuucuacaaauccauaacacgcgcacgcuucgaagaacucugcagcgaccucuuccgcagcacccucgaacccguugaaaaagcccuacgcgacgccaaacuagacaaagcccaaauccacgacuucguccugggcggcggccuccacucacacccccaaggagccgaaguagcagcaggacuccugcaacgccaaggagcagaacaagaacaccaacccuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3390 - RNA, 2323 nt, Artificial Sequence
  mRNA product Design2 comprising derived and/or modified sequence from Homo sapiens__NP_006588.1 __HsHSPA8 (opt8)
ggggcgcugccuacggagguggcagccaucuccuucucggcaucaagcuuaccaugagcaaaggaccagcaguagggauagaccucggaaccacauacuccugcguagggguauuccagcacggcaaaguagaaauaauagcgaacgaccaaggcaaccggaccaccccuuccuacguagccuucaccgacacagagcgccucaucggagacgcggccaaaaaccaagucgcaaugaaccccaccaacacaguauucgacgcaaaaagacucauaggcaggcgguucgacgacgcagucguacaaagcgacaugaagcacuggcccuucauggucguaaacgacgcaggacgcccaaaaguccaaguagaauacaagggcgagacaaaauccuucuacccagaagaggucuccagcaugguacugaccaaaaugaaagagauagcagaagccuaccucggaaaaacuguaaccaacgcaguagucacagucccagccuacuucaaugacagccaacgccaggccaccaaagacgccggaaccaucgccggacuuaacguacuacgcaucaucaaugagccaacggcggccgcaaucgcguacgggcucgacaaaaagguaggagccgaaagaaacguccugaucuucgaccuaggaggaggaacauucgacgucucaauccucacaauagaagacggcauauucgaaguaaagagcacggccggcgacacacaccugggaggagaagacuuugacaacagaaugguaaaccacuucauagcagaguucaagcgcaagcacaagaaggacaucagcgaaaacaaaagagcaguacgccgccuccgcaccgccugugaaagagcaaaacgcacccucagcuccagcacccaagcaaguauagaaauugacucacuauacgaaggcaucgacuucuacaccagcaucacccgagcaagauucgaagaauuaaacgcagaccucuucagaggaacccuggacccagucgagaaagcacuacgagacgcaaaacuagacaaaagucaaauacacgacauaguccuagucggaggcagcacacgaaucccgaagauacagaaacuccuccaagacuucuucaacggaaaagaacuaaacaaaagcauaaauccagacgaagcagucgcauacggcgcagcgguccaagcggccauacuuucaggcgacaaaagcgagaacguacaagaccugcugcuccuggacgucacgccgcucucacuaggcaucgaaacagccggcggcguaaugaccgugcucauaaaacgcaacacaaccauaccaacaaaacagacccagaccuucacgacauacuccgacaaccagccaggcguacucauacaggucuacgaaggagaacgcgcaaugacaaaagacaacaaccuccuaggcaaauucgaacucacagggauacccccagcaccgcgcggagucccacaaauagaagucaccuucgacaucgacgcaaacggaauccuaaacguauccgccguagacaaaucaaccggaaaagaaaacaaaauaacgaucacaaacgacaaaggccgccuaagcaaggaggacaucgagagaaugguccaggaggccgaaaaauacaaagccgaagacgaaaaacaacgcgacaaaguaaguagcaagaacagccuggaaagcuacgcauucaacaugaaggcgacggucgaagacgaaaaacugcagggaaaaauaaacgacgaagacaaacagaaaauccuagacaaaugcaacgaaaucauaaacuggcuggacaaaaaucaaaccgccgaaaaagaagaauuugaacaccaacaaaaggagcucgaaaaagugugcaaucccauaaucaccaaacuauaccaaucagcgggaggaaugcccggagggaugccgggcggguucccaggagggggagcacccccaagcggaggcgcaagcucgggccccacgauagaggaggucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3391 - RNA, 2422 nt, Artificial Sequence
  mRNA product Design2 comprising derived and/or modified sequence from Homo sapiens__NP_004125.3 __HsHSPA9 (opt8)
ggggcgcugccuacggagguggcagccaucuccuucucggcaucaagcuuaccaugauaucagccagccgcgcggccgccgcaagacuggugggagcagccgcgagccgcggaccaacagcagcgcggcaccaagacagcuggaacggacugucacacgaagcauuccgacucgugaguagaagagacuacgcgagcgaagccauaaaaggggccguagucggaaucgaccucggaacaacaaauaguugcguagccgugauggagggaaaacaagccaaaguacuagagaacgcggagggagcgagaaccacaccaagcgucguagccuucaccgcagauggagaaaggcucguaggcaugcccgcaaaaagacaagcagugacgaacccaaacaacaccuucuacgcgacaaagcgccucaucggccgacgcuacgacgaccccgaggugcaaaaagacaucaaaaacguaccauucaaaauagugagagcaagcaacggcgacgccugggucgaagcccacggcaaacuauauagccccagccagauaggggccuucgucuugaugaaaaugaaagagaccgcagaaaacuaccuaggacacacagccaagaacgcaguaauaaccguaccugcauacuucaacgacagccagagacaagccacaaaggacgccggccagauaagcggacuuaauguacuacgcguaauaaacgaaccgacagccgccgcgcucgcauacggccuagacaaaagcgaggacaaaguaauagcaguauacgaccuaggagggggaacuuucgacaucucgauacuagaaauacaaaagggaguuuucgaggucaagucaacaaacggggacaccuucuuaggcggagaagacuucgaccaagcgcugcuacgccacaucgugaaagaguucaaaagagaaacaggggucgaccucacgaaagacaacauggcacuccaaagagucagagaagcggcagaaaaagcgaaaugcgaacuaagcagcagcguccaaacagacauaaaccuacccuaccuaacaauggauagcucaggcccaaaacaccugaacaugaagcucacgcgcgcgcaauucgaggggauagugacugaccucaucagaagaaccauagcaccaugccaaaaagcaaugcaagaugccgaaguaagcaaaagcgacauaggggaagucauccuagucggaggaaugacgaggaugccaaaaguacaacaaacaguacaagaccucuucgggagagccccguccaaggccguaaacccggacgaggcaguagccauaggagcggccauacaaggaggaguccuagccggggacguaacagacgugcugcugcucgacguaacaccccugucucugggcauugaaacccuaggaggcguuuucacaaaacucaucaacagaaacacgacgauaccgacuaagaaaucccaagucuucuccacagccgccgacggucaaacccaaguagaaaucaaagucugccaaggagagagggaaauggccggggacaacaaauuacucgggcaauucacccucaucggaaucccacccgcgccccgaggcgugccccagauagaggucacauucgacaucgacgccaacggaauaguacacguaagcgccaaagacaaaggaacaggccgggaacaacagauagucauacagucaagcggaggccucagcaaggacgacaucgaaaacauggucaaaaacgcagagaaguacgcagaagaggaccggagaaagaaagaacgcguggaagcaguaaacauggccgaagggauaauacacgacaccgagacaaaaauggaggaguucaaagaccagcugcccgcggaugaauguaauaaacuaaaagaagaaauaagcaaaaugagggaacuacucgcacgaaaggacucugaaacgggcgagaacauuagacaagcggcaagcagccuccaacaagcaucccugaagcucuuugaaauggcauacaagaaaauggcgucggaaagggaaggguccgggagcucaggcacgggagagcaaaaggaagaccaaaaggaggaaaaacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3392 - RNA, 2410 nt, Artificial Sequence
  mRNA product Design2 comprising derived and/or modified sequence from Homo sapiens__NP_079291.2__HsHSPA12A (opt8)
ggggcgcugccuacggagguggcagccaucuccuucucggcaucaagcuuaccauggcggacaaagaagccggaggaagcgacggcccccgcgaaaccgccccaacauccgccuacagcucgcccgcccgcagccuaggagacaccggaaucacaccccucucucccucccacauugucaacgacaccgacuccaacguaucugaacaacaaucauuccucguaguagucgcaguagacuucggcaccaccucguccggauacgcauacucguucaccaaagaacccgaauguauccacguaaugagacgcugggaaggcggcgaccccggggucuccaaccagaaaaccccaaccaccauacuacucaccccagaaagaaaauuccacuccuucggauacgccgcccgcgacuucuaccacgaccucgaccccaacgaagccaagcaauggcucuacuuggaaaaauucaaaaugaaacuccauacaaccggagaccucaccauggacaccgaccucacagcugcaaacggcaagaaagucaaagcacucgagaucuuugccuacgcgcugcaauacuucaaagaacaagcccucaaagaacucuccgaccaagcagggucagaguucgaaaauagcgacguccgaugggucaucaccgucccagcaauuuggaaacaacccgcaaaacaauucaugcgccaagccgccuaccaagcuggccuagcuucaccagaaaacucagaacaacuaaucauagcacucgaaccggaagcagcaagcaucuacugcagaaaacuacgccuccaccaaaugaucgaacucagcucaaaagccgccgugaacggcuacuccggauccgacaccguaggcgcgggcuucacacaagccaaagaacacauccgucggaaccgccaaucacgaacauuccuagucgaaaacgucauaggcgaaaucuggagcgaacuagaagaaggcgacaaauacgucguagucgacucaggcggaggcacaguggaccucaccguacaucaaauccgccuaccagaaggccaccucaaagaacucuacaaagcuacaggcggaccauacggaucacugggcgucgacuacgaguucgaaaaacuacuauacaagaucuucggcgaagacuuuaucgaacaauucaaaaucaaaagacccgccgccuggguagaccucaugaucgccuucgaauccagaaagagggcagccgcgcccgaccgcacuaacccccugaacauaacacucccauucagcuucaucgacuauuacaagaaauuccgcggccacucaguugaacacgcccuccgcaaauccaacguagacuuuguaaaauggucaucccaaggcaugcuccggaugucccccgacgccaugaacgcccuauucaaaccaaccauagauuccauaaucgaacaccucagagaccucuuccaaaaacccgaagucucaaccguaaaauuccuuuuccuagucgggggauucgccgaagcgcccuuacuacaacaagcggugcaagcugcauucggcgaucaaugccgaauaauaaucccccaagacguaggccuaaccauacugaaaggggcaguacucuucggccucgaccccgcaguaaucaaaguccgacgcuccccacuaaccuacggcguaggcguacucaacagauacguagaaggaaaacauccaccagagaaacuccugguuaaagacggaaccagauggugcaccgacguauucgacaaauucaucagcgccgaccaaucaguugcacucggcgaauuaguuaagcgaagcuacacccccgcgaaaccaucccaacucgucaucgucauaaauaucuacagcucagaacacgacaacgucucguucaucaccgaccccggggucaaaaagugcggcacgcucagacucgaccucaccggcaccagcgggacggcaguaccagcgcgacgcgagauacaaacccucaugcaauucggcgacacagagaucaaagccaccgcgauugacauagcaacaucaaaaucugucaaagucggaaucgacuucuuaaacuacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3393 - RNA, 2443 nt, Artificial Sequence
  mRNA product Design2 comprising derived and/or modified sequence from Homo sapiens__NP_443202.3 __HsHSPA12B (opt8)
ggggcgcugccuacggagguggcagccaucuccuucucggcaucaagcuuaccaugcucgccguccccgagaugggcuugcagggccuauacauaggcagcucacccgaaagaagcccagucccauccccaccuggaucccccagaacccaagaauccugcggaaucgcuccccucaccccaucacaauccccaaaaccggaaguccgcgcaccccaacaggccucauucucaguuguugucgccauagacuucggcacaaccucaagcggauacgccuucagcuucgccucagaccccgaagccauacauaugaugcgcaaaugggaggguggcgaccccggcgucgcccaccagaaaacgcccacuugccuacuccucaccccagaaggcgccuuccacuccuucggcuacacggccagagacuacuaccacgaccucgaccccgaagaagcaagggacugguuguacuucgaaaaauuuaaaaugaaaauucauagcgccacagaccuaacccuaaaaacgcaauuagaagcuguaaacggcaaaaccaugcccgcccucgaagucuucgcccacgcacuccgcuucuuccgagaacacgcacuccaagaacuaagagagcaaucacccagccuccccgagaaagacacaguacgcuggguacugaccguacccgccauauggaagcaaccagcgaaacaauucaugagagaggccgcauaccucgcagggcuaguaucccgggaaaacgcagaacaacuccucauagcauuagaaccagaagcagccucagucuauugcagaaaacuccgccugcaccaauugcucgaccucagcggccgcgccccaggaggcggucgacucggcgaacgacgaagcauagacucaucauuccgccaagccagagaacagcuccgccgauccagacacucacgaaccuuccuuguagaauccggcgucggagagcuuugggccgaaaugcaagccggggaccgauacgucguagccgacugcggcggcggaaccgucgaccuaacaguacaccaacuagaacaaccacaugguacccucaaagaacucuacaaagccuccggcggucccuacggagccguuggcguagaccucgcauucgaacaacuacucugcagaauauucggagaagacuuuauagcuaccuuuaaaagacaacgacccgcagccugggucgaccuaacuauagccuucgaagcacgcaaacgaacagccggcccacacagagccggcgcacucaacauaagccuaccauucucguucauagacuucuaccgcaagcaaagaggccacaacgucgaaaccgcccucagacgaucauccguaaacuucguaaaauggucaagucaaggaaugcugcgaaugucaugcgaagcaaugaacgagcuauuccaaccgacaguaagcggaaucauccaacacaucgaagcgcuccuagcgcgcccugaaguccaaggcguaaaacuucuauucuuaguuggaggauucgcagaaagcgccguacuucaacaugcaguccaagcagcacucggcgcacgcgggcuccgagucgucgucccccacgacguuggccuaaccauacucaaaggagccguccucuucggacaagccccaggggucguccgagugcgcagaucaccgcuaacauacggcguaggcgugcucaaucgcuucguaccaggcagacacccgcccgaaaaacuccuaguccgagacggacggcgcuggugcaccgacgucuucgaaagauucgucgcggcugaacaauccguagcccucggcgaagagguacgucgcagcuacugcccagcccgacccggacagagacgaguucucaucaaccucuacugcugugcagcagaagacgcccgguucauaacagaccccggcguaagaaaaugcggagcacucucccuugaacuagaaccggcagacugcggacaagacaccgccggcgccccacccggaagacgcgaaaucagagccgcaaugcaauucggagacacagaaaucaaagucacagcaguagacguaagcaccaacagaagcgucagagcaagcauagacuuccucucaaacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3394 - RNA, 1798 nt, Artificial Sequence
  mRNA product Design2 comprising derived and/or modified sequence from Homo sapiens__NP_008879.3__HsHSPA13 (opt8)
ggggcgcugccuacggagguggcagccaucuccuucucggcaucaagcuuaccauggcccgcgaaaugaccauacuaggcuccgccguauuaacccuccuccuugcaggcuaccuagcacaacaauaccucccacuaccaaccccaaaagucauuggcauugaccucggaaccacguacugcagcgucggcgucuucuucccuggaaccggcaaagucaaaguaauacccgacgaaaacggccacaucuccauaccauccaugguuuccuucaccgacaacgacguguacgucggauacgaauccgucgaacucgccgacagcaacccacagaacaccaucuaugacgcaaaacgauucaucggaaaaauauucacagccgaagaacucgaagccgaaaucggacgcuauccauucaaaguacuaaacaaaaacggcaugguagaguucuccgucacaagcaacgaaaccaucaccgucagccccgaguacguaggaucuagacugcuucuaaaacuaaaagaaauggccgaagccuaucugggcaugcccgucgccaacgcaguaaucucgguccccgcagaguucgaccuaaaacaacgaaacucaaccauagaagcggccaaccuagccggccucaaaauacuaagagucauaaacgaacccacugccgcggcuauggccuacggucuccacaaagccgacgucuuccacguccucgucaucgaccucggcggcggaaccuuagacgucagccuacucaacaaacaaggcggcauguuccucacccgcgcaaugagcggcaacaacaaacucggaggccaagacuucaaccaacgccuacuccaauaccucuacaaacagaucuaccaaaccuacggcuuuguaccaucccgcaaagaagaaauacaccgacuccgacaagccgucgaaauggucaaacucaaccugacccuacaccaaagcgcccagcuaucuguacuacuaaccgucgaagaacaagaccgcaaagaaccccacucaagcgacaccgaacuccccaaggacaaacucagcucugcggacgaccaccgcgucaacuccggcuucggccgaggcuuaucagacaagaaauccggagaaagccaaguccucuucgaaaccgagauaucccgcaaacuauucgacacacucaacgaagaccuauuccagaaaaucuuaguacccauacaacaaguccucaaagaaggccaccuggagaaaacagaaauagacgaagucguccuaguaggcggcagcacacgcaucccccgcauuagacaagucauccaagaguucuucggcaaagaccccaacaccuccgucgaccccgaccuagccgucgugaccgggguagcaauccaagccggcaucgacggaggcuccuggccacuacaggucucggcacuugaaaucccgaacaaacaccuccagaaaaccaacuucaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3395 - RNA, 1912 nt, Artificial Sequence
  mRNA product Design2 comprising derived and/or modified sequence from Homo sapiens__NP_057383.2__HsHSPA14 (opt8)
ggggcgcugccuacggagguggcagccaucuccuucucggcaucaagcuuaccauggcagcaaucggcguccaccucggaugcacaucagccugcgucgccgucuacaaagacgggcgcgccggcgucgucgcaaacgacgcgggcgaccgcgucacaccagccgucgucgcauacuccgaaaacgaagaaauaguaggccuagccgccaagcaaucccgcauacgcaacaucagcaacacagucaugaaaguaaaacaaauauuaggccgcuccuccuccgacccacaggcccaaaaauacaucgcagaaucaaaaugccucguaaucgagaaaaacggcaaacuacgcuacgagaucgacacuggcgaagaaaccaaguucguaaacccagaagacgucgcccgccuaaucuucucaaaaaugaaagaaacggcccacucaguccucggcuccgacgccaacgaugucgucauaaccguaccauucgacuucggcgaaaaacaaaagaacgcacuaggcgaagccgcccgcgcagcgggauucaacguccuacgccucauacacgaaccauccgcggcccucuuagcuuacggaaucggacaagacucccccaccggcaagucaaacauccuaguauucaaacuaggaggaaccucacuaucacucucagucauggagguaaacucaggcaucuaccgcguccucagcaccaacacagacgacaacaucggaggagcccacuucaccgaaacacucgcccaguaccucgccuccgaguuccagcgaucguucaaacaugacguacgaggaaacgcacgcgcaaugaugaagcucacgaacagcgcagaagucgcaaagcacucccuaagcacacuaggcagcgcaaacugcuuccuggacucauuauacgaaggacaggacuucgacugcaacguaagccgcgccagauucgaacuccucugcucaccccucuucaacaaaugcaucgaagccauacgcggacuacuagaccaaaacggguucaccgccgacgacaucaacaaagucguucucugcggcggauccagccgcauccccaaacugcaacaacucaucaaggaccuauuccccgccgucgagcugcuaaacuccauaccacccgacgaaguuauacccauuggagcagcaauagaggccggcauccucaucggcaaagagaaccuccucgucgaagacucccugaugaucgagugcuccgccagagacauacucgucaaaggcgucgacgaaucaggagcaucacgcuucacaguccuauuccccucuggaacaccccuuccagcacgacgacaacacacccuacaagcaccaggcagcauuuccuccgucugccuagaacucuacgaauccgauggcaaaaacucggccaaagaagaaaccaaguucgcacaagucguacuccaagaccucgacaagaaagaaaacggacuccgcgacauccuggccgugcucaccaugaagcgagauggaucacuacacgugaccugcaccgaccaggaaaccggcaaaugcgaagccaucagcaucgaaaucgcauccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3396 - RNA, 2959 nt, Artificial Sequence
  mRNA product Design2 comprising derived and/or modified sequence from Homo sapiens__NP_006635.2 __HsHSPH1 (opt8)
ggggcgcugccuacggagguggcagccaucuccuucucggcaucaagcuuaccauguccgucgucggacuggacgugggaagccaaagcugcuacauagcagucgcccgggcagggggcaucgaaacaaucgccaaugaguucagcgacagaugcacuccaagcgucaucuccuucggauccaaaaacagaacaauaggagucgccgccaaaaaccaacagauaacccacgcaaacaacaccgucucaaacuucaaacgguuccacggcagagcauucaacgaccccuucauacaaaaagaaaaagaaaaccuaucauacgaccucgucccacucaaaaacggaggagucgguaucaaagucauguacaugggcgaagaacaccuuuucucaguagagcaaauaacagcaaugcuacuaaccaaacucaaagagacagcagaaaacucgcugaagaaaccagucacagauugcgucauaagcgucccgagcuucuucaccgacgccgaacgacgcucaguacuagacgcagcccaaaucgucggccugaacugucucagacuaaugaacgauaugacggcagucgcccuaaacuacggcauauacaaacaggaccucccaucacuggaugaaaaaccacguaucguggucuucgucgacaugggccacucagcauuccaagucuccgcaugcgccuucaacaaaggcaaacucaaaguacuaggcacagccuucgacccauuccuugggggcaaaaacuucgacgaaaaacuggucgagcacuuuugcgcagaguucaaaaccaaauacaaacucgacgccaaaagcaaaauccgagcacuucuacgauuauaccaagaaugcgaaaaacucaagaaacucaugagcagcaacucgacagaccuccccuugaacaucgaaugcuucaugaaugacaaggacgugucagggaagaugaaccggucacaguucgaagaacugugcgccgaacuccugcagaaaaucgaagucccacuguacucccuacucgaacaaacccaccugaaagucgaagacgucucagcaguagaaaucgugggaggggcaacccgaauaccugccgucaaagaacguaucgcgaaauucuucggaaaagacaucaguacaacgcucaacgccgacgaagcagucgccagagggugcgcacuccaaugcgcgauccuaucccccgcguucaaaguacgcgaguucuccgugacugacgccgucccauucccaaucucacuaaucuggaaccacgacucagaagacacggaaggaguccacgaagucuucagccgcaaccacgcugcccccuucucuaaaguauuaaccuuccuccgccgagguccauucgaacucgaagcguucuacucagacccacaagggguacccuacccggaggcgaaaaucggccgcuuuguaguacaaaacgucucagcccagaaagacggcgaaaaaucccgggucaaagucaaaguccgcgucaacacccacggcauauucaccaucucaacugccagcauggucgagaaaguaccaacagaggagaacgaaaugucaagcgaagccgacauggaaugccuaaaucaaagaccgccagaaaacccugacaccgacaaaaacguacaacaagacaauuccgaagcagggacccagccacaaguccagacagacgcacaacagaccagccaaucacccccauccccagagcucacgagcgaagaaaacaaaauaccagacgcagacaaggcaaacgaaaagaaagucgaccagccgccagaagcgaaaaagccgaaaaucaaaguagucaacgucgaacuccccauagaagcaaaccucguauggcagcucgggaaagaccuccuaaacauguacaucgagacagaaggcaaaaugauaaugcaagacaaacuagaaaaagaaagaaacgacgcuaaaaacgcaguagaagaguacgucuacgaguuccgcgacaaacucugugggcccuacgaaaaauucaucugcgaacaagaccaccaaaacuuccuaagacuccuaaccgaaacggaagacuggcucuacgaagaaggcgaggaccaagcaaaacaagccuacgucgauaaacucgaggagcuaaugaaaaucggcacgcccgucaaaguccgcuuccaagaagcagaagaacgaccgaagauguucgaagaacugggccagcgcuugcaacacuacgcgaaaauagcggccgacuuccgcaacaaagacgaaaaauauaaccacauagacgaaucagagaugaaaaagguagagaaaagcguaaacgaaguaauggaauggaugaacaacgucaugaacgcccaagccaagaaaucacuagaccaagaccccguugucagagcccaagaaauaaaaaccaaaauuaaagaacucaacaacacaugcgagccagucgucacccaaccgaaaccaaaaauagaaucuccaaaacucgaaagaaccccaaacggcccuaacaucgauaagaaagaagaggaucucgaagacaaaaacaacuucggggcagaacccccgcaccaaaacggcgaaugcuaccccaacgagaaaaacucugugaacauggaccuagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3397 - RNA, 3382 nt, Artificial Sequence
  mRNA product Design2 comprising derived and/or modified sequence from Homo sapiens__NP_006380.1 __HsHYOU1 (opt8)
ggggcgcugccuacggagguggcagccaucuccuucucggcaucaagcuuaccauggccgacaaaguccgacgacaacgaccgcgccgacgaguauguugggcgcucgucgccguacugcucgccgaccuacuggcccuaagugacacccucgcagugaugaguguagaccuaggcuccgaauccaugaaggucgcgauagucaaaccaggagugccgauggaaauaguccucaacaaggaauccaggcgaaaaaccccaguaauaguaacccucaaagaaaacgagcgguucuuuggagacucagcagcaagcauggcaaucaagaauccaaaagccacccuacgauacuuccaacaccuacuaggaaagcaggcagacaacccacacgucgcacuauaccaggccagguucccggaacacgagcugaccuucgacccccaaaggcaaacgguacacuuccaaaucagcagccaacuacaauucagcccagaagaaguccucggaaugguccuaaacuacagcagaagccucgcagaggauuucgccgaacagccaauaaaagacgccguaauaacagucccaguauucuucaaccaagccgagcgacgagccguccuacaggcagcacgcauggccgggcucaagguacuccagcuaauaaacgacaacacggcaacggcccuauccuacggagucuuucggagaaaagacauaaacacaaccgcacaaaacauaauguucuacgacaugggcucaggcucgacagucugcacaauagucacauaccagauggucaaaacaaaggaagccgggaugcaaccgcaacugcaaauacgaggagucggauucgaccgaacacugggaggacuagaaauggaacuacgacuccgagagaggcuggccggccuauucaacgaacaaagaaaaggccaacgcgcaaaagacguaagggaaaacccacgagcaauggcuaaacuacuccgagaagccaaccgacugaaaacaguacuaagcgcaaacgcagaccacauggcgcaaauugaagggcuaauggacgacguagacuucaaagcaaaagucacccgcguggaguucgaggaacucugcgcagaccuguuugaacgcguccccggccccguacaacaagcacugcaaagcgcagaaaugagccuagacgagauagaacaaguaauccuaguaggcggcgccacacgaguacccagaguucaagagguacuacugaaagcugucgggaaagaggaacuaggcaaaaacaucaacgccgacgaggccgcagcaaugggagccguauaucaagcagcagcauuaaguaaagcauucaagguaaagccguuuguaguacgggacgccgucguauacccaauuuuagucgaguucacgcgggaagucgaagaggaacccggaauacacucacugaaacacaacaaacgcguccuauucucacgaaugggucccuacccacaaagaaaaguaauaaccuucaaccgauacagccacgacuucaauuuccacaucaacuacggcgaccuuggauuccuagggcccgaagaccugagagucuucggaagccagaaccucaccacagucaaacugaaaggagugggggacagcuucaagaaauacccagacuaugaaucaaaaggaauaaaggcacacuucaaccucgaugaaagcggaguacugagccuggacaggguagaaagcguuuucgagacacugguggaagacagugccgaagaagagagcacacuaacaaaacugggcaacacaaucaguagccucuucgggggcggaacaacgccagacgcaaaagaaaacgggaccgacaccguacaagaagaagaagaaagcccagccgaaggaagcaaggacgagccaggagagcagguagagcucaaagaagaagcagaggcgcccguagaagacggcucucagccaccuccgcccgaacccaaaggagacgcaacaccagagggagagaaggcgaccgaaaaagaaaacggcgacaaaagcgaggcgcaaaaaccgucggagaaagccgaggcgggaccagaaggaguagccccagcacccgaaggcgaaaagaaacaaaaaccagcgagaaaaagaaggaugguggaggaaaucggcguggaacugguagugcuagauuuacccgaccucccagaagacaaacucgcgcagucgguacagaaauuacaagaccugacacuaagagaucuugaaaaacaagaacgagagaaggcggcaaacagucuggaagcguucaucuucgagacgcaggacaaacuauaccagccggaguaccaagagguaucaaccgaagaacaaagagaggaaaucuccggcaagcuaucggcggccucaacauggcucgaggaugaagggguaggcgccaccacagugaugcuaaaagaaaagcuagcugaacuaagaaaacuaugccaaggucuauuuuuccgagucgaggaaaggaagaaauggccagaaagacuaucggcccucgacaaccuacuaaaccacuccagcauguuucuaaaaggcgcgagacuaauaccagagauggaccaaaucuucacggaagucgaaaugaccacacuagaaaaagugauaaacgagacgugggcauggaaaaaugccacacucgcagaacaagccaaacuacccgcaacggaaaagcccguccuacucagcaaagacaucgaagcaaaaaugauggcguuagaccgcgaaguacaguaccuacuaaacaaagcgaaauucaccaaaccacgaccccgccccaaagacaaaaacggcacacgggcagagccaccacugaacgcaagcgccucagaccaaggggaaaaggucauacccccggccggacaaaccgaagacgcggaaccaauaagcgagcccgaaaagguggagacgggaagcgaacccggcgacacagagccacuggaacuaggaggcccgggcgcagaaccagagcaaaaggaacaaagcacagggcaaaagaggccacucaaaaacgaugaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3398 - RNA, 2581 nt, Artificial Sequence
  mRNA product Design2 comprising derived and/or modified sequence from Homo sapiens__NP_005339.3 __HsHSP90AA1 (opt8)
ggggcgcugccuacggagguggcagccaucuccuucucggcaucaagcuuaccaugccagaagaaacgcaaacgcaagaccaaccaauggaagaggaggaaguagaaacguucgccuuccaggcagagaucgcccaacuaaugagccugauaauaaacacauucuacucgaacaaagagauauuccucagagagcucauaagcaacagcucggacgcacuggacaaaauacgauacgaaucccuaaccgacccgagcaaacucgacuccggcaaagaacuccacaucaaccuaauaccaaauaaacaggaccggacacucaccaucgucgacacagggauaggaaugacaaaagcggaccugaucaacaaccuaggaacgauugcaaaaagcggaacaaaagcguucauggaagcccuccaagcaggcgccgauauauccaugauaggacaauucggcgugggguucuacucagcauacuuagucgcggaaaaagucacgguaauaacgaaacacaacgacgacgaacaguacgcgugggagagcuccgcaggcggcagcuucacaguuaggacagacaccggagagcccauggggcgagggaccaaggucauccuucaccucaaagaagaccaaacggaauaccucgaagaaaggcgcauaaaggaaaucgugaagaaacacucccaauucauaggauacccuaucacacuauucguagaaaaagaacgcgacaaagagguaagcgacgacgaagcggaagagaaggaagacaaggaagaggaaaaagagaaggaagagaaagaaagcgaagacaagcccgaaauagaagacguaggcucggacgaggaagaagaaaagaaagacggcgacaaaaagaagaaaaagaaaauaaaagaaaaauacauugaccaggaggaacucaacaaaacgaaaccgauauggaccaggaacccggacgacaucacaaacgaagaauacggggaguucuacaaaucgcucacaaacgacugggaagaccaccuagcggucaaacacuucaguguggagggacaacuagaguucagagcacuccuguucgucccaaggcgagccccauucgaccuauucgaaaaccgcaaaaagaaaaacaacauaaaacucuacgucagaagagucuuuauaauggacaacugcgaggaacuaauccccgaauaccuaaauuucauccgaggggucguggacucugaagaccucccacuaaacaucucaagagaaaugcugcagcaaaguaagauccuaaaagugauccgcaaaaaccuaguaaagaaaugccuggaacuguucacggaacuggcggaggauaaagaaaacuacaaaaaguucuacgaacaauucuccaagaacauuaaacuggggauccacgaagacucccaaaacagaaagaaacugagcgaacuccugcgauacuacaccagcgcguccggagacgagauggucagccuaaaggacuacugcaccagaaugaaagaaaaccaaaaacacaucuacuauauaacaggggaaaccaaggaccaagucgcaaacagcgccuuuguagagcgccugagaaaacacggacucgaagucauauacaugauagaaccaaucgacgaauacugcguacagcagcugaaggaguucgaaggaaaaacgcuaguaucgguaacgaaagagggacuagagcuacccgaagacgaggaagagaaaaagaaacaagaagaaaagaaaaccaaauucgagaaccucugcaaaauaaugaaagacauccuagaaaagaaaguagaaaaagucguagugucaaaccgccucgucacgagcccauguugcauagucacgucaaccuacggauggacagccaacauggagaggauaaugaaagcccaagcccuacgagacaacucaacaaugggauacauggccgccaagaaacaccuagaaauaaaccccgaccauucgauaauagagacucuccgacaaaaagccgaggccgacaagaacgacaagagcguaaaagaccugguaauccuccucuacgaaacggcccuccuaucaagcggguucagccuagaagacccacaaacccacgccaaccgcaucuacagaaugauaaaacuaggacucggaaucgacgaagacgacccgaccgcggacgacaccucagcagcgguaacagaggaaaugcccccacuagaaggggacgacgacacgagcagaauggaggaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3399 - RNA, 721 nt, Artificial Sequence
  mRNA product Design2 comprising derived and/or modified sequence from Homo sapiens__NG_005218__HsHSP90AA3P (opt8)
ggggcgcugccuacggagguggcagccaucuccuucucggcaucaagcuuaccauggacuccucaaaacuagacuccggcaaaggacuccacaucaaccucguccccaacaaacaaaaccaaacacucaccauaguagacacacgcaucggcaugaccaaaacagaccucaucaacaaccucggcaccgucaccaaauccggaacaaaagccuucauggaagcacuccaagccgacgcagacaucuccaugaucggacacuucggcgucggcuucuacucagcauaccucgucgccaaaaaagucaccguaaucucaaaacacaacaacgacgaacaauacaccugggaauccuccgcaggcggcuccuucaccguacgaacagacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3400 - RNA, 2557 nt, Artificial Sequence
  mRNA product Design2 comprising derived and/or modified sequence from Homo sapiens__NP_031381.2__HsHSP90AB1 (opt8)
ggggcgcugccuacggagguggcagccaucuccuucucggcaucaagcuuaccaugcccgaagagguacaccauggugaagaggaagucgagaccuucgccuuccaagccgaaauagcacaauuaaugagccugauaaucaacaccuucuacucgaacaaagaaaucuuccugcgcgaacucaucucgaacgcaagcgacgcccuagacaagauaagauacgaaucacugacagaccccagcaagcuagacucagggaaggagcucaaaaucgacaucauuccaaacccccaagaacggacacuaacccugguggacacagggaucgggaugaccaaggccgaccugauaaacaaccucgggacaaucgccaaaagcggcaccaaagcguuuauggaggcccuacaagccggagccgacaucagcaugaucgggcaauucggcgucggauucuacagcgccuaucuaguagcggaaaaaguaguagugaucacaaaacacaacgacgacgaacaauacgccugggaaagcagugcaggaggcagcuucacggugcgagccgaucacggagaacccauaggacggggcaccaaggugauacugcaccucaaagaagaccaaaccgaauaccuggaagaacgacgaguaaaggaggucguaaagaagcacagccaauucauaggcuacccaauaaccuuguaccuagagaaagaacgggaaaaagagauaagugacgacgaagcugaagaagaaaaaggcgaaaaagaagaagaagacaaagacgacgaagaaaagcccaaaaucgaggacguaggcagcgacgaagaagacgacagcggaaaagacaagaaaaagaaaacaaagaaaauaaaagagaaguacaucgaccaagaagaacucaacaaaacgaagcccauauggacaagaaauccagacgauaucacgcaagaagaauacggagaguucuauaagagucuaaccaacgacugggaagaccaccuagcggucaaacacuucagcgucgaaggacagcuagaguuccgagcccugcuauucaucccccgaagggcacccuucgaccuauuugaaaacaaaaagaagaaaaacaacauuaaacucuacguacgccgcgucuucauaauggacagcugcgacgaacuaauaccagaauaccugaacuucauccgcggagucgucgacagcgaagaccuaccacugaacauaucacgagaaaugcugcaacaaagcaaaauccucaaagucauacgcaaaaacaucguaaagaaaugccuugaacuauuuucggaacuggcagaagacaaagaaaauuacaagaaauucuacgaagccuucagcaaaaaccucaaacugggaauccacgaagacuccacaaaccgaagaagacuaagcgaacuccuaagauaccacaccagucaaagcggcgacgaaaugacaagccucucagaauacgugucccgaaugaaagaaacccagaaaagcaucuacuacaucacgggcgaaagcaaagaacaaguagcaaacagugcuuucguagaacgggugagaaagcgaggauucgaagucguguauaugaccgaaccaaucgacgaauacugcguacaacaacuaaaagaguucgauggcaagucccucguaucagucacgaaagaaggccuagaacugccggaagacgaagaagagaaaaagaaaauggaagaaagcaaagcaaaauucgaaaaccugugcaaacucaugaaagaaauacucgacaagaaagucgaaaaaguaacaauaagcaaccggcuagugagcagcccaugcugcaucgucacaagcacauacggcuggacggcgaacauggaaagaauaaugaaagcacaagcccuacgagacaacagcacgaugggauacaugauggcaaagaagcaccuagaaaucaacccagaccacccaaucguggaaacacuccgacaaaaagccgaagcagacaagaacgacaaggccguaaaagaucuagugguacuacuguucgaaaccgcgcuacucagcucaggauucagccucgaggacccacaaacccacucgaacaggaucuacagaaugaucaaacuaggccugggaauagacgaagacgaagucgccgccgaagaacccaacgcggcagucccagacgaaaucccaccauuggagggagacgaagacgcaagcaggauggaggaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3401 - RNA, 2794 nt, Artificial Sequence
  mRNA product Design2 comprising derived and/or modified sequence from Homo sapiens__NP_003290.1__HsHSP90B1 (opt8)
ggggcgcugccuacggagguggcagccaucuccuucucggcaucaagcuuaccaugagggcguuauggguccuagggcugugcugcguccuccugacguucggcagcgucagagcagacgacgaaguggacguagacggcaccguagaagaagaccugggaaaauccagagaggguagcagaaccgacgaugaagucgugcagcgagaggaagaagccauccaacucgacgggcugaacgcgucacagauacgggaacuacgagagaaaagcgaaaaauucgccuuccaagcagaagucaaccgaaugaugaaguuaaucauaaacucacuauacaaaaauaaagaaauauuccucagagaacugauaagcaacgcgagugacgcacuagacaaaaucagacucaucagccucaccgacgaaaacgcccuuagugggaacgaagaacuaacagucaaaaucaaaugcgacaaggaaaagaaccuacuacacguaacagacacggguguaggaaugacccgggaggaacucgucaaaaaccucggcaccauagcgaaaagcggaacaucagaguuccucaacaaaaugacagaggcccaggaagacggacaaagcaccagcgaacugaucgggcaauucggaguaggauucuacagcgcguuccucguggcagauaaggucaucgucaccucaaaacacaacaacgacacccagcacauaugggagagcgacagcaacgaguucuccguaaucgcggacccccgcgggaacacgcucggccgcggaaccacaaucacacucguacucaaagaagaagcaagcgacuaccuagagcucgauacaauaaagaaccuggugaaaaaguacagccaguucaucaacuucccaaucuacguauggagcagcaaaacugagacgguagaagaaccaauggaagaagaggaagcagccaaagaagaaaaagaagagucggacgacgaggcagcgguagaagaagaagaagaagagaagaaaccgaaaaccaagaaaguagagaaaacgguaugggauugggaacuaaugaacgacaucaaacccauauggcagcgccccagcaaagaagucgaagaagacgaauacaaggcauucuacaagagcuucagcaaagaaagugacgacccgauggccuacauacacuucaccgcagaaggggaaguaacauucaagagcauacuauucgucccaaccucagcgccgcgaggacucuucgacgaguacgggagcaagaaaagcgacuacaucaaacuguacguaagacgcguauucauaaccgacgacuuccacgacaugaugcccaaauaccuaaacuuugugaaagggguaguagacagcgacgaccuaccccuaaacguguccagagaaacccuccagcagcacaaacuccugaagguaauaaggaagaaacuggugcggaaaacacuagacaugauaaagaaaauagccgacgacaaguacaacgacaccuucuggaaggaguucggcaccaacauaaaacuaggggugaucgaagaccauagcaaccggacccgacucgcaaaacuccuaagauuccaaucaagccaccaccccaccgacauaacgagccucgaccaguacguggaaaggaugaaggaaaagcaagauaaaaucuacuuuauggcgggcuccucccgaaaagaagcagaaagcucacccuucguagagcgacuacucaagaaaggguacgaaguuauauaccugacagaaccuguggacgaauacugcauacaagcacugccggaguucgauggcaaacgcuuccaaaacguggcaaaagaaggcguaaaauucgacgaaagcgagaaaacgaaagaaucacgcgaagcaguagaaaaagaguucgaaccccuacucaauuggaugaaagacaaagcauuaaaagacaaaauagaaaaagcaguagugagccaacgcuugaccgaaagcccgugugcccucguagcaagccaguacggcuggagcgggaacauggagagaaucaugaaagcgcaggcguaccaaacaggaaaagacauauccaccaacuacuacgcuucacaaaagaaaaccuucgaaauaaacccaagacauccgcuaauccgcgacaugcugcgacgaauaaaggaggacgaagacgacaagacaguacucgaccucgcagucguccucuucgaaaccgcaacgcuacggucaggcuaccugcucccagacacgaaagcauacggagacaggauagagaggaugcucagacuaagccuaaacauagacccggacgccaagguagaagaagaaccagaggaagaaccggaagaaacggcagaagacaccacagaggacacagagcaagacgaggacgaggaaauggacguaggaacugaugaagaagaagaaacggccaaagaaucgacagcagaaaaggacgaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3402 - RNA, 2497 nt, Artificial Sequence
  mRNA product Design2 comprising derived and/or modified sequence from Homo sapiens__NP_057376.2__HsTRAP1 (opt8)
ggggcgcugccuacggagguggcagccaucuccuucucggcaucaagcuuaccauggcacgagaacuaagggcccuccuccuuuggggccgacgccuccgcccgcuacuucgcgcgccagcacuggcagcugucccaggaggcaaacccauccuaugcccccgccgaacaaccgcacagcucggucccagacgcaacccagcuuggucccuucaagcaggccgccucuucuccacucaaacagcagaagacaaagaagaaccacuccacagcauaaucucaucaaccgaaucaguacaaggcucaacaucuaaacacgaguuccaagccgaaacuaagaaacugcucgacauaguggccagaucccuauacuccgaaaaagaagucuucauccgcgaauugaucucaaacgcauccgacgcacucgaaaaacuacgacacaaacucgucuccgacggccaagcccucccagaaauggaaauccaucugcaaacuaacgccgaaaaaggcaccauaacaauccaggacacaggcaucggcaugacccaagaggaacuugucuccaaccucggaacaaucgcccgcagcggauccaaagcauuccucgacgcccuacaaaaccaagcagaagcaagcuccaaaaucaucggacaauucggagucggcuucuacucagccuucauggucgccgaccgcgucgaaguguacucacgcucagcugcacccggaagucuaggcuaucaauggcuaucagacggaagcggggucuucgaaaucgcagaagccucuggcgugcgcacaggcaccaaaaucaucauccaccugaaauccgacugcaaagaguucucgagcgaagcacgagucagggacguuguaaccaaauacucaaacuucguauccuuuccacuauaccucaauggccgucgaaugaacacccuccaagcaaucuggaugauggacccuaaagacguaagagaauggcaacacgaagaguucuaccgcuacguugcccaagcucacgacaaaccacguuacacccugcacuacaaaaccgacgcaccccugaauauccgaagcauuuucuacguccccgacaugaaacccucuauguucgacguaucccgcgaacucggcuccucagucgcccuauacucccgcaaaguccuuauacaaaccaaagccaccgacauacucccaaaauggcuccgcuuuauacgaggagucgucgacucagaagacaucccgcucaaccugagccgagaacuacuccaagaauccgcccucauucgcaaacugcgugacguccuccaacaacgccucaucaaauucuucaucgaccaaucaaagaaagacgccgaaaaauacgcuaaauucuucgaagacuacggccuauucaugcgcgaaggaaucgugaccgccacagaacaagaggucaaagaagacauagccaaacuccuaagauacgaauccuccgcacugcccucgggacaauuaaccucacuauccgaauacgcaagccguaugcgcgccgggacccgcaacaucuacuaccucugcgcccccaaccgacaccuggcagagcacuccccauacuacgaggcaaugaaaaagaaagacaccgaaguccuuuucugcuucgaacaauucgacgaacuaacccucuuacaccuaagggaguucgacaaaaagaaacucaucucaguggaaacggacaucguagucgaccacuacaaagaagaaaaauucgaagaccgcucaccagccgcagaaugucuauccgaaaaagaaacagaagaacucauggccuggaugcgcaacguccuaggcagucgcgucacaaacgucaaaguaacccuuagacuugacacccaucccgccaugguaacaguccucgaaaugggagccgcacgccacuuccuaagaaugcagcaacuagccaaaacacaagaagaaagagcccaacuccuacaaccuacacuagaaaucaacccccgccacgcacucaucaagaaacuaaaccaacuacgcgcaagcgaaccaggccuagcgcaacuccuaguagaccaaaucuacgaaaacgccaugauagcagcaggccuaguagacgacccccgcgccauggucggccgccucaacgaacuccuaguaaaagcccucgaaagacacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3403 - RNA, 844 nt, Artificial Sequence
  mRNA product Design2 comprising derived and/or modified sequence from Homo sapiens__NP_000609.1__HsIGF1 (opt8)
ggggcgcugccuacggagguggcagccaucuccuucucggcaucaagcuuaccaugggcaaaaucuccucacuccccacacaacuauucaaaugcugcuucugcgacuuccucaaagucaaaaugcacacaauguccuccucacaccucuucuaccuagcccucugccuacucaccuucacaucaucagccacagccggcccugaaaccuuaugcggagccgaacucguagacgcccuccaauucgucugcggagaccgaggcuucuacuucaacaaacccaccgguuacggaucaucaucccgccgcgccccacaaacaggcaucgucgacgaaugcugcuuccgcucaugcgaccuccgaagacuagaaauguacugcgcaccccucaaacccgccaaauccgcccgcuccguccgagcccaacgccacacagacaugcccaaaacacaaaaagaaguccaccucaaaaacgccucccgaggauccgccggcaacaaaaacuaccgcauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3404 - RNA, 925 nt, Artificial Sequence
  mRNA product Design2 comprising derived and/or modified sequence from Homo sapiens__NP_000603.1__HsIGF2 (opt8)
ggggcgcugccuacggagguggcagccaucuccuucucggcaucaagcuuaccaugggcauaccaaugggcaaauccaugcuaguacuccuaaccuuccuugccuucgcauccugcugcauagccgccuaccgacccuccgaaacacucugcggcggcgaauuagucgacacccuacaauucgucugcggcgaccgcggcuucuacuucucccgaccagccucccgcgucuccagacgcucacgcggcaucguagaagaaugcugcuuccgaucaugcgaccucgcccuccucgaaaccuacugcgccacccccgcaaaaucagaacgagacgucucaaccccacccaccguccuccccgacaacuuccccagauaccccguaggcaaauucuuccaauacgacaccuggaaacaauccacccaaagacuuagacgcggccuccccgcccuacuccgagcccgccgcggacacguacucgccaaagaacucgaagccuuccgcgaagccaaacgccaccgcccacucaucgcccuacccacacaagaccccgcccacggcggcgcacccccagaaauggccucaaaccgaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3405 - RNA, 1021 nt, Artificial Sequence
  mRNA product Design2 comprising derived and/or modified sequence from Homo sapiens__NP_000591.1__HsIL6 (opt8)
ggggcgcugccuacggagguggcagccaucuccuucucggcaucaagcuuaccaugaacuccuucuccacaucagccuucggccccgucgccuucucccucggacuccuccuuguccucccagccgccuuccccgccccagucccccccggcgaagacucaaaagacguagccgccccccaccgacaaccccuuaccuccuccgaacgcaucgacaaacaaauacgauacauccuagacggcaucucagcccuccgcaaagaaaccugcaacaaauccaacaugugcgaaucuuccaaagaagcccuagccgaaaacaaccucaaccuccccaaaauggccgaaaaagacggcugcuuccaaucaggauucaacgaagaaaccugccuugucaaaaucaucaccggccuccucgaauucgaagucuaccucgaauaccuccaaaaccgcuucgaaucauccgaagaacaagcccgcgccguccaaaugucaacaaaaguccucauacaauuccuccaaaaaaaagccaaaaaccucgacgccauaaccacccccgaccccaccaccaacgccucacuacuaaccaaacuccaagcccaaaaccaauggcuacaagacaugaccacccaccucauccuccgcuccuucaaagaauuccuacaaagcucccuccgcgcccuacgccaaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3406 - RNA, 1663 nt, Artificial Sequence
  mRNA product Design2 comprising derived and/or modified sequence from Homo sapiens__NP_002183.1__HsINHBA (opt8)
ggggcgcugccuacggagguggcagccaucuccuucucggcaucaagcuuaccaugccacuacuauggcuccgcggcuuccuacuggccucaugcuggaucaucguacgcagcagccccacaccaggaagcgagggacacagcgcagccccagacugcccaagcugcgcccuagcggcccugccaaaagacguacccaacagccaacccgaaaugguagaagccgucaaaaaacacauacuaaacaugcuacaccuaaaaaaaaggccagacguaacacaacccgucccaaaagcagcacuacucaacgcaauccgcaaacuccacgucgggaaagucggagaaaacggauacguagagauagaagacgacaucgggcgccgcgccgaaaugaacgaacucauggaacaaaccucagagauaaucacguucgccgaaagcggaacagcccgcaaaacacuacacuucgaaauaagcaaagaaggcagcgaccuaagcgucgucgagcgcgcagaagucuggcucuuccucaaaguacccaaagcaaaccgcacacgaacaaaagucacaauacgacuguuccagcaacaaaagcacccacaaggcucccucgacacaggcgaagaagcagaagaaguaggccuaaaaggagaacggagcgaacuacuccuaucagaaaaagucguagacgcacgcaaaagcacguggcacgucuucccaguaagcagcagcauacaacgacuacucgaccaaggcaaaagcagccucgacgucagaauagcaugcgaacaaugccaagaaucaggcgccucccucguccuacugggaaaaaaaaagaaaaaagaagaagaaggcgaaggaaagaaaaaaggcgguggagaaggaggcgcaggagcggacgaggaaaaagaacaaucccaccgcccauuucuaaugcugcaagcacggcaaucagaagaccacccccaccgccgccgacgacgaggacuagaaugcgacggaaaagucaacaucugcugcaaaaaacaauucuucgucagcuucaaagacauaggauggaacgacuggauaauagcgccaagcggauaccacgcaaacuacugcgaaggcgaaugccccagccacauagcaggcacaagcgggagcagccugucguuccacagcaccgugaucaaccacuacagaaugagaggacacuccccauucgcaaaccugaaaucgugcugcguccccaccaaacuacgaccgaugagcaugcucuacuacgacgacggacagaacaucauaaaaaaagacauacaaaauaugaucguggaagagugcggaugcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3407 - RNA, 1606 nt, Artificial Sequence
  mRNA product Design2 comprising derived and/or modified sequence from Homo sapiens__NP_002184.2__HsINHBB (opt8)
ggggcgcugccuacggagguggcagccaucuccuucucggcaucaagcuuaccauggacggccugccaggccgagcguuaggcgccgccugccuccuacuccuagcagcaggcuggcucggccccgaagccuggggaucaccaaccccaccaccaacccccgcagccccucccccacccccaccacccggcagucccggcggaucacaagauaccugcaccucaugcggcggauuccgcagaccagaagaacucggacgcguagacggagacuuccucgaagccguaaaaagacacauacuaucccgccuccaaaugcgcggccgacccaacaucacacacgccguccccaaagccgccauggucaccgcccuacgcaaacuacacgccggcaaaguucgcgaggacggccgagucgaaaucccacaccucgacggccacgccucccccggcgcagacggacaagaacgaguuagcgaaaucaucuccuuugccgaaacagacggccuagccucaucacgaguccgacucuacuuuuucaucuccaacgaaggaaaccaaaaccucuucgucguacaagcaucccuauggcuauaccuaaaacuccuacccuacgucuuagaaaaaggaucccgccgcaaaguccgcgucaaagucuacuuccaagaacagggccacggcgaccgcuggaacauggucgaaaaacgcguagaccucaaacgcuccggcuggcacaccuucccccuaaccgaagccauccaagcccucuucgaacgcggcgaacgacgccuaaaccucgacguacagugcgacucaugccaagaacucgccguaguacccguauucgucgacccaggggaagaaagccacagaccauucgucgucguccaagccagacucggcgacucccgacaccgcauacgcaaacgaggccucgaaugcgacggccgcacaaaccucuguugccgccaacaauucuucaucgacuuccgccuaaucgguuggaacgacuggauuauagccccaacaggauacuacggcaacuacugcgaagggucaugccccgccuaccuagccggaguccccggcucugccagcucauuccacacagcagucgugaaccaauaccgcaugcgaggccuaaaccccggcaccguaaacucuugcugcauccccacaaaauuaucaaccauguccaugcuuuacuucgacgacgaauacaacauagucaaacgcgacguccccaacaugauaguagaagaaugcggcugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3408 - RNA, 3841 nt, Artificial Sequence
  mRNA product Design2 comprising derived and/or modified sequence from Homo sapiens__NP_000623.2__HsITGAM (opt8)
ggggcgcugccuacggagguggcagccaucuccuucucggcaucaagcuuaccauggcacuucgcguccuccuccuuaccgcccuaacccuaugucauggauucaaccucgacaccgaaaaugccaugaccuuucaagaaaacgcccgcggauucggccagucuguaguacagcuccaaggaucuagaguagucgucggugccccucaagaaaucguagcagcaaaccaacgcgguagucuauaccaaugugacuacucuacuggcucgugcgaaccuaucaggcuccaaguccccguggaagccgucaacauguccuuaggacuaucacuggccgccaccaccuccccaccgcaacuccuagccugcggacccaccguacaccaaacauguagcgaaaacacguacgucaaaggacucuguuuucucuucggcagcaaccuacgccaacaaccccaaaaauucccugaagcccucagaggcugcccacaagaagacuccgacauagccuuccucaucgacggauccggcuccauuauaccccacgacuuccggaggaugaaagaauuugucucgacgguaauggagcaacucaagaaaucaaaaacacuguucagccuaaugcaauacucggaggaguuccgaauccacuucaccuucaaagaguuccaaaacaaccccaacccccguagccuuguuaaacccauaacccaacuacugggccgaacacacaccgccaccggcauccgcaaagucguccgcgaacuauucaacauaaccaacggcgcacgcaaaaaugcuuucaagauacuuguaguaaucacagacggagaaaaauucggagacccauugggauacgaagacgucauuccugaagccgaccgagaaggcguaaucagauacgugauagguguaggcgacgcauucagaucagaaaaaucacgccaagaacuaaacacaauagccuccaagccaccccgagaccaugucuuccagguaaacaauuucgaggcacuuaaaacuauucagaaccagcuccgugagaaaaucuucgccaucgaaggaacucagacaggauccuccucgucuuucgaacaugagaugagccaagaaggcuucagcgcugccaucaccucuaacggacccuugcuaucuacagucggcuccuacgacugggccggcggcguguuccucuacaccuccaaagaaaaauccacguucauaaacaugacacgagucgacucggacaugaaugacgcguaccuugguuaugcugccgcaauuauacuuagaaaccgugugcaaucccuuguacucggcgcucccagauaucaacacaucggccucgucgcuauguuucgucaaaauaccgggaugugggaauccaacgccaaugucaaaggcacccaaaucggcgccuacuucggcgcgagccuaugcucagucgacgucgacucaaacggauccaccgaucuaguccugaucggagcaccacacuauuacgaacaaaccagaggcggccagguaucagucugcccacucccccgaggccgcgcccgcuggcaaugcgacgccguccuuuacggcgagcagggccagccuuggggacgauucggagccgcccucaccguacucggugacguuaacggagauaaacuaacagacgucgcaaucggcgcccccggagaagaagacaacagaggagcggucuaccucuuucacggaaccuccgggagcggaaucagcccgucccauucccagcgcauugcagguagcaaacucaguccccgccuccaguacuucggccaaucccuguccggcggccaagaccuuacaauggacggccuaguagaccucaccgucggugcucagggccauguccugcuucuacgcucucaaccagucuuacgaguaaaagcaauaauggaguucaacccacgcgaagucgcccgcaacgucuucgaaugcaacgaccaggucguaaaaggcaaagaagccggagaaguccguguaugccugcacguacaaaaguccacccgcgaccgccuacgggaaggccaaauacagucugucgucacuuaugaccucgcucucgacuccggaagaccgcacucucgggccgucuuuaacgaaaccaaaaacucaacacgacgacaaacacaggugcucggccugacgcagacaugcgagacgcucaaauugcagcuaccaaacugcaucgaagacccaguaagcccuauuguccuucgccuaaacuucagccucguggggacaccacuaagcgccuucggcaaccuacgcccgguacucgcggaagacgcccagcgccucuucaccgcccuuuuucccuucgagaaaaacugcggcaacgauaacaucugccaagacgaucugucgaucaccuucagcuucaugucccucgacugucucguagucggaggcccccgugaguucaacguaaccguaaccguccgcaacgacggagaagacagcuaccgcacucaggucaccuuuuucuucccccucgaccugucuuacagaaaaguaucaacacuccaaaaccaacgaucccaacguucauggcgacuagccugcgaauccgccagcuccacugaagucagcggcgcccucaaaagcacguccugcucgaucaaccaccccauauuccccgagaacucagaagucacauucaacaucacauucgacguagauucaaaggcuucacucggaaauaaacugcuucucaaagccaacgucaccucagaaaauaauaugccccguacuaacaaaaccgaguuucaacuagaacucccggucaaauacgccgucuacaugguaguaaccucucacggaguauccaccaaguaccucaacuucacugcauccgaaaacacuucucgcgucaugcagcaccaauaucaagucuccaaccucggucaacguucacugcccaucucccuaguauuccuggucccaguacgccuaaaccagaccgucauaugggacagaccccaagucaccuucucagaaaaccuuagcucuaccugccauacaaaggaaagauuacccucacacuccgacuuucucgcagagcucaggaaagcccccguagucaacugcucgauagcaguaugccaacgaauacaaugcgauaucccauucuuuggcauccaggaagaguucaacgccacccugaaggguaaccucucauucgacugguacauaaagacaucacauaaccaucuacuuauagucagcacagccgaaauccuguucaacgacucaguguucacccuccugcccggccaaggagccuucguacgcucacaaaccgaaacaaaaguugaaccuuucgaaguucccaacccccuuccgcucauagucggcuccucagucggaggccuccuccuacucgcccuaauaaccgcagccuuguacaaacucggauucuucaaacgccaguacaaagacaugaugucagaaggagguccucccggcgcagaaccacaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3409 - RNA, 1786 nt, Artificial Sequence
  mRNA product Design2 comprising derived and/or modified sequence from Homo sapiens__NP_002415.1__HsMMP8 (opt8)
ggggcgcugccuacggagguggcagccaucuccuucucggcaucaagcuuaccauguucucacuaaaaacccuacccuuucuccuacuccuucacguccagauaucaaaagccuuccccgucuccucuaaagagaaaaacaccaaaaccgugcaagacuaccucgaaaaauucuaccaacucccguccaaccaauaccaaucaacacgcaaaaacggcacuaacguaaucgucgaaaaauugaaagaaaugcaacgauucuucggccucaacgucaccggcaaacccaacgaagaaacccucgacaugaugaagaaaccccgaugcggaguacccgacucuggcggcuucaugcucacucccggcaaucccaaaugggaacgcacuaaccucaccuaccgcaucagaaauuacacaccccaacucucagaagccgaagucgaaagagcgauuaaagacgcauucgaacuaugguccgucgccagcccccuaaucuucacccgcaucucccaaggugaagccgacaucaacauagcauucuaccaacgcgaccacggugacaacuccccauucgacggcccaaacggcauacuugcccacgcauuccaacccggucaaggaaucggaggcgacgcccacuucgacgccgaagaaaccuggaccaacacauccgcaaacuacaaccuauuccucguugccgcccacgaguucggccacucccuaggcuuagcacacuccuccgauccaggugcccuaauguauccaaacuacgccuuccgcgaaaccuccaauuacucccuaccccaagaugacaucgacggaauccaagcaaucuacggacucucauccaaccccauccaacccaccgguccaucaaccccaaaacccugcgaccccucccucaccuucgacgcaaucaccacucucagaggugaaauccucuucuucaaagaccguuacuucuggcgaagacacccacaacuccaacgcgucgaaaugaacuuuauuucacucuucuggcccucgcuucccaccggcauccaggccgcauacgaagacuucgaccgcgaccuaaucuuccucuucaaagguaaccaauacugggcacuaucaggcuacgacauccuucaaggcuaccccaaagacauauccaacuacggcuucccauccuccguccaggcaaucgacgcugcagucuucuauagauccaaaaccuacuucuucgucaacgaccaauucuggcgauacgacaaccaacgacaauucauggaacccggcuaccccaaaucaaucuccggcgcuuuccccggcaucgaauccaaagucgacgccguuuuccaacaagaacacuucuuccacgucuucuccgggccacgauacuacgccuucgaccucaucgcccaacgcgucacccgaguagcacgcggcaacaaauggcuuaacugccguuacggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3410 - RNA, 2506 nt, Artificial Sequence
  mRNA product Design2 comprising derived and/or modified sequence from Homo sapiens__NP_004985.2__HsMMP9 (opt8)
ggggcgcugccuacggagguggcagccaucuccuucucggcaucaagcuuaccaugucccucuggcaaccccuaguucuaguccuccucguacuuggaugcugcuucgcagcaccccgacaacgccaauccacccuaguccucuucccuggcgaucuucgaacaaaccugaccgaccgccaacucgcggaagaauaucucuaccgcuacggcuacacacguguagccgaaaugcgcggagaauccaaaagccuagguccagcacuccuccuccuccaaaaacaacuuucacuccccgaaacgggcgaacucgacuccgccacccucaaagcaaugagaacaccacgcugcgggguacccgacuuagggagauuccaaacguucgaaggagaccuaaaguggcaccaccacaacauaacuuacuggauacaaaacuacagcgaggaccugccccgagcagucaucgacgacgccuucgcaagagccuucgcccuauggagcgccguaacaccccucaccuucacccguguauacucccgagacgccgacauugucauccaauucggcguagccgaacacggagacggcuacccauucgacggcaaagacggccuauuggcacacgcauuuccacccggcccaggaauacaaggcgacgcccacuuugacgaugacgaacucuggagccugggaaaaggagucguaguccccaccagauucggcaacgcagacggagcagcaugccacuuccccuuuauauucgaaggccgcucuuacagcgccugcacuaccgauggccgcuccgauggucuacccuggugcuccaccaccgccaacuacgacaccgaugaucgcuucgguuucuguccaucugaaagacucuacacccaggacggcaacgccgacggcaaacccugccaauuuccauucaucuuccaaggccaaucuuacuccgcaugcaccacagacggccgauccgauggauaucgcuggugcgccacaacugccaauuacgaccgagacaaacucuucggauucugcccaacccgagcagacucaaccguaaugggaggaaacucagccggcgaauuaugcguauuucccuucaccuuccucggaaaagaguacuccacgugcaccagcgaaggccgaggagacggacgacuauggugcgccaccacaucaaacuucgacuccgacaagaaauggggcuucugccccgaucaaggcuacucucuguucuuagucgccgcacacgaguucggacacgcccugggacuagaccacaguucaguccccgaagcgcucauguaccccauguaccgcuucacagaaggaccaccacuacacaaggacgacguaaacggcaucagacaccuauaugguccccgaccagaacccgaaccacgcccucccacuaccacuaccccacaaccaacugccccacccacaguauguccaacaggaccacccaccguacaccccuccgaacgccccaccgccggcccuaccggaccucccuccgcaggucccacaggaccacccacagccggccccuccaccgccaccacaguucccuuauccccugucgacgacgcaugcaacgucaacauauucgacgcuaucgccgaaaucggcaaucaacuauaccuguucaaggacggcaaauauuggcgcuucucagaaggccgaggcagccgcccucaagguccauuccucauugccgacaaauggcccgcccuccccagaaaacuugacuccgucuucgaagaacgucucuccaagaaauuauucuucuucucaggccgucaagucugggucuacaccggcgccagcguccucggccccagacgucuagacaaacuuggacucggagccgacgucgcucagguaaccggggcucugcgauccggacgcgggaagauguugcuauucagcggacgcagacuauggcgcuucgacgucaaagcccaaauggucgacccgagauccgccuccgaaguugaccguauguucccaggcgugccccucgacacccacgacguauuccaauaccgcgaaaaagcauacuucugccaggaccgcuuuuauuggcgagucucuucccgaucugaacuuaaccaagucgaccaaguaggauaugucaccuacgacauccuccagugccccgaggacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3411 - RNA, 1798 nt, Artificial Sequence
  mRNA product Design2 comprising derived and/or modified sequence from Homo sapiens__NP_002418.1__HsMMP13 (opt8)
ggggcgcugccuacggagguggcagccaucuccuucucggcaucaagcuuaccaugcacccaggcguccucgcagcuuuccucuuccucuccuggacacacugccgcgcauuaccccuccccucaggaggcgacgaagacgaccucuccgaagaggaccuccaauucgccgaacguuaccuccgcuccuacuaccacccgacaaaccucgcaggaauacucaaggaaaacgccgccuccuccaugaccgaacgccuuagagaaaugcagucauucuucggccuagaaguaaccggaaaacuagacgacaacacccuagacgucaugaaaaaaccccgaugcgguguccccgacgucggcgaauacaacgucuucccccgcacccuuaagugguccaaaaugaaccugaccuaucgcauagucaacuacacgccagacaugacccauuccgaagucgaaaaagcauucaaaaaagcguucaaaguaugguccgacgucaccccacuuaacuucacacgccuccacgacggaaucgcagacaucaugauaagcuucgguaucaaagaacacggcgacuucuaccccuucgacggcccaucaggccuacuagcccacgcauucccccccggcccgaauuacggcggcgacgcccacuuugacgaugacgaaaccuggacauccuccuccaaagguuacaaccuauuccuaguagccgcacacgaauucggccacucccucgggcuagaccacuccaaagaccccggagcccucauguuccccauauacacuuacaccggcaaaucccacuucaugcuacccgacgacgacguacaaggcauccaaucccuguacggcccaggcgacgaagacccaaaccccaaacaccccaaaacucccgacaaaugcgaccccucccucucccuagacgccaucaccucacuccgcggcgaaacaaugauauucaaagaccguuucuucuggcgccuccacccacaacaaguagaugcagaacucuuccuaacaaaauccuucuggcccgaacuaccaaaccgaaucgacgcugcauaugaacauccaucccacgaccucauuuucauauuucgaggccgaaaauucugggcacuaaacgguuacgacauccucgaaggcuaccccaaaaaaaucuccgaacuaggccuucccaaagaaguaaaaaaaaucucagccgccguccacuuugaagacaccggaaagacucuacuauucucaggcaaccaagucuggcgauacgacgacaccaaccacauaauggacaaagacuaccccaggcuaauagaagaagacuuuccaggcaucggagacaaaguagacgccguauacgagaaaaacggcuacaucuacuucuucaacggccccauacaauucgaguacuccaucugguccaaucgaaucguacgcgucaugcccgccaacucaauccucuggugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3412 - RNA, 1450 nt, Artificial Sequence
  mRNA product Design2 comprising derived and/or modified sequence from Homo sapiens__NP_001286.1__HsCCR1 (opt8)
ggggcgcugccuacggagguggcagccaucuccuucucggcaucaagcuuaccauggagacccccaacaccacagaagacuacgacaccaccaccgaauucgacuacggugacgccacccccugucaaaaagucaaugaacgcgccuucggcgcacaacuacuaccgccccucuacucgcucguuuucguaaucggccucgucggaaauauacucgucguccucguccuaguccaauacaaacgccucaaaaacaugacuucaaucuaccuccuuaaccuagccaucucugaccuccucuuccuauucacacucccauuuuggaucgauuacaaacucaaagacgacugggucuucggcgacgcaaugugcaaaauccuaucaggcuucuacuacaccggccuauauagcgaaaucuucuucauuauccuucucaccaucgaccgcuaccucgccauaguccacgcagucuucgccuugcgcgcacgcaccguaacuuuuggagucauaaccuccaucaucauuugggcucucgccauccucgccucaaugcccggccuauacuucuccaaaacacaaugggaauucacccaccauacuugcucccuccacuucccacacgagucccuaagagaauggaaacucuuucaagcacucaaauuaaaccucuuuggucucguucuuccccuccucgucaugauaauuugcuacaccggcaucaucaaaauccuccuccgccguccaaacgaaaaaaaauccaaagccguccgccuaaucuucguaauaaugaucaucuucuuccucuucuggacccccuacaaccucacaauccucaucuccgucuuccaagauuuccucuucacccacgaaugcgaacaaucucgucaccucgaccucgcuguccaagucacagaagucaucgcuuacacacacugcugcgucaaccccguaaucuacgcauucgucggugaacgauuccgcaaauaccuccgccaacucuuccaccgccgcguagccguccaccucgucaaauggcuucccuuccucuccgucgaccgacucgaacgcguaucuagcaccuccccuuccacaggagaacacgaacucuccgccggcuucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3413 - RNA, 1018 nt, Artificial Sequence
  mRNA product Design2 comprising derived and/or modified sequence from Homo sapiens__NP_002598.4__HsPDGFA (opt8)
ggggcgcugccuacggagguggcagccaucuccuucucggcaucaagcuuaccaugcgcacccucgccugccuccuccuccucggcugcggcuaccucgcccacguccucgccgaagaagccgagaucccacgcgaaguaaucgaacgccucgcccgcucccaaauacacuccauccgcgaccuccaacgccuccucgaaaucgacucaguaggcuccgaggacucacucgacaccucacuccgcgcccacggcguccacgccaccaaacacguccccgaaaaaagaccacucccaauccgacgaaaacgauccaucgaagaagccguccccgcagucugcaaaacccgcaccgucauauacgaaaucccacgaucccaagucgaccccaccuccgccaacuuccuaaucuggcccccaugcgucgaagucaaacgaugcaccggcugcugcaacacauccuccguaaaaugccaacccagccgcguccaccaccgcuccguaaaaguagcaaaagucgaauacguacgcaaaaaacccaaacuaaaagaaguccaaguccgccucgaagaacaccuagaaugcgcaugcgcaacaacaucccuaaaccccgacuaccgcgaagaagacaccggccgaccacgagaauccggcaaaaaacgcaaacgcaaacgccucaaaccaacauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3414 - RNA, 1108 nt, Artificial Sequence
  mRNA product Design2 comprising derived and/or modified sequence from Homo sapiens__NP_002599.1__HsPDGFB (opt8)
ggggcgcugccuacggagguggcagccaucuccuucucggcaucaagcuuaccaugaaccgaugcugggcacucuuccuaucccucugcugcuaccuacgccuagucucagccgaaggcgaccccauccccgaagaacucuacgaaaugcucagcgaccacuccauccgaagcuucgacgaccuucaacgccuacuccacggcgaccccggcgaagaagacggagccgaacucgaccuaaacaugacccgcucccacuccggcggagaacucgaaucacucgcacgcggacgcagaucccucggcucccucaccaucgccgaaccagccaugauagcagaaugcaaaacccgaacagaagucuucgaaaucucacgccgccucauagaccgaaccaacgccaacuuccucgucuggcccccaugcgucgaaguccaaagaugcuccggcugcugcaacaaccgcaacguccaaugccgcccaacccaaguccaacuccgcccaguccaaguacgcaaaaucgaaaucguacgcaaaaaaccaaucuucaaaaaagccaccgucacccuagaagaccaccucgccugcaaaugcgaaaccguagccgcagcccgacccguaacacgcucucccggcggcagccaagaacaacgagcaaaaacaccccaaacacgcgucacaaucaggaccguccgcguccgcagacccccaaaaggcaaacaccgcaaauucaaacacacccacgacaaaaccgcacucaaagaaacccuaggcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3415 - RNA, 1420 nt, Artificial Sequence
  mRNA product Design2 comprising derived and/or modified sequence from Homo sapiens__NP_057289.1__HsPDGFC (opt8)
ggggcgcugccuacggagguggcagccaucuccuucucggcaucaagcuuaccaugucccucuucggccuccuccuccucaccucagcccuagcaggccaacgccaaggcacccaagccgaauccaaccucuccuccaaauuccaauucucauccaacaaagaacaaaacggcguacaagacccgcaacaugaacgcauaaucaccguauccaccaacggcagcauccacuccccaagguucccccauaccuacccccgcaacaccguccuagucuggcgccuugucgccgucgaagaaaacgucuggauccaacugacauucgacgaacgcuucggccucgaagaccccgaagacgacaucugcaaauacgauuucgucgaaguagaagaaccuuccgauggcaccauccucggccgcuggugcggaagcggcaccguccccggcaaacaaaucucaaaaggcaaccaaauacgcauccgauucgucuccgacgaauacuucccaucagaacccggauucugcauacacuacaacaucgucaugccacaauucaccgaagccgucucacccuccguccuaccccccucagcccucccccucgaccuacucaacaacgccauaacagccuuuuccacccucgaagaccucauccgauaccucgaaccagaacgauggcagcucgaccuagaagaccucuaccgccccaccuggcaacucuuaggcaaagccuucgucuucggccgcaaaucgcgcguaguugaccuuaaccuccuaaccgaagaaguacgccucuacagcugcaccccacgcaacuucuccguaucaauccgcgaagaacucaaacguaccgacaccauauucuggcccggaugccuccuagucaaaagaugcggcggaaacugcgccugcugccuccauaacugcaacgaaugccaaugcguacccuccaaaguaaccaaaaaauaccacgaaguccuucaacuccgcccaaaaacaggcguacguggccuccauaaaucacuuaccgacgucgcccucgaacaccacgaagaaugugacugcgucugucgcggauccaccggaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3416 - RNA, 1477 nt, Artificial Sequence
  mRNA product Design2 comprising derived and/or modified sequence from Homo sapiens__NP_149126.1__HsPDGFD (opt8)
ggggcgcugccuacggagguggcagccaucuccuucucggcaucaagcuuaccaugcaccgccucaucuucgucuacacccuaaucugcgccaauuucugcucaugccgcgacaccucugccacaccgcaaagcgcuucaaucaaagcacuccggaacgccaaccugcgacgagacgaccucuaccgccgcgacgaaaccauccaagucaaaggaaacggcuacguacaaagcccccgauucccaaacuccuacccccgcaaccuccuacucaccuggagacuacacucccaagaaaacacccgaauacaacucguauucgacaaccaauucggacuagaagaagcugaaaacgacaucugccgauacgacuucguagaagucgaagacauaagcgaaacauccacaaucaucagaggccgcuggugcggccacaaagaaguaccaccccgcaucaaaucccgcacaaaccaaaucaagauaaccuucaaaucagacgacuacuucgucgccaaacccggauucaaaaucuacuacucccuccuagaagacuuccaacccgccgccgccuccgaaacaaacugggaaucagucaccucaagcaucucagguguaucauacaacucccccuccgucaccgaccccacacucauagcagacgcccucgacaagaaaauagcugaauuugacaccgucgaagaccuccucaaauacuucaaccccgaauccuggcaagaagaccucgaaaacauguaccuggauacaccacgcuacagaggccgaucauaccacgaccgaaaaaguaaagucgaccuugaccgccucaacgacgacgccaaacgcuauagcugcaccccucgaaacuacuccgucaacauccgagaagaacuaaaacucgcaaacgucguauucuucccacguugccuccuuguccagcgaugcggaggcaacugcggcugcggcaccgucaacuggcggagcugcacaugcaacuccggcaaaaccguaaagaaauaccacgaaguacuccaauucgaaccaggucacaucaaacgucgcggcagagcuaaaaccauggcauuagucgacauacaacuagaccaccacgaacgaugcgacugcaucugcagcucacgacccccacgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3417 - RNA, 1060 nt, Artificial Sequence
  mRNA product Design2 comprising derived and/or modified sequence from Homo sapiens__NP_003946.3__HsSOCS3 (opt8)
ggggcgcugccuacggagguggcagccaucuccuucucggcaucaagcuuaccauggucacacacuccaaauuccccgccgccggcaugucccgacccuuagacaccuccuuacgccuaaaaaccuucuccuccaaauccgaauaccaacucguagucaacgcaguacgcaaacuccaagaauccggauucuacuggucagccguaaccggcggcgaagccaaccuccuccuauccgccgaaccagccggcaccuuccuaauucgcgacucauccgaccaacgccacuucuucacccucuccgucaaaacccaauccggcacaaaaaaccuccgcauccaaugcgaaggcggaucauucuccuuacaauccgacccccgcuccacccaaccagucccccgauucgacugcguacucaaacucguccaccacuacaugccaccccccggcgcccccuccuucccuucaccccccaccgaacccuccuccgaagucccugaacaacccucagcccaacccuuacccggcucccccccacgccgcgcauacuacaucuacucaggcggcgaaaaaaucccacucguccucucccgcccccucuccuccaauguagccacacuccaacaccucugccgcaaaaccgucaacggccaccuagacuccuacgaaaaaguaacccaacuccccggacccauacgcgaauuccuagaccaauacgacgccccacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3418 - RNA, 865 nt, Artificial Sequence
  mRNA product Design2 comprising derived and/or modified sequence from Homo sapiens__NP_003227.1__HsTGFA (opt8)
ggggcgcugccuacggagguggcagccaucuccuucucggcaucaagcuuaccaugguccccuccgccggccaacucgcccucuucgcccucggcauaguacucgcagccugccaagcccuagaaaacucuaccuccccccucuccgccgaccccccaguagcagccgccgucgucucacacuucaaugacugcccagacucccacacccaauucugcuuccacggcaccugccgcuuccucguacaagaagacaaacccgccugcguaugccauuccggauaugucggcgcccgcugcgaacacgccgaccuccuagcaguagucgcagcaucacaaaaaaaacaagcaaucacagcacuugucgucgucucaaucgucgcccucgccguacuaaucaucaccugcguccucauccacugcugccaaguccgaaaacacugcgaauggugccgagcacucaucugccgccacgaaaaacccucagcccuacucaaaggccgaaccgcaugcugccacuccgaaacagucgucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3419 - RNA, 1555 nt, Artificial Sequence
  mRNA product Design2 comprising derived and/or modified sequence from Homo sapiens__NP_000651.3__HsTGFB1 (opt8)
ggggcgcugccuacggagguggcagccaucuccuucucggcaucaagcuuaccaugccuccauccggccuacgacuacuccccuuacuccuaccccuccuauggcuccuaguccuaacacccggccgccccgcagccggccuaucgaccugcaaaaccaucgacauggaacucgucaaacgcaaacgcaucgaagccauucgaggacaaauccuauccaaacucagacucgccucaccucccucccagggcgaaguaccacccggcccccuucccgaagcaguccucgcccucuacaacucaacaagagaccgcgucgccggcgaauccgccgaacccgaacccgaacccgaagccgacuacuacgccaaagaaguuacccgagugcuaauggucgaaacccacaacgaaaucuacgacaaauucaagcagucaacacacucaauauacauguucuuuaauaccucagaacuccgcgaagcaguaccugaacccguccuccuaucccgcgccgaacuccgacuucucagacucaaacuuaaggucgaacaacacgucgaacucuaccaaaaauacuccaauaauucauggcgcuaccucuccaaucgacuccuugcccccuccgacucacccgaauggcucuccuucgacgucaccggagucguacgccaguggcucucccgcggcggcgaaaucgaaggcuuccgccucuccgcacacugcuccugugacucccgcgacaauacccuacaagucgacaucaacggcuucaccaccggccgacgcggcgaucucgccaccauccacggcaugaaccgcccauuccuccuccuaauggccacaccccucgaacgugcccaacaucugcaaucaucccgccaccgacgugcccucgacaccaacuacugcuucuccucaaccgagaaaaauugcugcguacgacaacuauacaucgacuuccgcaaagaccucggauggaaguggauccacgaacccaaaggauaccacgccaacuucugccucggccccugccccuacaucuggucccucgacacacaauacuccaaaguucucgcccucuacaaccaacacaaucccggcgcaucagcagcccccugcugcgucccccaagcccuagaaccccucccaaucgucuacuacgucggccgaaaaccaaaagucgaacaauuauccaacaugaucguccgcagcugcaaaugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3420 - RNA, 1627 nt, Artificial Sequence
  mRNA product Design2 comprising derived and/or modified sequence from Homo sapiens__NP_003229.1__HsTGFB2 (opt8)
ggggcgcugccuacggagguggcagccaucuccuucucggcaucaagcuuaccaugcacuacugcguacucuccgcauuccucauacuccaccucgucaccgucgccuuaucuuuauccacaugcucaacccucgacauggaccaauucaugcgcaaacgcaucgaagccauccgaggacaaaucuuaucaaaacucaaacuaaccuccccacccgaagacuaccccgaaccagaagaagucccacccgaagucauuuccauuuacaacuccacacgcgaccugcuacaagaaaaagccucccgccgcgccgccgcaugcgaacgcgaacgcucagacgaagaauacuacgccaaagaagucuacaaaaucgacaugccacccuucuuccccuccgaaaacgccaucccacccaccuucuacagacccuacuuccguaucguccgcuuugacgucagcgcaauggagaaaaacgccaguaaccuugucaaagccgaguuccgaguauuccgccuacaaaacccaaaagcccgcgucccagaacaacgcaucgaacucuaccaaauccuaaaauccaaagaccuaacuucucccacccaacgauacauagacucaaaaguugucaagacccgcgcagaaggugaauggcucagcuucgacguaacugacgccguccacgaauggcuacaccauaaagaccgaaaccuaggcuucaaaauaagccuccacugcccaugcugcacauucguccccucgaacaacuauaucaucccgaacaaaucagaggaacuggaagcccgcuucgccggaaucgacggaaccuccaccuacaccuccggcgaccagaaaaccauuaaaucaacccgcaaaaagaacagcggaaaaaccccacaccuccuacucaugcuacuaccauccuaccgacuagaaucacaacaaaccaaccgcagaaagaaacgcgcccucgaugccgccuacugcuucaggaacguccaagacaacugcugccuacgcccccuauacaucgacuucaaacgcgaccucggauggaaauggauccacgaaccuaaaggcuacaacgcaaacuucugcgccggagcaugccccuaccucuggagcuccgacacacaacacucucgcguccucucccuauacaacaccaucaaccccgaagccuccgccucacccugcugcgucucccaagaccucgaaccccucacaauacuauacuacaucggcaaaacccccaaaaucgaacaacuguccaacaugaucgucaaauccugcaaaugcagcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3421 - RNA, 1621 nt, Artificial Sequence
  mRNA product Design2 comprising derived and/or modified sequence from Homo sapiens__NP_003230.1__HsTGFB3 (opt8)
ggggcgcugccuacggagguggcagccaucuccuucucggcaucaagcuuaccaugaagaugcaccuccaacgcgcccucguaguccucgcccuccucaacuucgccacagucagccucucccuaucaaccugcaccacccuagacuucggccacaucaaaaagaaaagagucgaagccauccgcggccaaauccucuccaaacuccgucucaccagcccacccgaacccaccgucaugacccacgucccauaccaaguccucgcccuauacaacuccacgcgcgaacuacuagaagaaaugcacggagaaagagaagaaggaugcacccaagaaaacacagaaucagaauacuacgcaaaagaaauccacaaauucgacaugauccaaggacucgccgaacacaacgaacucgccgugugccccaaaggcaucaccucuaaagucuuccgauucaacgucuccucaguagagaaaaaccgcaccaaccucuucagagccgaguuccgaguccucagaguccccaaccccucuucaaaacgcaacgaacaacgcauugaacuguuccaaauccuacgaccagacgaacacaucgcuaaacaacgauacauaggaggcaaaaaccugcccacccgaggaacagcagaauggcucuccuucgacgucaccgacaccguccgcgaauggcucuuacgccgagaauccaaccuuggacuagaaaucuccauacacugccccugccacaccuuccagcccaacggagacauacucgaaaacauccacgaagucauggaaaucaaauucaaaggaguagauaacgaagacgaccacggacgcggcgaccucggccgacucaagaaacaaaaagaccaccacaacccgcaccucauacugaugaugaucccaccccaucgccucgauaaccccggccagggcggccaacggaagaaacgagcacucgacaccaacuauugcuucagaaaccucgaagaaaacugcugcgucagaccccucuacaucgacuuccgccaagaccuaggcuggaaauggguacacgaaccaaaaggcuacuacgccaacuucugcagcggacccugcccauaccuccgaucggcagacaccacccacucaaccguccucggccucuacaacacccuuaaccccgaagcauccgcaucccccugcugcguaccgcaagaccuagaaccccucaccauacuauacuacgucggccgaaccccaaaagucgaacaauuauccaacauggucgucaaauccugcaaaugcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3422 - RNA, 1768 nt, Artificial Sequence
  mRNA product Design2 comprising derived and/or modified sequence from Homo sapiens__NP_001057.1__HsTNFRSF1B (opt8)
ggggcgcugccuacggagguggcagccaucuccuucucggcaucaagcuuaccauggcaccaguagccgucugggccgccuuggccguuggccuagaacucugggccgcagcccacgcccugccagcccaagucgcauucaccccuuacgcccccgaacccggcagcacaugccgacuccgcgaauacuacgaccaaacggcacagaugugcugcucuaaaugcagcccaggccaacacgcaaaagucuucuguacaaaaaccagcgacaccguaugcgacuccugcgaagacuccacuuauacccaacucuggaacuggguccccgaaugccucucuugcggcagccgcugcucauccgaucaagucgaaacccaagccuguacccgcgaacaaaacagaaucuguaccugcagacccggcugguacugcgcccucuccaaacaagaaggaugccgacuaugcgccccucuccgcaaaugccgcccaggauucggcguagcacgccccggcaccgaaaccucagacgucgucugcaaaccuugugcgcccggaacauucagcaacaccaccucauccaccgacaucugcagaccccaucaaauaugcaacgucgucgcuauccccggaaacgcaucaauggacgcugucugcaccucaaccucucccaccagauccauggcaccaggggccguccaccuaccccaacccgucuccacucgaucccaacacacccaacccacaccagaaccguccaccgccccauccaccuccuuccuccuccccaugggcccauccccgcccgccgaagguucuaccggagacuucgcccuucccgucggccuuaucgucggugucaccgcacucggacuccucaucauaggcgucgucaacugcgucaucaugacacaaguaaagaagaaaccacuuugccuacaacgagaagccaaaguaccccaccuccccgcagacaaagcccguggcacccaaggacccgagcaacaacaccuccuaauaaccgcccccucauccuccuccucaucacucgaaucauccgccucagcacucgaccgcagagcgcccacccgcaaccaaccacaagcccccgguguagaagccuccggcgcuggcgaagcccgcgccuccacaggaucuuccgacucuucacccggcggccacggcacccaagucaacguaaccugcauagucaacguaugcuccuccuccgaccacuccucacaaugcaguucccaagcaucaucaacaaugggagacacagacuccucccccuccgaauccccaaaagacgaacaagucccauuuucaaaagaagaaugugccuucagaucccaacucgaaacaccagaaacccuacuuggcuccacagaagaaaaaccccucccccuaggcguucccgacgcuggcaugaaaccauccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3423 - RNA, 895 nt, Artificial Sequence
  mRNA product Design2 comprising derived and/or modified sequence from Homo sapiens__NP_002623.2__HsPGF (opt8)
ggggcgcugccuacggagguggcagccaucuccuucucggcaucaagcuuaccaugccggucaugagauuguucccgugcuuucuccagcuauuggccggguuagcacuaccggcagugcccccacaacagugggcgcucucggccgggaacgggagcucggaaguggaagugguaccauuccaggaagugugggggcgcucguacugucgagcgcucgagcgauugguagaugucgugagcgaguacccaagcgagguagagcacauguucucacccucaugcgugagcuugcucaggugcacgggcuguugcggggacgagaacuugcacugugucccgguagagaccgcgaacgugaccaugcaacugcucaagaucagaagcggggacaggcccucguacguggaauugaccuuuagccagcacgugcgcugugaaugucgcccgcucagagaaaagaugaagcccgagcgcagacgaccgaaagggcgcgggaaaaggcgcagggaaaagcaaaggcccacggacugucacuugugcggggacgcggucccgcgcagguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3424 - RNA, 1621 nt, Artificial Sequence
  mRNA product Design2 comprising derived and/or modified sequence from Homo sapiens__NP_001020537.2__HsVEGFA (opt8)
ggggcgcugccuacggagguggcagccaucuccuucucggcaucaagcuuaccaugaccgaccgccagaccgacaccgcgcccucgccaucauaccaucucuugcccggacgcaggagaacagucgaugccgcggcaucgcgagggcaaggaccagagcccgcaccaggaggaggggucgaggggguaggagcgcgcggaguagcgcucaaacuguucguacaacugcuaggcugcaguagguucgggggagcggucguacgcgcgggggaggccgaaccaagcggcgcggccagaagcgcaagcagcggcagggaagaaccacagcccgaggaaggagaagaggaagaggaaaaagaagaggaaaggggcccacaguggcgacugggagcgcgcaagcccgggagcuggaccggagaagcggcagugugcgcggacucggccccggcagcacgcgcgccacaggcccuggccagagccucaggcaggggcgggcgcguggccaggcgcggggcagaagaaucaggaccgccccacagcccaagcaggcgagggagcgcaaguagggccgggcccggccgcgcgagcgaaaccaugaacuuccuccugagcuggguccacuggucgcucgcgcuauugcucuaccuccaccacgcgaaauggagccaggccgcgcccauggcagaaggaggcgggcagaaccaccacgagguagugaaauucauggacguauaccaaaggagcuacugccaccccauagaaacgcuuguggacauauuccaagaauaccccgacgaaaucgaauacauauucaaaccgagcugcgucccacucaugcgcugcggagggugcugcaacgacgaagggcucgaaugcgugcccacggaagagagcaauaucacgaugcaaaucaugcgcauaaaaccgcaccaggggcaacacauaggggagaugucguuccuacaacacaacaaaugcgaaugccgacccaagaaagaucgagcacgccaggaaaagaaaucagucaggggcaaaggaaagggccagaaaagaaaaagaaagaaaagccgguacaaaagcuggagcguauacgugggcgcgcgaugcugccuaaugccguggagccuaccgggaccgcacccaugcggacccugcagcgagagaagaaaacaccuauucguacaggacccgcagacaugcaaaugcucgugcaagaacacagauucgcgaugcaaagcacgacagcucgagcucaaugaaaggacaugcagaugugacaaaccccgacgcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3425 - RNA, 1081 nt, Artificial Sequence
  mRNA product Design2 comprising derived and/or modified sequence from Homo sapiens__NP_001165094.1__HsVEGFA (opt8)
ggggcgcugccuacggagguggcagccaucuccuucucggcaucaagcuuaccaugaacuuccuccucuccuggguccacuggucccuagcccuccuacuauaccuccaccacgccaaauggagccaagccgcccccauggccgagggcggcggacaaaaccaccacgaagucguaaaauucauggacguauaccaacgaagcuacugccaccccaucgaaacccucguagacauauuccaagaauaccccgacgaaaucgaauacaucuucaaaccaagcugcguaccccuaaugcgaugcggcggcugcugcaacgacgaaggccucgaaugcguacccaccgaagaaagcaacaucacaaugcaaaucaugagaaucaaaccccaccaaggccaacacauaggcgaaauguccuuccuccaacacaacaagugcgaaugccgccccaaaaaagaccgcgcccgccaagaaaagaaauccguccguggaaaaggcaaaggccaaaaacgaaaacgaaaaaaaagccgcuacaaauccuggagcgucuacguaggcgcccgaugcugccuaaugccauggucccuccccggcccccaccccugcggccccugcuccgaacgccgaaaacaccucuucguccaagacccacaaaccugcaaaugcuccugcaaaaacacagacucacgcugcaaagcaagacaacucgaacuaaacgaacgcaccugccgcugugacaaaccacgacgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3426 - RNA, 1006 nt, Artificial Sequence
  mRNA product Design2 comprising derived and/or modified sequence from Homo sapiens__NP_003368.1__HsVEGFB (opt8)
ggggcgcugccuacggagguggcagccaucuccuucucggcaucaagcuuaccaugucaccacuacuccgccgacuacuccucgccgcccuccuccaacucgcccccgcccaagcccccgucagccaacccgacgccccaggccaccaacgcaaagucgucuccuggaucgacguuuacacucgcgcaacaugccaaccccgcgaaguagucgucccacucaccgucgaacuaaugggcaccgucgccaaacaacucguccccucaugcgucaccguccaacgcugcggaggaugcugccccgacgacggccuagaaugcgucccaaccggccaacaccaaguacgcaugcaaauacucaugauccgauaccccucaucccaacuaggcgagaugucccucgaagaacacucccaaugcgaaugccgacccaaaaaaaaagacuccgccgucaaacccgaccgagccgccacaccccaccaccgcccacaaccccgcuccgucccaggcugggacucagcccccggcgcaccaucacccgccgacaucacccaccccacacccgcacccggccccuccgcccacgccgcccccucaaccaccuccgcacuaacccccggccccgccgccgccgccgccgacgccgccgcaucaucaguagcaaaaggcggagcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3427 - RNA, 1642 nt, Artificial Sequence
  mRNA product Design2 comprising derived and/or modified sequence from Homo sapiens__NP_005420.1__HsVEGFC (opt8)
ggggcgcugccuacggagguggcagccaucuccuucucggcaucaagcuuaccaugcaccuccucggauucuucucaguagccugcucccuucuggccgcagcccuccuccccggcccgcgcgaagcccccgccgccgccgcagccuucgaauccggccuagaccugagcgacgccgagcccgacgcaggagaagccaccgccuaugccuccaaagaccucgaagaacaauugcgcucggucucgucagucgacgaacucaugaccguccucuacccagaauacuggaaaauguauaaaugccaacuccgcaaagguggcuggcaacacaaccgggaacaagccaaccucaacagccgaacagaagaaacaaucaaauucgccgcagcccacuacaacacagaaauccucaaauccauagacaacgaauggcgcaaaacccaaugcaugccccgcgaagugugcaucgacguaggcaaagaguucggcgucgccacaaacacauucuucaaaccaccgugcgucuccgucuaccgcuguggcggaugcugcaacucggaaggacuacaaugcaugaacacguccaccuccuaccucuccaaaacccucuucgaaauaaccguaccacuaucccaggguccaaaacccguaacaauauccuucgcaaaccauacuuccugccgaugcauguccaaacuugacgucuacagacagguacacagcauaauccggcguucccuacccgcuacccuaccacaaugccaagcagccaauaaaaccuguccaacaaacuacauguggaacaaccacaucugucgcugccucgcccaagaagacuucauguucuccucagacgccggcgacgacucaacagacggcuuccacgacaucuguggcccaaacaaagaacuugaugaagaaacaugccaaugcgucugccgagccggacuccgacccgcaagcugcggcccccauaaagaacuagaccggaacucaugccaaugcguauguaaaaauaaacuauuccccucccaaugcggcgccaaccgggaguucgacgaaaauaccugccaaugcguaugcaaacgcacuugcccacgcaaccaaccccuaaaccccggcaaaugcgccugcgaaugcaccgaaucgccccaaaaaugccuacucaaaggcaagaaauuccaccaccaaaccugcuccuguuaccgccgacccugcaccaaccgccaaaaagccugcgaacccgguuucucauacucagaagaggucugccgaugcguccccagcuauuggaaacgcccacaaauguccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3428 - RNA, 1447 nt, Artificial Sequence
  mRNA product Design2 comprising derived and/or modified sequence from Homo sapiens__NP_004460.1__HsVEGFD (opt8)
ggggcgcugccuacggagguggcagccaucuccuucucggcaucaagcuuaccauguaccgugaaugggucgucgucaacguauucaugaugcuauacguucaacucguccaaggauccucaaaugaacacggcccagucaaacgcagcucccaauccacacucgaacgcuccgaacaacaaauccgcgccgccuccucccucgaagaacuacuucgcaucacccauucagaagacuggaaacuauggcgaugccgccuccgccucaaaucauuuaccucaauggacagccgcucagccucccaccgcuccacacgcuucgcggccacuuuuuacgacauagaaaccuuaaaagucauagaugaagaauggcaacgcacacaaugcucccccagagaaaccugcgucgaagucgccuccgaacucggcaaaucaaccaacaccuucuucaaacccccaugcgucaacguauuccguugcggaggcugcugcaacgaggaaucauuaaucugcaugaacacaagcacauccuacaucuccaaacaacucuucgaaaucucuguaccccucaccuccguccccgaauuaguaccugucaaagucgcaaaccacacaggaugcaagugccucccuaccgcaccccgccaccccuacuccauaauccggcgauccauccaaauccccgaagaagaccgaugcucacacucaaagaaacucugccccaucgacaugcucugggacuccaacaaaugcaaaugcguccuccaagaagaaaacccccuagccggcaccgaggaccacucccaccuacaagaaccagcccucugcggcccccacaugauguucgacgaagaccgaugcgaaugcgucugcaaaacccccugccccaaagaccucauccaacaccccaaaaacugcuccugcuucgaaugcaaagaaucccuagaaaccugcugccaaaaacacaaacuauuccacccagauaccugcucaugcgaagaccgcugccccuuccacacacgccccugcgccuccggcaaaaccgccugcgccaaacacugccgauuccccaaagaaaaacgcgccgcccaaggaccccacucccgcaaaaaccccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3429 - RNA, 1012 nt, Artificial Sequence
  mRNA product Design2 comprising derived and/or modified sequence from Homo sapiens__NP_061986.1__HsFGF21 (opt9)
ggggcgcugccuacggagguggcagccaucuccuucucggcaucaagcuuaccauggacuccgacgaaaccggcuucgaacacuccggccucugggucuccguccucgccggccuccuccuaggcgccugccaagcacaccccauacccgauucuuccccacuacuccaauucggcggccaaguccgccaacgcuaccucuacacagacgacgcccaacaaacagaagcccaccuagaaauccgagaagacggcacagucggaggcgccgccgaccaaucacccgaaucccuccuacaacuaaaagcccucaaacccggcgucauccaaauccucggcgucaaaaccagccgauuccucugccaacgccccgacggcgcccucuacggaucccuacacuucgacccagaagccugcuccuuccgcgaacuccuccuagaagacggcuacaacgucuaccaaucagaagcccacggccucccccuccaccuccccggcaacaaaucaccacaccgcgacccagccccacgcggccccgcccgcuuccuuccccuccccggccucccacccgcacuccccgaacccccaggcauccucgcaccccaacccccagacgucggcuccucagacccccucuccauggucggccccucucaaggcagauccccauccuacgccuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3430 - RNA, 1792 nt, Artificial Sequence
  mRNA product Design2 comprising derived and/or modified sequence from Homo sapiens__NP_002412.1__HsMMP1 (opt9)
ggggcgcugccuacggagguggcagccaucuccuucucggcaucaagcuuaccaugcacuccuucccuccccuccuacuacuccucuucuggggcguugucucccacuccuuccccgcgacccuagaaacacaggaacaagacguugaccucguccaaaaauaccuagaaaaauacuacaaccucaaaaacgacggacgccaaguagaaaaacgacgcaacuccggccccgucgucgaaaaacucaaacagaugcaagaguucuucggccucaaggucaccggcaaacccgacgccgaaacacuaaaaguaaugaaacaaccccgcugcggcguacccgacgucgcccaauucguacucaccgaagguaacccacgcugggaacaaacccaccucacuuaccggaucgaaaacuacacccccgaccucccccgcgccgacgucgaccaugccaucgaaaaagccuuccaacucuggucaaacgucacaccccucaccuucaccaaagucucugaaggccaagcagacaucaugauaucauucguacgaggcgaccaccgagacaacucccccuucgacggcccgggaggcaaccuggcacacgccuuccaaccagguccaggaaucggcggcgacgcacacuuugacgaggacgagcgauggaccaacaacuuccgagaauacaaccuccaccgcgucgcagcccacgagcucggccacucacugggacucucacacuccaccgauaucggagcacucauguaucccucuuacacuuucuccggcgacguacaacuagcccaagacgacauagacggaauccaagcaaucuacggacgcucccagaaccccguccagcccaucggaccucaaacaccaaaagccugcgacuccaaacuaacauucgacgccaucacaaccauacgaggcgaagucauguucuucaaagacagauucuacaugcgcacaaacccuuucuaucccgaagucgagcucaacuucaucuccgucuucuggccccaacuccccaacggccuugaagcagccuacgaguucgccgaccgcgacgaaguccgauucuucaaaggaaacaaauacugggccguccaaggccaaaacguccuacauggcuaccccaaagacauauacuccuccuucggcuucccaagaaccgucaaacacaucgacgcagcacucuccgaggaaaacaccggaaaaaccuacuucuucgucgcaaacaaauacuggcgcuacgacgaauacaagcgcucaauggaccccggcuauccaaaaaugaucgcacacgacuuccccggcaucggucacaaagucgaugcuguuuucaugaaagacggcuucuucuacuucuuccacggaacccgccaauacaaauuugacccaaaaaccaaacgcauccucacacuacaaaaagccaacagcugguucaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3431 - RNA, 1552 nt, Artificial Sequence
  mRNA product Design2 comprising derived and/or modified sequence from Homo sapiens__NP_002412.1__HsMMP1(1-19,100-469) (opt9)
ggggcgcugccuacggagguggcagccaucuccuucucggcaucaagcuuaccaugcacuccuucccaccccuacuccuccuacucuucuggggcguagucucccacucauucguacucaccgaaggcaacccccgaugggaacaaacccaccucaccuaccgcauagaaaacuacacccccgaccucccccgcgccgacguagaccacgccaucgaaaaagccuuccaacucugguccaacguaacaccccucaccuucaccaaagucuccgaaggccaagcagacauaaugauaucauucguccgcggcgaccaccgagacaacucacccuucgacggccccggcggcaacuuagcccacgccuuccagcccggcccaggcauaggcggagacgcacacuucgaugaagacgaacgcuggaccaacaacuuccgcgaauacaaccuccaccgcgucgcagcccacgaacucggccacucccuuggacucucacacuccaccgacaucggagcccuaauguacccaucauacacauucucaggcgacguacaacucgcccaagacgacaucgacggcauacaagcaaucuauggccgcucacagaacccaguacaaccaaucggcccccaaacccccaaagccugcgacuccaaacucaccuucgacgcaauaaccacaauucgaggagaagucauguucuucaaagaccgauucuacaugcgcaccaaccccuucuaccccgaaguagaacucaacuucauauccgucuucuggccucaacuacccaacggccucgaagcagcauacgaguucgccgaccgagacgaaguccgauucuucaaaggcaacaaauacugggccguccaaggccaaaacguccuacacggcuacccaaaagacaucuacucuuccuucggcuucccacgaacaguaaaacacauagacgcagcucucucagaagaaaacaccggcaaaacuuacuucuucguagcaaacaaauacuggcgcuacgacgaauacaaacgcucuauggaccccggauaccccaaaaugauagcucacgacuuccccggcauaggucacaaagucgacgcaguauucaugaaagacggcuucuucuacuucuuccacggcacccgccaauacaaauuugaccccaaaaccaaacgcauccucacccuucaaaaagccaacuccugguuuaacugucgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3432 - RNA, 3739 nt, Artificial Sequence
  mRNA product Design2 comprising derived and/or modified sequence from Clostridium histolyticum__BAA77453.1__ColG (opt9)
ggggcgcugccuacggagguggcagccaucuccuucucggcaucaagcuuaccaugaaaaagaacauccuaaagauacucauggacagcuacagcaaagaaucgaaaauccaaaccguucgucgaguaaccuccguaagccuccuagccguauaucugaccaugaacacgagcagccucguacuagccaaacccauagaaaacaccaacgauaccucaaucaaaaacguagaaaaacugaggaacgcacccaaugaagaaaacucaaagaaaguugaagacagcaaaaaugacaaggucgaacacgucaaaaacaucgaagaagcaaaaguagagcaaguagcccccgagguaaaaagcaaaagcacgcucagaucagcaagcauugccaacacaaacagcgaaaaauacgacuucgaauaccuaaacggucuaagcuauaccgaacugacgaacuuaauaaagaacaucaaauggaaccaaauaaacggccuauucaacuacuccacaggcagccaaaaauucuucggggacaaaaacagaguacaggcaauaaucaacgcgcuccaggaauccggccguaccuacacggcgaacgacaugaaggggaucgaaacauucaccgaaguacuccgugccggcuucuaccuuggguauuacaaugacggacucagcuaccucaacgaccgcaacuuucaggacaagugcauccccgcaaugaucgcaauccaaaagaacccuaauuucaaauuaggaacagccguacaggacgagguaaucacgagccugggcaaauuaaucggcaacgccucugcgaacgcagaggucgucaacaacugugugccaguccucaagcaguuccgggagaaccugaaucaauacgcacccgacuacguaaagggcacugccgucaacgaacucauaaaaggcauagaguucgacuucucaggcgccgccuacgaaaaagacguuaaaacgaugcccugguacggaaaaauagaccccuucauaaacgaauuaaaagccuuaggccucuacggcaacaucaccagcgcaacggaaugggccucagacguagguaucuacuaucuuuccaaauucggauuauacagcaccaaccgcaacgacauaguacaaucccuagagaaagccgucgauauguacaaauacggaaaaauagcguucguagccauggaacgaaucaccugggacuacgacggcaucggcucaaacggcaagaaagucgaccacgacaaauuccuggacgacgccgaaaaacacuaucuccccaaaaccuacacauucgacaacgggacguucauaauccgcgcgggcgacaaaguauccgaagagaaaaucaaacgccuauacugggccuccagagaaguuaaaagccaauuucaccgggugguggggaacgacaaagcccuagaagucggaaacgccgaugacguccucacaaugaaaaucuucaauagucccgaagaauacaaauucaacaccaacauaaacggcguuagcaccgacaaugggggccuguacaucgaaccccggggcacauucuacaccuacgaaagaacgccucaacaaucuaucuucagucuggaggaguuguuccgccacgaauacacccacuaccuacaagcacguuaccucgucgacggccuauggggccagggacccuuuuacgaaaagaacaggcuaaccugguucgacgagggcacagccgaguucuucgccgggagcacccgcacauccggaguacugcccaggaaaagcauccucggcuaccuugccaaagauaaaguugaccaucgcuacucacugaagaagacccuuaacagcggauaugacgauagcgacuggauguucuacaacuauggguucgcgguagcacacuaccuauaugaaaaagacaugcccacuuucaucaaaaugaauaaggcaauccucaacaccgacgucaaauccuacgacgaaaucauuaagaaacugagcgacgacgcaaacaagaacaccgaguaccagaaccacauccaggagcuagccgacaaguaccagggggcaggaaucccccuaguaucagacgacuaccucaaagaucacggcuacaagaaagcgagcgaaguauacuccgaaauaucgaaggcagcaagccucacgaacacaagcgugacagccgaaaaaucacaauacuucaacaccuucacucuccgggguaccuacacaggcgagaccuccaagggagaauuuaaagacugggacgaaaugagcaaaaagcucgacggcacccucgaaucacucgccaaaaacuccugguccggcuacaagacauuaacugcauacuucacuaauuaccgcgucaccagcgacaacaaaguccaauacgacgucguuuuccacgggguacuaaccgauaacgcagacaucuccaacaacaaagcaccuaucgcaaaagucacgggaccauccacuggggccguuggacgcaauauugaguucucagguaaagacagcaaagacgaggacggcaaaaucgucagcuacgacugggauuucggagacggcgcgacaucacgaggcaaaaacagcguccacgcauauaagaaagccggcaccuacaacguuacacuaaaggucacagacgacaaaggagcaacagcgacagagucauucacaauagagaucaaaaacgaggacacgacgacaccuaucacaaaagaaauggaaccgaacgacgacaucaaagaagccaacggcccaauagucgaaggaguaaccguuaaaggcgaccucaacggcucagaugacgccgauaccuucuacuucgacgucaaggaagacggggacguaacaauugaacuaccauacucagggucaagcaauuucacauggcucgucuacaaagaaggcgacgaucagaaccauauagcaucaggcauagacaaaaacaacucgaaagugggcaccuuuaaaagcacaaaaggccgccacuacguguucauauacaaacacgacagcgccucgaacaucucuuacucacuaaacaucaagggccuaggaaacgagaagcugaaagaaaaagaaaacaacgacucuucagauaaggccaccgucauucccaacuucaacacaacaaugcaaggcucgcugcucggcgacgacuccagagacuauuacuccuucgagguaaaagaagaaggagaagucaacaucgaauuggacaagaaagacgaguucggggugacauggacccuucacccggaauccaacauaaacgacaggauaaccuacgggcaaguagauggaaacaaagugucgaacaaagucaagcuccgacccggcaaauacuacuugcuagucuacaaauacagcggcucuggcaacuacgaacuacgaguaaacaaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3433 - RNA, 3463 nt, Artificial Sequence
  mRNA product Design2 comprising derived and/or modified sequence from Clostridium histolyticum__BAA77453.1__HsALB(1-18)_ColG(111-1118) (opt9)
ggggcgcugccuacggagguggcagccaucuccuucucggcaucaagcuuaccaugaaaugggugacuuucauuucccugcuguuccucuucagcagcgccuacuccaucgcaaacacaaacagcgaaaaauacgacuucgaauaccugaacggacucaguuacaccgaacucacaaaccucaucaagaacaucaaguggaaccaaauaaacggccucuucaacuacucgaccggcucccaaaaguucuucggggauaagaaccgcguccaagccauuaucaacgcccuccaagaaagcgggcgcacauacaccgccaacgacaugaagggcauagaaacauuuacagaagugcuacgcgcgggcuucuaccucggcuauuacaacgacggacucagcuaccuaaacgaccgaaacuuccaggacaagugcauaccggcaaugauagccauccagaaaaaucccaacuuuaaacucggaacugccgugcaagacgaaguaaucaccucgcucggaaaacuaaucggcaacgccucagccaaugccgaaguagucaauaacugcguccccgucuuaaagcaauuccgagagaacuugaaccaauacgcaccagacuacgucaagggcaccgccguaaacgaguuaaucaaagggauagaguucgacuucucgggagccgcauaugaaaaagacgucaaaaccaugccaugguacggcaaaaucgaccccuucauaaacgaacucaaagcccuuggccuauacggcaacauaacaagcgcgacagaaugggccagcgacguaggcaucuacuaccuaucaaaguucggacucuacagcaccaaccggaacgacauaguccaaagccucgaaaaagcaguagacauguacaaauacggcaaaauagccuucgucgcaauggagcgcauaacaugggauuacgacgggaucggcaguaaugguaagaaaguagaccaugacaaguuccucgacgacgcagaaaaacacuaccuaccuaagacauacaccuucgacaacggaaccuucauaauccgcgcaggcgacaaaguuagugaggagaaaaucaaaagacuauacugggcaucaagagaagucaaaucacaauuccaccgcguagucggcaacgacaaagcccucgaaguggggaacgccgacgacguccuaacaaugaaaaucuucaacagccccgaagaauacaaauucaauacuaauauaaacggaguaagcacagacaacggcggccuauauaucgaaccccgcgggacuuucuauaccuacgaaaggacgccgcaacaauccauauucucacuagaagaacuauuccgccacgaauacacccacuaccuccaggcaagauaccuagucgacggccuauggggucagggcccauucuacgaaaagaaccgccuaaccugguucgacgagggaacagccgaauuuuucgccggauccacccgcacaagcggaguccugccccgcaaaucaauacucggguaccuagcgaaagacaaaguggaccaccgauacagccuaaagaaaacacucaacuccggauacgaugacagcgacuggauguucuacaacuacggauucgccgucgcacacuaccuauacgagaaagacaugcccacuuucaucaaaaugaacaaagcgauacucaacaccgacgucaaaagcuacgacgagaucaucaagaaacuguccgacgacgcaaauaaaaacaccgaauaccagaaccacauucaggaacucgccgacaaauaccaaggagccggcaucccacucgucagcgacgacuaccucaaagaccacggguacaaaaaggcguccgaaguauauucugagaucagcaaagccgcaucccugaccaacacaucagucacagcagagaaaucucaguacuucaacacauucacgcuccgggggaccuacacaggcgaaacuagcaaaggggaguucaaggacugggacgagaugagcaagaaacuggauggcacacucgagagucucgcgaaaaacuccuggucgggcuacaaaacgcuuacagcauauuucaccaacuaccgcgucaccucagacaacaaaguccaauacgacgucguguuccacggagugcucaccgacaacgccgacaucuccaacaacaaggcaccuaucgcaaaggugaccggccccucaacaggcgcgguuggacggaacaucgaguucuccgggaaagacaguaaggacgaggacggcaaaauaguaagcuacgacugggacuucggagacggggcgaccucccgaggcaagaacagcguccacgccuacaagaaagccggcacauacaacgugacacuuaaaguuaccgacgacaaaggagccaccgccacggaguccuuuaccaucgagaucaaaaacgaagacaccacaaccccaauaaccaaagaaauggaaccuaacgacgacauuaaggaggcaaacggcccaauaguagaaggaguuacggucaagggugaccucaacgguuccgaugacgcagacaccuucuacuucgacgucaaagaagacggggauguaaccaucgaacuacccuacuccggauccucaaauuucacuuggcuaguauacaaggagggcgacgaccaaaaccacauagccucggggauagacaaaaacaacucuaaaguaggaaccuuuaaguccacaaagggacggcacuacgucuuuaucuacaagcacgacuccgcuuccaacauaucguacucguuaaacaucaaaggacuaggaaacgaaaaacucaaagagaaagaaaacaacgacucaucggacaaagcgacaguaauaccaaacuucaacaccacgaugcagggcucccuauugggagaugacagccgagacuacuacucguuugaaguaaaagaggaaggcgaagucaacaucgaacuagauaagaaagacgaguucggaguuacguggacccuccaccccgagagcaacaucaaugaccgaauuaccuauggccaggucgacgguaacaaaguaucuaauaaagucaaacuccgcccaggcaaauacuaccuccucgucuacaaguacagcgguagcggcaacuacgaacuacgcgugaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3434 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt9)
ggggcgcugccuacggagguggcagccaucuccuucucggcaucaagcuuaccaugaagugggugacauucaucucccuacuguucuuauuuaguuccgccuauaguaugaaaaagaacauucucaaaauccucauggacagcuacagcaaagagagcaagauccagaccgugcgucgaguaaccagcgucagcuuacuagcgguauaccuaaccaugaacacauccagccuaguccuggcaaaacccaucgaaaacaccaaugacacuuccaucaagaacgucgagaagcuacgaaacgcaccaaacgaagagaauagcaagaaaguugaagauuccaaaaaugacaaaguagagcacgucaaaaacaucgaagaagcaaaagucgaacaaguagccccggaagucaaauccaagagcacgcuccgcuccgccaguagacggcgcaggaaacgcaucgcaaacacaaacuccgagaaauacgacuucgaauacuugaacggauuaagcuacacggagcuaaccaaccucaucaaaaauauaaaauggaaccaaauaaacggccuauucaacuauagcaccgggucccagaaauucuucggagauaagaaccgcguacaagcuaucaucaaugcccugcaggaauccggccgcacauacacggccaacgacaugaaagguauagaaacauucacagaagugcuaagggccggcuucuaccucggcuacuacaacgacgggcuaucauaccuaaaugacagaaauuuucaggacaaaugcauaccggcuaugaucgcgauacagaaaaacccgaacuucaagcuaggcacggccguacaagacgaagucaucaccuccuugggaaaacucauaggcaacgccuccgcgaacgccgaagucgucaacaacuguguacccguccuaaaacaguuuagagagaaccuaaaccaguacgcuccggacuacgucaaagggacagcagugaaugaacugauuaagggaauagaguucgacuucucaggcgcugccuacgaaaaggacgugaaaaccaugcccugguacggcaagaucgacccauucaucaacgaauuaaaagcacucggccuauauggcaacauaaccuccgccaccgaaugggcaucggacgucggaauauacuaccucaguaaauuuggacuguauagcaccaacagaaacgacaucguccaaagccucgagaaagcagucgacauguacaaauacggcaaaauagccuucguggcaauggaaaggaucacaugggacuacgacggcaucggguccaacggaaagaaaguagaccacgacaaauuucuugacgacgccgagaaacacuaccuaccaaaaacuuacaccuucgacaacggcaccuucauaaucagagcaggagacaaagucagcgaagagaaaaucaaacggcuuuacugggccucacgugaagugaaaagccaguuccaccgcgucgugggaaaugacaaggcauuggaaguagggaacgcggacgacguccuaacaaugaaaauauucaacagcccagaagaauacaaauucaacacuaacauaaauggagucuccaccgacaacggcggccucuacauagaaccaaggggcaccuuuuacacauacgaacgcacaccucagcaaagcauauuuucacuagaagaacucuuccgucacgaauacacccacuaccuccaggcuagauaccucguugacggacuguggggccagggccccuuuuaugagaaaaaccgccucacgugguucgacgaaggcacagccgaguucuucgccggcagcacacgaaccagcggcguacuaccacgaaaaucgauccucggcuaccuggcaaaagacaaagucgaucauagguacagccucaaaaagacacuaaacagcggauaugacgacucugacuggauguuuuacaacuacggguucgccgucgcacacuaccucuacgaaaaggacaugcccacauucaucaaaaugaacaaggcgauccuaaacacugacguaaaaagcuacgacgaaauaauaaagaagcuaagcgacgaugccaacaagaacacagaguaccaaaaccacauucaggaacuugccgacaaauaccagggagccggaaucccgcucguauccgacgacuaccuaaaagaccacggauacaaaaaggcauccgaagucuacagcgaaauaagcaaggccgcgucacuaacaaacacgucagucaccgcagagaaaucccaauacuucaacaccuuuacacugagagggacauacaccggcgaaaccucaaaaggagaguucaaagacugggacgaaauguccaagaaacuagacggaacacucgaaucgcuagcuaaaaacuccuggagcggauacaaaacccucacggcuuauuucaccaacuaccgcgucacgagcgacaacaagguacaauaugacguugucuuccacggcguccucacggacaacgccgacaucucaaacaauaaggcccccauagcaaaaguaacaggaccauccaccggcgcagucggccgaaacauagaguucucaggcaaagauuccaaagacgaagacgggaaaaucguuaguuacgauugggacuucggcgacggcgccaccucgcgagguaagaacuccgugcacgcauacaaaaaggccggaaccuacaacguuacccuaaaggugacagacgacaaaggagcgacggcgacagaaucuuucacaaucgaaaucaaaaacgaagacacuacaacacccaucacgaaagaaauggagcccaacgacgacaucaaggaagcaaacgggccgaucguugaaggaguaaccgucaaaggagaccucaacgggagcgacgacgcagacaccuucuacuucgaugucaaagaggacggggacguaacaaucgagcuccccuacucaggaagcagcaacuucacauggcuaguguacaaggagggcgacgaccagaaccacauagcguccggcaucgacaaaaacaacucaaaaguaggcaccuucaaaaguaccaaaggccgccacuacguuuucaucuacaagcacgacuccgccuccaacauaagcuacucgcuaaacaucaagggcuuaggcaacgaaaaacugaaagaaaaagaaaacaacgacucaucugacaaggccaccguaauacccaauuucaacacaaccaugcagggcucacugcucggagacgacucacgagauuacuacuccuuugaaguaaaagaagaaggcgaaguaaacaucgaauuggauaagaaagacgaguucggcgugacguggacacuucacccagaaucaaacaucaacgacaggauaaccuaugggcaaguagacggcaacaaaguaucuaacaaggucaagcuccgccccggcaaguacuaccugcucgucuacaaauacagcggaucuggaaacuaugaacuccgcguaaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3435 - RNA, 3487 nt, Artificial Sequence
  mRNA product Design2 comprising derived and/or modified sequence from Clostridium histolyticum__BAA34542.1__ColH (opt9)
ggggcgcugccuacggagguggcagccaucuccuucucggcaucaagcuuaccaugaacuuccucaaaaucauacugaaccgcggaaaaaccaugaagagaaagugccuauccaaaagguuaaugcucgccauaaccauggccacgauauucacagugaacucgacccucccgauuuacgccgccguagacaaaaacaacgcgaccgccgcgguacagaacgaguccaaacgguacacgguauccuaucucaagacccucaacuacuacgacuuggucgaccuucucgucaaaacagagauagaaaaccuucccgaucuauuccaauacucuagcgacgccaaagaguucuacggaaacaaaacaagaaugucguucaucauggacgagaucggccgccgcgcuccucaauacacagaaauagaccacaaaggcauacccacccuggucgaggucguccgcgccggcuucuaccuagguuuccacaacaaagaacuaaacgaaaucaacaagcgcagcuucaaagaaagggucauacccuccauacuggcuauccagaaaaaccccaacuucaaauugggaaccgaaguacaagacaaaauagucucagccacaggccugcucgcagguaacgagacugcaccaccggaagugguaaauaacuucaccccgauacuccaagacuguaucaagaacaucgaccguuacgcccucgacgaucucaaaagcaaagcacucuucaacgugcucgcagcaccaacguaugauaucacugaauaccugagagcaaccaaagaaaaaccggagaacacccccugguacgggaaaaucgacggguucauaaacgaauugaagaaacuggcccuuuacggcaaaauaaacgacaauaacucauggauaaucgacaacggaaucuaccacauagcaccccucggcaaacuccacaguaacaacaaaauagggaucgagacccuaaccgaagugaugaagguuuaccccuaucucucaaugcagcaucuccagagugcagaccaaauaaaaaggcauuacgacucaaaagacgccgagggcaacaagauaccucucgacaaguucaagaaagagggcaaagaaaaguacugccccaaaaccuacacguuugacgaugguaaagucaucauaaaggcaggagcacgagucgaagaagaaaaagucaaacgucuuuacugggccagcaaggaaguaaacagccaguucuuccgagucuacggcaucgacaaaccacucgaggaaggcaacccggaugacauccucacaauggugaucuacaacagcccggaggaguacaaacuuaacuccgucuuguacggcuaugacaccaacaauggcgggauguacaucgaaccagaaggaacuuucuucaccuaugagcgcgaagcccaagaguccaccuauacccucgaggaacucuuccgacacgaauacacucauuacuuacaaggccgcuacgcaguacccgggcaauggggccgcaccaagcuauacgacaaugacagacuaacuugguacgaggaaggcggagccgaacuauucgcaggcuccacacgcaccucaggaauacucccucgcaaaagcauaguauccaacauacacaacaccacccgaaacaacagauauaaacuaagcgacaccguccacagcaaauacggagcgagcuucgaguucuacaacuacgccugcauguuuauggacuauauguacaacaaagauaugggcauacucaacaaacuuaacgaccuagcaaagaacaacgacgucgacggcuacgacaacuacauacgggaccucagcucgaacuaugcacuaaacgacaaauaccaagaccacaugcaggaacgcauagacaacuacgaaaaccucaccguacccuucgucgcagacgacuaccuaguccgacacgcguacaaaaaucccaacgaaaucuacuccgaaaucagcgaagucgccaagcugaaggaugccaaaagcgaagugaagaaaucacaauauuucucaaccuucacgcuccgcggcucauacacagguggcgccuccaaaggaaaacuagaggaucaaaaagcaaugaacaaguucauagacgacucccucaaaaagcucgacacauacuccugguccggcuacaaaacacuuaccgcguacuucaccaacuacaaaguagacuccucgaaucgaguaaccuacgacgucguauuccacggcuaccuuccaaacgaaggcgacuccaaaaacucccuacccuacggaaagauaaacggcaccuacaaagguaccgaaaaggagaaaaucaaauucuccagcgaagggucauuugacccagacggaaaaaucgucuccuacgaaugggacuucggagacggaaauaagucaaacgaagaaaaccccgaacacagcuacgacaaagugggaaccuacaccguaaagcucaaagugacagaugacaaaggcgaaucaaguguaaguacgaccacugcugagauaaaagacuugucggagaauaaacuucccguaaucuacaugcacguccccaaaucaggagcacuaaaccagaaagucguauucuacggcaaaggaaccuacgaccccgacggcucaauagccggauaucaaugggauuucggggacggaagcgacuuuucgucggaacagaaccccagccacguguacacgaagaaaggggaauacaccgucacccugcggguaauggacagcucaggccaaauguccgagaaaacaaugaaaauaaaaaucaccgaccccgucuaccccaucggcacggaaaaagaacccaacaacuccaaagaaaccgcauccggcccaaucgugcccggcauacccgucuccggcacaauagaaaauaccuccgaccaagacuacuucuauuucgaugucaucacccccggagaggucaaaaucgacaucaacaaacugggcuacggcggagcaaccuggguagucuacgacgagaacaacaacgccgucaguuacgcaaccgacgacgggcaaaaccucagcggaaaguucaaagccgacaaaccaggaagauacuacauccaccuauacauguucaauggcagcuacaugcccuacagaauuaauaucgagggauccgugggccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3436 - RNA, 3448 nt, Artificial Sequence
  mRNA product Design2 comprising derived and/or modified sequence from Clostridium histolyticum__BAA34542.1__ColH (opt9)
ggggcgcugccuacggagguggcagccaucuccuucucggcaucaagcuuaccaugaaacgaaaaugccuuagcaaacgccugaugcucgccauuaccauggcgacaauauucaccgugaacaguacgcucccuaucuacgcagccguagacaaaaacaacgcaaccgcagccguacagaacgaguccaaacgcuacaccgucuccuaucucaagacccuaaacuacuacgaccuuguagaccuccucgugaagaccgaaaucgaaaaccuacccgaccucuuccaauacuccagcgacgccaaggaguucuacggaaacaaaacccgaaugagcuucauaauggacgaaaucggucgccgcgcgccccaauacacggaaaucgaccauaaaggaaucccuaccuuagucgaggucguaagagcggguuucuaccuaggauuccacaacaaagagcuaaacgagaucaacaaacgcuccuucaaagaacgcgugauccccucuauccuagccauccagaaaaacccaaauuucaaacucggcaccgaaguacaagauaaaauaguaagcgccaccggacuccucgcuggcaacgaaaccgcacccccagaaguagugaauaacuucacacccauccuccaagauugcaucaaaaauauagaccgauacgcccuggacgauuuaaaaagcaaagcacucuucaacguacucgcugcacccacauacgacaucacagaguacuugagggcaacgaaagagaaacccgaaaacacccccugguacggaaaaauagacggcuucaucaacgaacuaaagaaauuggcgcuauaugggaaaaucaacgacaacaacaguuggauaaucgacaacggcaucuaucacauagcaccccucggcaaacuccauagcaacaacaaaauaggcauagaaacacuaacugaagucaugaaaguauaccccuaucucagcaugcaacaccuacaauccgccgaccaaaucaaacgccacuacgacagcaaagacgcagaaggcaacaaaauaccccucgacaaguucaagaaagaaggaaaagagaaauacugccccaaaaccuacaccuucgacgacggcaaaguaaucaucaaggccggagcacgaguagaagaagagaaaguaaaacgacucuacugggcgagcaaagaagucaauagccaauucuuccgcguuuacgguaucgauaaaccgcuugaagaaggcaacccagaugacauccuaacgaugguuaucuauaacagucccgaagaauacaaacucaacagcguccuuuauggguacgacaccaauaacggcgggauguacaucgaacccgaggggaccuucuucacauacgaacgagaagcccaagaauccaccuacacacuagaagaacucuuccgccacgaauacacccacuaucuucagggcagauacgccguaccaggacaaugggggaggaccaaauuauacgacaacgaccgacucacaugguacgaagaaggcggcgccgaguuauucgcuggaaguacucgaaccuccggcauccuuccccgaaaaagcauagucucgaacauccacaacacaacccguaacaaucgcuacaaacuauccgauacaguccacagcaaauauggagcuagcuuugaguucuacaacuaugccugcauguucauggacuacauguacaacaaggacaugggcauccucaacaaacuaaacgaccuggcgaaaaacaacgacguagacggcuacgacaacuacauacgcgaucuuagcucuaacuacgcccuaaacgacaaauaucaagaccauaugcaggaacggaucgauaauuacgaaaaucucacaguacccuucgucgccgacgacuaccuaguccggcaugcauacaaaaacccgaaugagauauacuccgagaucucagaagucgcaaaacugaaagacgcaaagucggaaguuaaaaagagccaauacuucagcacauucacccuccgcggaucuuacaccggcggggccuccaaggggaaacuugaggaccaaaaagcaaugaacaaauuuaucgacgacagccucaaaaagcucgacaccuacagcuggagcggguacaaaacacuuacggcauacuucaccaauuacaaagucgacucgagcaaucgggucaccuacgacguggucuuccacggcuaccuaccgaacgaaggcgacagcaaaaacucacuaccguacggcaaaauaaacggcacguauaaagggaccgaaaaagaaaagaucaaguucucaucagaaggcuccuucgacccagacggaaaaauagugagcuaugagugggauuucggcgacgggaacaaaucaaacgaagagaacccggagcacagcuacgacaaagucgggaccuacaccgucaaacuaaaagucaccgaugacaaaggcgaguccucaguauccacgaccacggcugaaaucaaagaccugagcgaaaacaagcucccagucauauacaugcacgucccgaaauccggcgcccuaaaccagaaagucgucuucuacggcaaaggcacuuacgacccagacggcagcauagcaggauaccaaugggacuucggggacggcuccgacuucucaucagaacagaacccaucacacgucuacaccaaaaagggcgaguacacaguuacacuccgcgugauggacuccuccggacaaaugagcgagaaaacaaugaaaauaaaaauaaccgacccgguauacccaauaggcacggaaaaggaaccuaacaacagcaaagaaacagcaucaggucccauuguacccggcaucccagucucaggaaccaucgaaaacaccuccgaccaagacuacuucuacuucgauguaauaacacccggcgaaguaaaaaucgacaucaacaaacucggguacgggggagcaaccugggucguauacgaugaaaacaacaacgcugucucauacgcaaccgacgacggacagaaccugagcggcaaguucaaagccgacaaaccagggagguacuacauacaccucuacauguucaaugguagcuacaugccuuaccguauaaauaucgaaggaucuguaggacgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3437 - RNA, 3382 nt, Artificial Sequence
  mRNA product Design2 comprising derived and/or modified sequence from Clostridium histolyticum__BAA34542.1__HsALB(1-18)_ColH(41-1021) (opt9)
ggggcgcugccuacggagguggcagccaucuccuucucggcaucaagcuuaccaugaaaugggugaccuucauaagccuucucuuccucuucucauccgccuacagcguacaaaacgagucgaaaagauacaccguaucauaccucaagacccucaacuacuacgaucucgucgaucuauuagucaagacagaaaucgaaaaucuacccgaccuauuccaguacucaucggacgccaaagaguucuacggcaacaaaacacgaaugagcuucauuauggacgaaauagguagacgagcgccgcaguacacggaaaucgaccacaaagggauccccaccuuagucgaaguuguacgcgcgggcuucuaccuaggauuucacaacaaagaacuuaacgaaaucaacaaacgcaguuucaaagaacgcgucauccccagcauccuagcgauccagaaaaaccccaauuuuaaacucggcaccgaaguacaggacaagauagugucagcaacaggccugcucgccggaaacgaaacggccccacccgaaguagucaauaacuucacacccauacugcaggacugcaucaaaaauaucgaccgauacgcacucgacgaccucaagagcaaagcccucuucaacgugcucgccgccccaaccuacgacauaaccgaauacuugagggccacaaaagaaaaacccgaaaacaccccaugguacggcaaaauugacggauucaucaacgagcugaagaaacucgcccucuacgggaaaaucaaugacaacaacagcuggaucaucgacaacggcaucuaccacauugccccgcuaggcaaacuacacuccaacaacaaaaucggcaucgaaacgcucacggaagucaugaaaguauauccauaucuauccaugcaacaccuccaaucugccgaccaaaucaaacgccacuacgacagcaaggacgcggaaggaaacaaaaucccacucgacaaguuuaagaaggaaggcaaagaaaaauacugcccuaaaaccuacacguucgaugacgggaaaguaauuaucaaagccggcgcccgagucgaagaggaaaaggugaaacgccuauacugggccuccaaagagguuaauucacaauuuuuccgagucuauggcaucgacaaaccacucgaggaagguaaccccgacgauauccucaccaugguaauauauaauucgcccgaggaauauaaacucaacagcgucuuauacggcuacgacaccaacaacgguggcauguacaucgagccggaaggcaccuucuucaccuacgagcgugaagcccaagaauccacguacacacuugaggaacuauuccgacaugaauacacccacuaccugcaaggccgguacgcaguaccuggccaguggggccgcacuaaacucuacgacaacgaccgucucaccugguacgaagaagguggagccgaacucuucgccggcuccacccgcaccagcggcauccuaccccgaaaauccauagucucgaacauucacaacacaacccgaaauaaccgcuacaaacucagcgacaccguacacucaaaauacggagccagcuucgaguucuacaacuacgcgugcauguucauggacuacauguacaacaaagauauggggauucuaaacaaacuuaacgaccucgccaaaaauaacgacgucgacgguuacgacaacuauauacgagaucuuucaucgaacuacgcacuaaacgacaaauaccaggaccacaugcaagaacgcaucgacaacuacgaaaaccucaccguccccuucgucgcagacgauuaccucguccgacacgcauacaagaaccccaacgaaauauacucggagaucagcgaagucgccaagcucaaagaugcaaaauccgaagucaaaaagucacaguacuuuagcacauucacacuccgcgggagcuacaccggcggcgcguccaagggaaagcucgaagaccaaaaagccaugaacaaauuuauagacgacucccucaagaaacucgacaccuacucguggagcggcuacaaaacacuuaccgcauacuucaccaacuacaaaguagacagcucaaaucggguaacuuacgacguagucuuccacggcuaccuucccaaugaaggagacagcaagaacucacucccuuacggcaaaauaaauggaacguacaagggcacggaaaaggagaaaaucaaauucagcuccgaaggcuccuucgaccccgacggaaaaauaguaucauacgaaugggacuucggcgacggcaacaagaguaacgaagaaaaucccgaacacucauacgacaaagucggcacguacaccgucaaacuaaaaguaacagacgacaaaggcgaauccucagugaguacgaccaccgcagaaaucaaagacuuaucagaaaacaaacuccccguaauauacaugcacgucccaaagagcggggcacucaaccaaaaagucgucuucuacggcaaaggaaccuacgacccugacggauccaucgccggcuaccagugggauuucggcgacggaagcgacuucucaucggagcaaaacccaagccacgucuacacgaaaaagggagaauacacagugacacuccgaguaauggacuccucagggcagauguccgagaaaaccaugaaaauaaagaucaccgacccugucuaccccaucggaaccgaaaaggagccuaacaauuccaaagaaaccgccagcggaccaauaguacccgguauccccgucuccggaaccaucgaaaacacgucagaccaggacuacuucuacuucgacgucauaaccccgggcgaaguaaaaaucgacaucaacaaacuaggcuacggcggagccacaugggucguauacgacgaaaacaacaacgcgguaucuuacgcaacagacgacggccaaaaccuaagcggcaaguucaaagcagacaaacccgggcgcuacuacauccaccuguacauguucaacggaagcuacaugccauacagaauaaauaucgaaggcuccguaggacguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3438 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt9)
ggggcgcugccuacggagguggcagccaucuccuucucggcaucaagcuuaccaugaaaugggucaccuucaucucucuacuguuccucuucucuagcgcauauagcaugaaacggaaaugucuauccaaacgccugaugcuggccauuacgauggccaccaucuucaccgucaacucuacccugccgaucuacgccgccguagacaagaacaacgccaccgccgcucgccgccgaagaaagaggguccaaaacgaaagcaaaagauacacaguaagcuaccuuaagacacucaacuacuacgaccucguagaccuacucgucaagacagaaauugagaaccuccccgaccuauuccaauacagcagcgacgccaaagaguucuacggcaacaaaacccgaaugucuuucauaauggaugaaauaggacgcagagcgccccaauacacggaaaucgaucacaaaggcauacccacccuaguggaagucguacgagcuggcuucuaucuggguuuccacaacaaagaacugaacgaaauaaacaagcgcagcuucaaagaacgcgugauccccucaauacuggcuauccagaaaaaucccaauuucaaacuagggaccgaaguccaagacaagaucguguccgcgacaggacuccucgccggcaacgaaaccgccccgccggaagucguuaacaacuucacgccaauacuacaagacugcauuaaaaacaucgaccgauacgcccuagacgaucugaaauccaaggcacuauucaacguucuggccgcaccaacauacgacaucacagaguaccugcgugccacaaaagaaaaaccagaaaauacccccugguacggcaaaaucgacggauucauuaaugaguugaaaaagcuagcacucuacggaaaaaucaacgacaauaacagcuggaucaucgacaacggcauuuaccacauagcgccccucggcaaacugcacuccaacaacaaaaucgguauagagacacucacagaggugaugaaaguuuacccauaccuaagcaugcaacaccuucaauccgccgaccaaaucaaacgccacuacgacuccaaagacgcggaaggcaacaaaauaccccucgacaaauuuaaaaaggagggcaaagaaaaauacugcccaaagaccuacaccuucgaugacggcaaaguaauaaucaaagcaggagccagagucgaggaggagaaggucaaaaggcuauacugggcaucuaaggaagugaacagccaauucuuucggguauacggaaucgacaagccccuagaagaagguaaccccgacgacauccuuacaaugguaauauacaacagcccggaagaguacaaacucaacaguguucuauacggauacgauacgaacaacggaggcauguacaucgaaccggagggcaccuucuucaccuacgagcgagaggcccaagaaagcacauacaccuuagaagaacuguuccgacacgaauacacccauuaccuccaaggcagauacgcuguccccggccaauggggacgcacuaaacuauacgauaacgaccgccuaacaugguacgaagaggguggcgccgaacucuucgccggcucaacgagaacgagcggaauccugccgcgcaaaagcaucgucagcaacauacacaacacaacgcgaaacaaucguuacaaacucucggacacgguccacucaaaauacggcgcgucauucgaguucuacaacuacgccugcauguucauggauuacauguacaauaaggacaugggcauccuaaacaaacucaacgaccucgcuaaaaacaacgacgucgacggcuacgacaacuauauccgagaccuaagcucgaacuacgcacucaaugacaaauaccaagaccacaugcaagagcgcaucgacaacuacgaaaaccuaacaguacccuucguugcggacgacuaucucgucaggcacgcauacaagaacccaaacgagauauacagcgaaaucagcgagguagccaaacuuaaggacgccaaauccgaagucaagaaaucgcaguacuucucaaccuucacgcuacguggcagcuacaccgggggagcaagcaaaggaaaacucgaggaccaaaaagcaaugaacaaguuuauugacgacagccuaaagaaacuagauacauauuccugguccggcuacaaaacgcuaacggcauacuucacgaacuacaagguugacucaaguaaccgcguaacauacgacguaguuuuccacggauaccuaccaaaugaaggcgacuccaaaaacucgcugccauacggaaaaaucaauggcacauacaaagggacagagaaggagaaaaucaaauucaguucagaaggauccuucgacccagacggcaaaaucguuucauaugaaugggauuucggagacgggaacaaaucaaacgaagaaaacccugagcacagcuacgacaaagucggcacauauacaguaaagcucaaagucacggacgacaagggcgagagcagcguaagcacgaccaccgcagaaaucaaggaccucuccgaaaauaaacucccagucauauacaugcacguaccaaaaucgggcgcccucaaccagaaaguaguguucuacggaaaaggcacauacgauccggacggauccauagcaggcuaccaaugggauuucggagaugggagcgacuucucgagcgaacaaaacccgucacacgucuacacuaaaaagggcgaguacaccguaacccuucggguaauggacuccuccggacaaaugucugagaaaaccaugaaaaucaagauaaccgacccaguauaccccaucggcaccgaaaaagaaccaaacaacuccaaagaaacugccuccggccccaucguaccgggaaucccagucuccggcaccaucgaaaacaccagcgaccaagauuacuucuacuucgacguaaucacccccggagaagucaaaaucgacaucaacaaacugggcuacggaggagcuaccuggguagucuacgacgaaaacaacaacgccgucaguuacgccaccgacgacgggcaaaaccuguccgguaaauuuaaggccgacaagccagggcgauacuacauccaccuguauauguuuaacggauccuauaugcccuaccgaauaaauaucgaaggaaguguaggccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3439 - RNA, 958 nt, Artificial Sequence
  mRNA product Design2 comprising derived and/or modified sequence from Homo sapiens__NP_001133.1__HsAMELX (opt9)
ggggcgcugccuacggagguggcagccaucuccuucucggcaucaagcuuaccaugggaacauggauacucuucgcaugccuccucggcgcagccuucgccaugccccucccuccccaccccggccaccccggcuacaucaacuucuccuacgaaguccucacaccccucaaaugguaucaauccaucagaccacccuaccccuccuacggcuacgaacccaugggcggcuggcuccaccaccaaaucauccccguccucucacaacaacacccucccacccacacccuccaaccccaccaccacauccccguaguccccgcccaacaacccgucaucccccaacaacccaugaugcccguccccggccaacacucaaugacccccauccaacaccaccaacccaaccucccaccacccgcccaacaacccuaccaaccccaacccguccaaccccaaccccaccaacccaugcaaccccaaccacccguacaccccaugcaaccccucccaccccaaccaccccuaccucccauguuccccaugcaaccccucccacccaugcuccccgaccucacccucgaagccuggcccuccaccgacaaaaccaaacgcgaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3440 - RNA, 517 nt, Artificial Sequence
  mRNA product Design2 comprising derived and/or modified sequence from Homo sapiens__NP_001133.1__HsAMELX-TRAP (opt9)
ggggcgcugccuacggagguggcagccaucuccuucucggcaucaagcuuaccaugccccuacccccccacccaggccaccccggcuacauaaacuucuccuacgaaguacucacaccccuaaaaugguaccaauccauccgaccccccuaccccucauacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3441 - RNA, 550 nt, Artificial Sequence
  mRNA product Design2 comprising derived and/or modified sequence from Homo sapiens__NP_001133.1__HsAMELX-LRAP (opt9)
ggggcgcugccuacggagguggcagccaucuccuucucggcaucaagcuuaccaugccccuccccccccaccccggccaccccggcuacauaaacuucucauacgaaguccucaccccccuaaaaugguaccaauccauccgccccccccccaugcuccccgaccucacacucgaagccuggcccucaaccgacaaaacaaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3442 - RNA, 589 nt, Artificial Sequence
  mRNA product Design2 comprising derived and/or modified sequence from Homo sapiens__NP_001133.1__HLA-A2-SP_HsAMELX(17-60) (opt9)
ggggcgcugccuacggagguggcagccaucuccuucucggcaucaagcuuaccauggccguaauggccccccgaacccucguccuccuacucucaggagcccucgcccucacccaaaccugggccaugccccucccaccccacccaggccaccccggauacaucaacuucuccuacgaaguacucaccccccuaaaaugguaccaauccauccgcccccccuaccccucauacggcuacgaacccaugggcggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3443 - RNA, 622 nt, Artificial Sequence
  mRNA product Design2 comprising derived and/or modified sequence from Homo sapiens__NP_001133.1__HLA-A2-SP_HsAMELX(17-47,168-191) (opt9)
ggggcgcugccuacggagguggcagccaucuccuucucggcaucaagcuuaccauggccguaauggcaccccgcacccucguccuacuccuauccggcgcccucgcccucacacaaaccugggccaugccccucccaccccaccccggccaccccggcuacauaaacuucuccuacgaaguccucaccccacucaaaugguaccaauccauccgcccaccacccaugcuacccgaccucacacucgaagccuggcccuccaccgacaaaacaaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3444 - RNA, 961 nt, Artificial Sequence
  mRNA product Design2 comprising derived and/or modified sequence from Homo sapiens__NP_001134.1__HsAMELY (opt9)
ggggcgcugccuacggagguggcagccaucuccuucucggcaucaagcuuaccaugggcaccuggauccucuucgccugccuagucggcgccgccuucgccaugccccucccaccccaccccggccaccccggcuacaucaacuucuccuacgaaguccuaacaccccuaaaaugguaccaauccaugauccgcccacccuacuccuccuacggcuacgaacccaugggcggauggcuccaccaccaaaucauccccgucgucucccaacaacacccccucacccacacccuccaaucacaccaccacauccccguaguccccgcccaacaaccccgcguacgacaacaagcccucaugcccguccccggccaacaauccaugacccccacccaacaccaccaacccaaccucccacuccccgcacaacaacccuuccaaccccaacccguccaaccccaaccccaccaaccaaugcaaccccaaccacccguccaacccaugcaaccccucuuaccccaaccaccccuaccacccauguucccccuccgcccccuaccacccauccuccccgaccuccaccucgaagccuggcccgccaccgacaaaacaaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3445 - RNA, 520 nt, Artificial Sequence
  mRNA product Design2 comprising derived and/or modified sequence from Homo sapiens__NP_001134.1__HsAMELY-TRAP (opt9)
ggggcgcugccuacggagguggcagccaucuccuucucggcaucaagcuuaccaugccccuaccaccccacccaggccaccccggcuacaucaacuucucauacgaaguccucaccccccuaaaaugguaccaaucaaugauccgccccccauacucauccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3446 - RNA, 553 nt, Artificial Sequence
  mRNA product Design2 comprising derived and/or modified sequence from Homo sapiens__NP_001134.1__HsAMELY-LRAP (opt9)
ggggcgcugccuacggagguggcagccaucuccuucucggcaucaagcuuaccaugccccuccccccccacccaggccaccccggcuacaucaacuucuccuacgaaguacucaccccccuaaaaugguaccaauccaugauccgccccccccccauacuccccgaccuccaccucgaagccuggcccgccacagacaaaaccaaacaagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3447 - RNA, 592 nt, Artificial Sequence
  mRNA product Design2 comprising derived and/or modified sequence from Homo sapiens__NP_001134.1__HLA-A2-SP_HsAMELY(17-61) (opt9)
ggggcgcugccuacggagguggcagccaucuccuucucggcaucaagcuuaccauggcagucauggcaccccgcacccucguccuccuccucuccggcgcccucgcccuaacccaaaccugggcaaugccacuacccccacaccccggccaccccggcuacaucaacuucucauacgaaguccuaacaccccucaaaugguaccaaucaaugauccgcccacccuacuccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3448 - RNA, 625 nt, Artificial Sequence
  mRNA product Design2 comprising derived and/or modified sequence from Homo sapiens__NP_001134.1__HLA-A2-SP_HsAMELY(17-48,169-192) (opt9)
ggggcgcugccuacggagguggcagccaucuccuucucggcaucaagcuuaccauggccgucauggcaccccgaacacucguccuccuccucuccggcgcccucgcccucacacaaacaugggccaugccccucccaccccaccccggccaccccggcuacaucaacuucuccuacgaaguccucacaccccuaaaaugguaccaauccaugauccgcccacccccaauacuccccgaccuacaccucgaagccuggcccgccaccgacaaaaccaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3449 - RNA, 952 nt, Artificial Sequence
  mRNA product Design2 comprising derived and/or modified sequence from Sus scrofa__NP_999071.1__SsAMELX-001-1 (opt9)
ggggcgcugccuacggagguggcagccaucuccuucucggcaucaagcuuaccaugggcaccuggauacucuucgccugccuccucggcgccgccuucuccaugccccuaccaccccaccccggacaccccggcuacaucaacuucuccuacgaaguccuaacaccccucaaaugguaccaaaauaugauacgccaccccuacacauccuacggcuacgaacccaugggcggauggcuccaccaccaaaucauccccgucgucucacaacaaaccccacaaucccacgcccuccaaccccaccaccacauccccaugguccccgcccaacaacccggcaucccccaacaacccaugaugccccuccccggccaacacuccaugacccccacccaacaccaccaacccaaccuaccccuacccgcccaacaacccuuccaaccccaacccguacaaccccaaccccaccaaccccuucaaccccaaucucccaugcaccccauccaaccccuccucccccaaccaccccuuccacccauguucucaaugcaaucacuccuccccgaccucccccucgaagccuggcccgccaccgacaaaaccaaacgagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3450 - RNA, 520 nt, Artificial Sequence
  mRNA product Design2 comprising derived and/or modified sequence from Sus scrofa__NP_999071.1__SsAMELX-TRAP (opt9)
ggggcgcugccuacggagguggcagccaucuccuucucggcaucaagcuuaccaugccccuaccaccccaccccggccaccccggcuacaucaacuucuccuacgaaguccuaacaccccuaaaaugguaccaaaacaugauccgccacccauacaccucauacggcuacgaaccaaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3451 - RNA, 553 nt, Artificial Sequence
  mRNA product Design2 comprising derived and/or modified sequence from Sus scrofa__NP_999071.1__SsAMELX-LRAP (opt9)
ggggcgcugccuacggagguggcagccaucuccuucucggcaucaagcuuaccaugccccucccaccccaccccggccaccccggcuacaucaacuucuccuacgaaguccuaacaccccucaaaugguaccaaaacaugauccgacaccccucccuacuccccgaccucccccuagaagcauggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3452 - RNA, 592 nt, Artificial Sequence
  mRNA product Design2 comprising derived and/or modified sequence from Sus scrofa__NP_999071.1__HLA-A2-SP_SsAMEL(17-61) (opt9)
ggggcgcugccuacggagguggcagccaucuccuucucggcaucaagcuuaccauggccgucauggcaccccgcacccuaguccuccuccucucaggcgcccucgcacucacccaaacaugggccaugccccuacccccacaccccggccacccaggcuacaucaacuucucauacgaaguccucaccccacuaaaaugguaccaaaacaugauacgccaccccuacaccucauacggauacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3453 - RNA, 625 nt, Artificial Sequence
  mRNA product Design2 comprising derived and/or modified sequence from Sus scrofa__NP_999071.1__HLA-A2-SP_SsAMEL(17-49,167-189) (opt9)
ggggcgcugccuacggagguggcagccaucuccuucucggcaucaagcuuaccauggccgucauggcaccccgcacucucguccuccuacucuccggcgcccuagcccucacccaaaccugggccaugccccuacccccacaccccggccaccccggcuacaucaacuucucauacgaaguccucaccccacuaaaaugguaccaaaacaugauccgccaucccucacuccuccccgaccucccccuagaagccuggcccgccacagacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3454 - RNA, 916 nt, Artificial Sequence
  mRNA product Design2 comprising derived and/or modified sequence from Sus scrofa__P45561-2__SsAMELX-001-2 (opt9)
ggggcgcugccuacggagguggcagccaucuccuucucggcaucaagcuuaccaugggcaccuggauacucuucgccugccuccucggcgcagccuucuccaugccccucccaccccaccccggccaccccggcuacaucaacuucucuuacauccgccaccccuacaccuccuacggcuacgaacccaugggcggcuggcuacaccaccaaaucauccccgucguaucccaacaaaccccacaaucacacgcucuccaaccccaccaccacauccccaugguccccgcccaacaacccggcaucccccaacaacccaugaugccccuccccggccaacacuccaugacccccacccaacaccaccaacccaaccucccccucccagcccaacaacccuuccaaccccaacccguccaaccccaaccacaccaaccacuacaaccacaaucccccaugcaccccauccaaccacuccucccccaaccaccccucccacccauguucucaaugcaaucccuccuacccgaccuuccccuugaagccuggcccgccaccgacaaaaccaaacgagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3455 - RNA, 952 nt, Artificial Sequence
  mRNA product Design2 comprising derived and/or modified sequence from Sus scrofa__NP_998965.1__SsAMELX-001-3 (opt9)
ggggcgcugccuacggagguggcagccaucuccuucucggcaucaagcuuaccaugggcaccuggaucuucuucgcaugccuccuaggcgccucccucgccaugccccucccaccccaccccggacaccccggcuacaucaacuucuccuacgaaguccucaccccacuaaaaugguaccaaaacaugauccgccaccccuacaccuccuacggauacgaacccaugggaggcuggcuccaccaccaaaucauccccgucgucucacaacaaacaccccaaucccacgcacuccaaccccaccaccacauccccaugguccccgcccaacaacccggaaucccccaacaacccaugaugccccuccccggacaacacuccaugacccccacccaacaccaccaaccaaaccucccccuccccgcccaacaacccuuccaaccacaacccguccaaccccaaccccaccaaccacuccaaccccaaucccccaugcaccccauccaaccacuccucccccaaccaccccucccacccauguucucaaugcaaucccuccuucccgaccucccccucgaagccuggcccgccaccgacaaaaccaaacgcgaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3456 - RNA, 601 nt, Artificial Sequence
  mRNA product Design2 comprising derived and/or modified sequence from Sus scrofa__K7GPB2__SsAMELX-002 (opt9)
ggggcgcugccuacggagguggcagccaucuccuucucggcaucaagcuuaccaugggcaccuggauacucuucgccugccuacucggcgccgcauucucaaugccccuccccccccaccccggccaccccggcuacauaaacuucuccuacgaaguccucaccccccucaaaugguaccaaaacaugauuagacacccaucccuccuccccgaccucccccucgaagcauggcccgcaaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3457 - RNA, 994 nt, Artificial Sequence
  mRNA product Design2 comprising derived and/or modified sequence from Sus scrofa__K7GLD0__SsAMELX-003 (opt9)
ggggcgcugccuacggagguggcagccaucuccuucucggcaucaagcuuaccaugggcacauggauccucuucgccugccuacucggagccgcuuuuuccaugccccucccuccccaccccggccaccccggcuacauaaacuucuccuacgaagaccucuaccucgaagccauccgcaucgaccgcaccgccuucguccucacaccccuuaaaugguaccaaaacaugauccgccaccccuacaccuccuacggcuacgaacccaugggcgguuggcuccaccaccaaaucauccccguagucucacaacaaaccccacaaucccacgcccuccaaccccaccaccacauaccaaugguccccgcccaacaaccaggcaucccccaacaacccaugaugccccuccccggccaacacuccaugaccccaacccaacaccaccaacccaaccucccccuccccgcccaacaacccuuccaaccccaacccguccaaccccaaccccaccaaccccuccaaccccaaucccccaugcaccccauccaaccucuccucccccaacccccacucccaccaauguucucaaugcaaucacuccuccccgacuuaccccuagaagccuggcccgccaccgacaaaaccaaacgagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3458 - RNA, 880 nt, Artificial Sequence
  mRNA product Design2 comprising derived and/or modified sequence from Sus scrofa__K7GPE9__SsAMELX-004 (opt9)
ggggcgcugccuacggagguggcagccaucuccuucucggcaucaagcuuaccaugggcaccuggauccucuucgccugccuccucggcgccgccuucuccaugccccucccaccccaccccggccaccccggcuacaucaacuucucauaugaaguccucacaccccucaaaugguaccaaaacaugauccgccaccccacaccccaaucccacgcccuccaaccacaccaccacauccccaugguccccgcccaacaaccaggcaucccacaacaacccaugaugccccuaccaggccaacacuccaugacccccacccaacaccaccaacccaaccuaccccuccccgcacaacaacccuuccaaccacaacccguccaaccccaaccccaccaaccccuacaaccccaaucccccaugcacccaauccaaccccuccucccccaaccaccccucccacccauguucuccaugcaaucacuccuccccgaccucccccuagaagccuggcccgcaaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3459 - RNA, 904 nt, Artificial Sequence
  mRNA product Design2 comprising derived and/or modified sequence from Sus scrofa__J9JIM4__SsAMELX-201 (opt9)
ggggcgcugccuacggagguggcagccaucuccuucucggcaucaagcuuaccaugccccucccaccccaccccggccaccccggcuacaucaacuucuccuacgaaguacucaccccucucaaaugguaccaaaacaugauccgacaccccuacaccuccuacggcuacgaacccaugggcggcuggcuccaccaccaaaucauccccgucgucucccaacaaacaccccaaucccacgcacuacaaccccaccaccacauccccaugguccccgcccaacaacccggcaucccccaacaacccaugaugccacuccccggccaacacuccaugacccccacccaacaccaccaacccaaccucccccuacccgcccaacaacccuuccaaccccaacccguccaaccacaaccucaccaaccacuccaaccccaaucacccaugcaccccauccaaccacuccuaccccaacccccacucccacccauguucuccaugcaaucacuccuccccgaccucccccuagaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3460 - RNA, 3343 nt, Artificial Sequence
  mRNA product Design2 comprising derived and/or modified sequence from Homo sapiens__NP_006120.1__HsBMP1 (opt9)
ggggcgcugccuacggagguggcagccaucuccuucucggcaucaagcuuaccaugccaggagucgcccggcuaccccuacuccuaggacuccuccuacuaccacgcccuggacgaccccuagaccuggccgacuacacguacgaccuagccgaagaagacgacuccgaaccccucaacuacaaagaccccugcaaggccgccgccuuccuaggcgacauagcccuagacgaagaagaccuccgagccuuccaaguccaacaagcggucgaccugcgccgacacacggccaggaaaucauccauaaaagccgcuguaccgggaaacacaucaacccccucaugccaaucgacaaacggacaaccacaaaggggcgcaugcggaagauggcgcgggcgaucacgcucacgccgcgcagccacaagccgcccggagcgaguguggcccgacgggguaauacccuucgucauagggggaaacuucacuggaucacaacgggcagucuuuagacaagcaaugagacacugggaaaagcauaccugcgucacauuccuagaacggaccgacgaagauucauacaucguauucaccuaccgcccaugcggauguugcucauacguaggccgaagaggcggcggcccccaagcgauaucgauaggcaagaacugcgacaaauucgggauaguuguacacgaacuaggacacgucguaggcuucuggcacgaacacaccagacccgaccgggaccggcacguauccauaguccgcgaaaacauccaacccggacaagaauacaacuuccuaaaaauggaaccacaagaagucgaaucgcuaggcgaaaccuaugacuucgauuccaucaugcacuaugcucgcaacaccuucucacgaggcaucuuccucgacaccaucguccccaaauacgaaguuaacggagucaaaccacccauaggacaacgcacgcgacucucaaaaggcgauaucgcucaagcacgcaaacucuacaagugucccgccugcggcgaaacgcuccaggacucgacaggcaacuucucaucccccgaauacccgaacggauacagcgcacacaugcacugugucuggcgaaucucaguaacaccaggcgagaaaaucauccuuaacuucacaucccucgaccuguacagaucccgccucugcugguacgauuacgucgaagucagagacggguucuggcgaaaagcaccgcuccgaggccgauucuguggauccaaacugccagaacccauagucuccacagacucucgacucuggguugaguucagaagcucuaguaacugggucggcaaaggcuucuucgccgucuacgaagcaaucugcggaggagacguaaagaaagauuacggccacauacagucccccaacuaccccgacgacuaccggcccaguaaaguauguaucuggagaauccagguaagcgaaggcuuccauguugggcucaccuuucagagcuucgaaauagaacgccacgacucaugcgcuuaugacuaucucgaaguacgcgacggccacuccgaaucaagcacacucauaggcagauacugcggauacgaaaaacccgaugacaucaaauccacguccagccgccuauggcucaaauucgucucagauggaagcauaaacaaagccggauuugcuguuaacuucuucaaggaaguagacgagugcucccgacccaaccgcggcgggugcgaacaacgcugccucaacacacucgguuccuacaaaugcagcugcgacccaggcuacgaacuagccccugauaagcgucgcugcgaagcagccugcgguggguuccucacaaaacuaaacggauccauaacaagcccuggcuggccaaaagaauaucccccuaacaagaacugcaucuggcaacugguggcgcccacacaauaccgaauaagccuacaauuugacuucuucgagacagaaggaaaugacgugugcaaguacgacuucguagaaguccgcuccggguuaaccgccgacuccaagcugcaugggaaauucugcggauccgaaaaaccagaagugauuacgagccaauacaacaacaugcgagucgaguucaagucagacaacacagucuccaagaaaggcuuuaaagcucacuucuucucagacaaagacgagugcucaaaagacaauggagggugucaacaagacugcguuaacacauucggguccuacgaaugccaaugccgcucuggguucguacuucacgauaacaagcacgacugcaaagaagccggaugcgaccacaaggugacaagcaccuccggcaccauaacgucccccaacuggccagauaaauaccccucaaagaaagaaugcacgugggccaucaguagcacucccggccacagagucaaacucacauucauggaaauggacaucgaaagccagccggagugcgcguacgaccaccucgaaguguucgacggacgcgacgcgaaggcuccagugcucggccgauucugcggauccaagaagccagaaccagucuuagcaacuggaagccgaauguuccuacgauucuacuccgacaauuccguucaacgaaaaggcuuccaagccucccacgccaccgaaugcggcggacaaguccgagcggacguaaaaaccaaagaccucuacagccacgcgcaauucggggacaacaacuacccagguggcguagacugcgaauggguaauagucgcagaagaaggcuacggagucgagcuaguauuccagaccuucgaaguugaagaagaaacagacugcggcuacgacuacauggaacuauucgacgguuacgacuccaccgcaccccggcucggacgguacugcggcuccggcccaccagaagaaguauacucagcaggagacagcguccucgucaaauuccacuccgaugauaccauaacaaagaaaggguuucaccuacgcuacacgagcaccaaauuccaagacacucuacacagccgcaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3461 - RNA, 1573 nt, Artificial Sequence
  mRNA product Design2 comprising derived and/or modified sequence from Homo sapiens__NP_001191.1__HsBMP2 (opt9)
ggggcgcugccuacggagguggcagccaucuccuucucggcaucaagcuuaccaugguagccggcacccgaugccuacucgcccuccuucucccccaaguccuccuaggcggcgccgccggccuggucccagaacuaggccgccgcaaauucgcagccgcauccuccggacgcccaucaucacagcccuccgacgaaguccucuccgaguucgaacucagacuacuaucgauguucggccuuaaacaacgccccaccccaucccgugacgccguagucccaccauacaugcucgaccuauaccgccgccacuccgggcaacccggaucaccagcacccgaccaccgccucgaacgcgccgcaucccgcgccaacacaguccgcuccuuccaccacgaagaaucccucgaagaacuccccgaaacaucaggcaaaacaacccgccgauucuucuucaaccucuccuccauacccacagaagaguucaucaccuccgcagaauuacaagucuuccgcgaacaaaugcaagacgcacucggcaacaacuccuccuuccaccacagaaucaacaucuacgaaaucaucaaacccgcaaccgccaacagcaaauucccaguaacccgacuccuugacacacgacucgucaaccaaaacgccuccagaugggaaucauucgacgucacaccagcagucaugcgcuggaccgcccaaggccacgcaaaccauggauucgugguagaagucgcccaccuagaagaaaaacaaggagucuccaaacgccacguccgcaucucacgcucccuccaccaagacgaacacucauggucacaaauccgaccccuccuaguaacauucggacacgacggcaaaggccacccccuacauaaacgcgaaaaacgacaagccaaacauaagcaacgaaaacgccucaaaucaagcuguaaacgucauccacucuacgucgacuucucugacgucggcuggaacgacuggaucguagcaccacccggcuaccacgccuuuuacugccacggagaaugccccuucccccucgccgaccaccuaaauuccaccaaccacgcaauaguccaaacccuaguuaacuccgucaacuccaaaaucccaaaagcaugcugcguucccacagaacucucagcaaucuccaugcucuaccuugacgaaaacgaaaaagucguccugaaaaacuaccaagacauggucgucgaaggcugcggcugccgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3462 - RNA, 1609 nt, Artificial Sequence
  mRNA product Design2 comprising derived and/or modified sequence from Homo sapiens__NP_001193.2__HsBMP4 (opt9)
ggggcgcugccuacggagguggcagccaucuccuucucggcaucaagcuuaccaugauacccggcaaccguaugcucauggucguccuccucugccaaguacuccucggcggagccucacacgcaucucucauacccgaaacuggcaaaaaaaaagucgccgaaauccaaggccacgcaggaggacgccgcucaggucaaucccacgaacuccuacgcgacuucgaagccacccuacuacaaauguucggccuccgacgccgaccccagcccuccaaauccgccgucauacccgacuacaugcgcgaccucuaccgacuucaauccggcgaagaagaagaagaacaaauacacagcaccggccucgaauaccccgaacguccagccucccgcgccaacaccguccgcucuuuccaccacgaagaacaccucgaaaacauccccggcacauccgaaaacuccgccuuccgauuccucuucaaccuauccucaauccccgaaaacgaagucauauccuccgccgaacuccgucucuuccgcgaacaaguagaccaaggccccgauugggaacgcggcuuccaccgcaucaauaucuacgaagucaugaaaccaccagccgaagucguacccggacaccucaucacacgcuuacuagacacccgccucguccaccacaacguaacacgcugggaaaccuucgacgucuccccagcuguucuccgauggacacgcgaaaaacaacccaacuacggccucgccaucgaagucacccaccuccaccaaacccgaacccaccaaggccaacacgucagaaucucccgcucucucccccaaggcucaggcaacugggcccaacuacgcccccuacuugucaccuucggccacgacggacgaggccacgcacuaacgcgacgccgccgcgccaaacgcucacccaaacaccacucucagcgcgccagaaaaaaaaacaaaaauugccgccgacacucacuguacgucgacuucagcgacgucggcuggaaugacuggaucgucgccccccccggcuaccaagcauucuacugccacggcgacugcccauucccacuagcugaccaccucaacucgaccaaccacgcaauuguacaaacccucgucaauuccgucaacagcuccaucccaaaagcaugcugcgugcccaccgaacucuccgcuaucuccaugcucuaccucgacgaauacgacaaagucguacucaaaaacuaccaagaaauggucgucgaaggaugcggcugccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3463 - RNA, 1924 nt, Artificial Sequence
  mRNA product Design2 comprising derived and/or modified sequence from Homo sapiens__NP_001709.1__HsBMP6 (opt9)
ggggcgcugccuacggagguggcagccaucuccuucucggcaucaagcuuaccaugcccggucuaggccgccgcgcacaguggcucugcuggugguggggacuacucugcuccugcugcggcccuccccccuuacguccacccuuaccagcagccgccgccgcggcagcaggaggccaacuacucggcgacgguggcucccccggacgaacggaacaacccccccccucaccccaauccucaagcggcuuccucuaccgccgccucaaaacccaagaaaaacgagaaaugcaaaaagaaauacuauccguccuaggccuuccacaccggccccgcccacuccacggccugcaacaaccccagccacccgcccuccgccaacaagaagaacaacaacaacaacaacaacucccccggggugaacccccuccaggccgccuaaaaucugccccucucuucaugcucgaccucuacaaugcccuauccgccgauaacgacgaagauggagcgucagaaggagaacgccaacaaucauggccccacgaagccgccuccucaucccaacgccgacaacccccgcccggcgccgcccacccccuaaaccguaaaucccugcucgcccccggcucaggcagcgguggugcauccccacucaccucggcccaagacuccgcauuccuaaacgacgcagacauggucaugagcuucgucaaccuagucgaauacgacaaagaauucuccccacgccaacgacaccauaaagaauucaaauucaaccucucacagauacccgaaggagaagucgucaccgccgcagaauuccgaaucuacaaagacugcguaauggguagcuucaaaaaccaaacauuccuaaucucuauauaccaaguacuccaagaacaccaacaccgugacagugaccuauuccuccucgacacccgagucguuugggccucagaagaaggcuggcucgaauucgacaucacagcaaccagcaaccuauggguaguaacaccgcaacacaacaugggccuacaacuauccguagucacccgagacggaguacacguucacccgcgcgcagccggccucguaggacgcgacggccccuacgacaaacagcccuucauggucgccuucuucaaagucuccgaaguacacguccgcaccacccgcuccgccuccucucgacgccgccaacaaucccgaaaccgauccacccaaucccaagacgucgcccgcguuuccucugccucagacuacaauuccucagaacucaaaaccgccugccgaaaacacgaacuauauguaucauuccaagaccuuggcuggcaagacuggaucaucgcccccaaaggcuacgcagccaacuacugcgacggcgaaugcuccuucccacuaaacgcccacaugaacgccaccaaccacgccaucguccaaacacucgugcaccuuaugaaccccgaauacguacccaaaccaugcugcgcccccaccaaacuaaacgccaucuccguacucuacuucgaugacaacuccaacgucauacuaaaaaaauaccguaacaugguaguacgcgccugcgguugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3464 - RNA, 1678 nt, Artificial Sequence
  mRNA product Design2 comprising derived and/or modified sequence from Homo sapiens__NP_001710.1__HsBMP7 (opt9)
ggggcgcugccuacggagguggcagccaucuccuucucggcaucaagcuuaccaugcacgugcguucacuacgagcagccgccccacacucauucgucgcccucugggcuccccuuuuucuccuacgcucugcccucgccgacuucucccuagacaacgaaguacacagcucauucauccaccgccgucuccgcucucaagaaagacgcgaaaugcaacgugaaauccucuccauccucggccucccccaccgaccccgcccccaccuacaaggcaaacacaacuccgcccccauguucaugcucgaccucuacaacgccauggccguagaagaaggaggaggacccgguggccaaggcuucuccuaccccuacaaagccgucuuuuccacccaaggucccccgcucgcaucacuccaagacucccacuuccucaccgacgccgacauggucaugucauucgucaaccuugucgaacacgacaaagaguucuuccacccccgcuaccaccaucgcgaguuccgcuucgaccucagcaaaauucccgaaggcgaagccgucaccgccgccgaguuccgaaucuacaaagacuacauccgugaacgcuucgacaacgaaacuuuccgcaucucagucuaccaaguccuccaagaacaccuaggccgcgaaucagaccucuuucuccucgacucacgaacccucugggccucagaagaaggauggcucgucuucgacaucacagccacauccaaccacugggucgucaacccucgccacaaccuuggacuccaacuguccgucgaaacccucgacggccaauccauaaaccccaaacucgccggccucauaggccgacacggaccccaaaacaaacaaccauucauggucgcauuuuucaaagcaaccgaaguccacuuuagauccauccguuccaccggaucaaaacaacgcucccaaaaccgcuccaaaacccccaaaaaccaagaagcccuccgcauggccaacguagcagaaaacuccuccagcgaccaacgccaagccugcaaaaagcacgaacucuacguaucauuucgagaccucggcuggcaagacuggauaaucgccccagaaggcuacgccgcauacuacugcgaaggagaaugcgccuucccccuaaauuccuacaugaacgccaccaaccacgccaucguccaaacccucguccacuucaucaaccccgaaacugucccaaaacccugcugcgcccccacacaacuaaacgccaucucaguccucuacuuugacgacucaucuaacguaauccuaaagaaauaucgcaacaugguaguccgcgccugcgguugccacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3465 - RNA, 682 nt, Artificial Sequence
  mRNA product Design2 comprising derived and/or modified sequence from Homo sapiens__NP_006264.2__HsCCL7 (opt9)
ggggcgcugccuacggagguggcagccaucuccuucucggcaucaagcuuaccaugaaagccuccgccgcccuccuaugccuccuccucaccgccgccgcauucuccccccaaggccucgcccaaccagucggcauaaacaccuccaccaccugcugcuaccgauucaucaacaaaaaaaucccaaaacaacgacucgaauccuaccgccgcaccaccuccucccacugcccccgagaagccgucaucuucaaaaccaaacucgacaaagaaaucugcgccgacccaacccaaaaauggguccaagacuucaugaaacaccuagacaaaaaaacccaaaccccaaaacucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3466 - RNA, 4006 nt, Artificial Sequence
  mRNA product Design2 comprising derived and/or modified sequence from Homo sapiens__NP_001954.2__HsEGF (opt9)
ggggcgcugccuacggagguggcagccaucuccuucucggcaucaagcuuaccaugcucuuaacccuuaucauacuucuucccgucgucagcaaguucagcuuugucucacucagugcaccccaacacuggagcugccccgaaggaacacuugccggcaacggcaauagcacaugcguugggccggcucccuuccuaauauucagccacggaaacagcauauuccgaaucgacacagagggaaccaacuacgaacagcugguagucgacgcuggcguaagcgucaucauggacuuccacuacaacgagaagcgaaucuacuggguagaucucgaacgccaacuacugcaacggguauucuugaacggcucgcgacaggagcgcgucugcaauaucgaaaagaacgucucaggaauggcuaucaacuggauuaaugaagaggugauauggagcaaccaacaggagggaaucauaaccgucacagacaugaaggguaacaacucccacauccuucucagcgcgcucaaauacccugcaaaugucgccguggauccugucgaacguuuuauauucuggucaagugaaguagccggcucccucuacagagccgaccucgacgguguaggggucaaggcacuacucgaaacguccgagaaaauaacagcaguaucgcuggacguacucgacaaacgccuauucuggauucaguacaaccgagaaggcagcaacuccuuaaucugcaguugcgacuacgacggagguagcgugcauauaaguaaacacccaacgcagcacaaccuauuugccaugucacuguucggggaccgcaucuucuacagcaccuggaaaaugaaaacaauauggaucgcaaacaaacacaccggcaaggauaugguccgcaucaaccuacacucuucauucguaccccuaggggagcucaaaguagugcacccucucgcccaaccaaaagcagaggaugauaccugggaacccgaacaaaagcugugcaaacuccgaaagggcaacugcucgagcaccgucugcggacaagaccugcaaagccaccucugcaugugugcggaaggauacgcacucucacgagaccggaaguacugcgaggacgucaacgaaugcgccuucuggaaccacggaugcacucuuggauguaagaacaccccaggauccuauuacuguaccugcccagucggauucguacuacuaccagacggaaaacgaugccaccaacugguauccugcccccgaaacguauccgaaugcucccacgauugcguccuaaccucagaggggccccucugcuucugcccagagggauccguguuagaacgcgacggcaagacuugcagcggcugcagcagcccagacaacggcgggugcagccaacuaugcguaccacuaucaccaguuucaugggaaugcgacugcuucccggguuacgaccuccagcucgacgaaaaaucaugugcggccagcggaccacagcccuuccuccuauucgccaauucacaagacauccggcacaugcacuucgacggcaccgacuacgguacccuacugagccaacaaauggguaugguguacgcgcucgaccacgacccaguagaaaacaaaauauacuucgcccacacagcccucaaguggaucgaacgagccaacauggauggaucacaacgcgagcggcuaauagaggaagguguggacgugccagaaggccuggccguagacuggauaggccgcagauucuauuggacagacagagguaaaucacucaucggacgaucagaccucaacggcaaaagguccaaaaucaucacuaaagagaacauaucacaaccacgcggcauagccguccaccccauggccaaacgccucuucuggaccgacacgggcaucaacccaagaauagaguccagcagccuccagggccuaggaagacuuguaaucgcaucguccgaucucauuuggcccagcgggaucacaaucgauuuccuaacugacaaacucuacuggugcgacgccaaacaaaguguaaucgaaauggcaaaccucgacggaucgaaacgacggcgccucacccaaaacgauguuggccaucccuucgcaguagcagucuuugaggacuacgucugguucagcgacugggccaugcccuccguaaugcggguuaacaaacgcaccggcaaagaccgaguccgacuacaggguuccaugcuuaaaccgagcucccuaguuguaguacacccacuagcaaaacccggggccgaccccugcuuauaucaaaacggaggaugcgaacacaucugcaagaaacgccucggcaccgcaugguguagcugccgagaaggauuuaugaaagccuccgacggcaaaaccugucuggcccuagauggccaccaacuccuugcgggcggcgaaguagaccuuaaaaaccaagugaccccgcuagacauacucucaaaaacgcgcgucucagaagacaacaucacagaaagccaacacaugcucguagcagaaaucaugguaagcgaccaagacgacugcgcacccguaggaugcagcauguaugcacggugcauaagcgaaggagaagacgcgaccugccaaugccuaaaaggauucgccggagacgguaagcucugcucagauauugacgaaugcgaaaugggaguacccguguguccacccgccagcucaaagugcaucaacacugaaggaggcuacgucugcagaugcagcgagggcuaucaaggcgacggcauccauugccuagauauagacgagugccagcuaggcgagcacucgugcggcgagaacgcgucgugcacaaacacggaagguggcuauacaugcaugugcgccggaagacucagcgaaccgggucuaauuugccccgacagcaccccaccuccacaccuucgcgaagacgaccaccacuacuccguccgcaacucggacucagaaugcccccucagucaugauggcuacugcuugcaugacggcguuuguauguauaucgaagcccuagacaaguacgcaugcaacugcgucguagguuacaucggagagcgcugccaauaucgcgaccuaaaauggugggaacucagacacgcaggucacggucagcaacaaaagguuaucgucguagccguuugugucgugguccuagucaugcuccuucuccuaucgcucuggggcgcccacuacuacagaacccaaaaacuccuauccaaaaacccgaaaaaucccuacgaagaaucgaguagggacguacguucgcgacgacccgcagacacggaagacggcaugaguucgugcccccaaccaugguucguaguuauuaaggaacaucaagauuugaaaaacggcggacagccagucgccggagaggacggccaagcagcagauggauccaugcaacccacaucauggagacaagaaccccaacuaugcggaaugggaacggaacaaggcugcuggauuccagucaguuccgacaaaggcucaugcccacaaguaauggaacgaucguuccacaugccauccuacggaacccaaacacucgaaggcgguguagaaaagccacacagccuccucucggcaaacccccuauggcagcagcgcgcacuagacccuccccaucaaauggagcugacccaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3467 - RNA, 892 nt, Artificial Sequence
  mRNA product Design2 comprising derived and/or modified sequence from Homo sapiens__NP_001423.1__HsEREG (opt9)
ggggcgcugccuacggagguggcagccaucuccuucucggcaucaagcuuaccaugaccgccggcagacgcauggaaaugcuaugcgccggccgaguccccgcacuccuacucugccucggcuuccaccuccuacaagccguccuauccaccacagucaucccaucaugcaucccaggcgaaagcucugacaacugcaccgcccuaguccaaaccgaagacaacccccgcgucgcccaagucuccaucacaaaaugcucauccgacaugaacggcuacugccuacacggccaaugcaucuaccucgucgacaugucccaaaacuacugcagaugcgaagucggcuacaccggaguccgcugcgaacacuucuuccucacaguacaccaaccucucuccaaagaauacgucgcccucaccgucauacucauuauccucuuccucaucaccguagucggcuccacauacuacuucugccgcugguaccgcaaccgcaaauccaaagaacccaaaaaagaauacgaacgcgucaccuccggcgaccccgaacucccccaaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3468 - RNA, 850 nt, Artificial Sequence
  mRNA product Design2 comprising derived and/or modified sequence from Homo sapiens__NP_000791.1__HsFGF1 (opt9)
ggggcgcugccuacggagguggcagccaucuccuucucggcaucaagcuuaccauggccgaaggcgaaaucacaaccuucaccgcccucaccgaaaaauucaaccucccccccggcaacuacaaaaaacccaaacuccuauacugcuccaacggcggacacuuccuccguauacuccccgacggcacagucgacggcacccgagaccgcucugaccaacacauccaacuccaacucucagccgaaucagucggcgaagucuacauaaaauccaccgaaacaggccaauaucucgcaauggacaccgacggccuucucuacggcucccaaacccccaacgaagaaugccucuuccucgaacgccuagaagaaaaccacuacaacacauacaucuccaaaaaacacgcagaaaaaaacugguucguaggccucaaaaaaaacggcuccugcaaacgcggcccccgcacccacuacggccaaaaagccauccucuuccucccccuacccgucucauccgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3469 - RNA, 1249 nt, Artificial Sequence
  mRNA product Design2 comprising derived and/or modified sequence from Homo sapiens__NP_001997.5__HsFGF2 (opt9)
ggggcgcugccuacggagguggcagccaucuccuucucggcaucaagcuuaccaugguagggguaggaggaggggauguagaagaugugacgccaaggccaggagggugucaaauaagcggaagaggggcaagaggcuguaacgggauaccgggggcagcggcgugggaggcagcgcugccgagaagacgaccacgaaggcauccgagugugaacccgcggucaagagcggcagggagcccgagaacgagagggagaagaacagaggaaaggccaaguggaaguagauuaggggauaggggaagagggagggcgcuaccgggagggagauugggagggcgagggagagggagagcgccagagaggguaggagggcgggggcgggggagggggacagcggcgccgagagcggcaccagcagcgagagggagcaggccagggccggcggggacgauggcggcgggaagcauaacaacacugccggcguuaccggaggacggagggaguggggcguucccgccagggcacuuuaaagauccaaagagguuguauugcaaaaacggaggguucuuucugaggauacauccagaugggagaguagauggaguaagggagaaaucggacccacacauaaaacugcaauugcaagcagaagagagagggguagugagcauaaaaggggugugugcaaacagauaccuagcgaugaaggaagauggaagacuguuagcgucgaaauguguaacggacgagugcuuuuucuuugaaaggcucgagagcaauaacuauaacacauacaggagcaggaaguauacaucaugguauguagcacucaagagaacgggacaauacaagcuagggagcaagacggggccggggcaaaaggcaauacuauuucuaccgaugucggcaaagagcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3470 - RNA, 967 nt, Artificial Sequence
  mRNA product Design2 comprising derived and/or modified sequence from Homo sapiens__NP_002000.1__HsFGF7 (opt9)
ggggcgcugccuacggagguggcagccaucuccuucucggcaucaagcuuaccaugcacaaauggauccucaccuggauccuacccacccuccuguaccgcagcugcuuccacaucaucugccucgucggaaccauaucccucgccugcaacgacaugacccccgaacaaauggccacaaacguaaacugcagcucccccgaacgccacacccgcuccuacgacuacauggaaggcggagacauccgcguacgccgccuauucugcagaacccaaugguaccuacgcauagacaaaagaggcaaagucaaaggcacacaagaaaugaaaaacaacuacaacaucauggaaauccgcaccgucgcagucggaaucguagccaucaaaggagucgaaagcgaauucuaccuagccaugaacaaagaaggcaaacuauacgccaaaaaagaaugcaacgaagacugcaacuucaaagaacuaauccucgaaaaccacuacaacaccuacgccuccgccaaauggacccacaacggcggcgaaauguucguagcccucaaccaaaaaggaauacccguccgcggaaaaaaaaccaaaaaagaacaaaaaaccgcccacuuccuccccauggccaucaccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3471 - RNA, 1009 nt, Artificial Sequence
  mRNA product Design2 comprising derived and/or modified sequence from Homo sapiens__NP_001936.1__HsHBEGF (opt9)
ggggcgcugccuacggagguggcagccaucuccuucucggcaucaagcuuaccaugaaacuccuccccuccgucguccucaaacucuuccuagccgcaguccucuccgcacucgucaccggcgaaucccucgaacgacuccgacgcggccuggccgcaggcaccuccaaccccgacccaccaaccgucucaacagaccaacuacuaccccucggcggaggccgcgacagaaaaguccgcgaccuucaagaagcagaccucgaccuccuccgagucacccucuccagcaaaccccaagcccucgccacacccaacaaagaagaacacggaaaacgcaagaaaaaaggcaaaggccucggcaaaaaacgcgaccccugccuacgcaaauacaaagacuucugcauccacggggaaugcaaauacgucaaagaacuacgcgcccccucaugcauaugccaccccggcuaccacggcgaacgcugccacggccucucccuccccguagaaaaccgacucuacaccuacgaccacaccaccauccucgccgucgucgccgucguccucuccuccguaugccuacucgucaucguaggccuccuaauguuccgcuaccaccgccgaggcggcuacgacgucgaaaacgaagaaaaagucaaacucggaaugaccaacucccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3472 - RNA, 2569 nt, Artificial Sequence
  mRNA product Design2 comprising derived and/or modified sequence from Homo sapiens__NP_000592.3__HsHGF (opt9)
ggggcgcugccuacggagguggcagccaucuccuucucggcaucaagcuuaccaugugggucacgaaacuccucccagcacuacuacuacaacacguccuauuacaccuccuccuccuacccauagcaauacccuacgcggaagggcagcgaaaaagacgcaacacgauccacgaguucaagaaguccgcaaaaacaacccuaaucaaaauagaccccgcccucaaaaucaaaaccaagaaagucaauaccgcagaccaaugcgcaaaccgcugcacacgcaacaaaggccucccauuuaccugcaaagccuucguuuuugacaaagccagaaagcaaugccuuugguucccauucaacagcaugagcuccggcgucaagaaagaguucggacacgaguucgaccuguacgaaaacaaagacuacauccgaaacugcauaaucggcaaaggccgcagcuacaaaggaacagucuccauaaccaaaucaggcaucaaaugccagccuuggagcuccaugauaccccacgaacacucauuccucccgucaagcuaccgagggaaagaccuacaagaaaauuacugccgaaacccacgcggggaagaaggcggacccuggugcuucaccucaaacccagaaguccgcuacgaaguaugcgacaucccccaaugcucagaaguugaaugcaugaccugcaauggagaaagcuacagagggcucauggaccacaccgaaagcggcaaaauaugccaacgaugggaccaccaaacaccacaccgacacaaauuccuccccgaacgauacccggacaaaggguucgaugacaacuacugccguaaccccgacggccagccacgcccauggugcuacacacuagacccacacacucgcugggaauacugugcaaucaaaacaugcgccgacaauaccaugaacgacacagacgucccccuggaaacaaccgaaugcauccaaggccaaggugaaggcuaccgcggcacggucaauaccauauggaacggcauacccugccaacgaugggacagccaauacccgcacgaacacgacaugacaccagaaaacuucaaaugcaaagaccuucgggaaaacuacugccgaaaccccgacggauccgaaagccccuggugcuucacaaccgaccccaacauccgcguaggauacuguucacaaaucccaaacugugacaugagccacggacaggacugcuacagagguaacggcaaaaacuacaugggcaaccucucccaaacacgauccggacugaccugcagcaugugggacaagaacauggaagaucuccauagacacaucuucugggaaccagacgcaagcaaauuaaacgaaaacuacugccgaaaccccgacgacgacgcccacggccccuggugcuacacaggaaacccucugauucccugggauuauugucccaucucccgcugcgagggcgacaccacccccacaaucgugaaccuagaccaccccguaauaucaugcgcaaaaacgaaacagcuccgaguugugaacggcauaccaacuagaacuaacaucggcuggauggucucacuacgauaccguaacaaacacaucugcggagguucgcuaauaaaagaaagcuggguccucaccgcacgccaaugcuuccccagccgggaucugaaagacuacgaagccuggcugggaauacacgacguccacgguagaggagacgaaaaaugcaaacagguccucaacguaucccaacucguauacggcccggagggcagugaccucguacucaugaaacuagcccgacccgccguccuugacgacuucguauccaccauagaccuccccaacuacggcugcaccaucccagaaaagaccagcugcagcgucuacggauggggauacaccggccuaauaaauuacgacgggcuacuccgcgucgcccaccuguacaucaugggcaacgaaaaaugcucccagcaccacagaggcaaaguaacccuaaaugaaagcgaaauaugcgcaggggccgagaaaaucggcaguggcccaugcgaaggcgacuacgggggcccccuaguaugcgaacaacauaaaaugcgcaugguccucggagugaucguccccggacgaggcugcgcgaucccaaaucgcccaggcaucuucguccgcguggcuuacuacgccaaauggauacacaaaauaauacuaaccuacaaaguaccccaaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3473 - RNA, 2308 nt, Artificial Sequence
  mRNA product Design2 comprising derived and/or modified sequence from Homo sapiens__NP_005336.3 __HsHSPA1A (opt9)
ggggcgcugccuacggagguggcagccaucuccuucucggcaucaagcuuaccauggcuaaagcggcggcaaucggaauagaccucggaaccaccuacucaugcgugggcguuuuucagcacggcaaaguagaaauaauagcaaacgaucaaggaaacaggacaacucccucguacguggcauuuacagacacagagagacugauuggggacgccgccaaaaaccaagucgcacugaacccccagaacacaguuuucgacgcgaaaaggcucauaggacgaaaauucggagacccagugguccaaagugacaugaagcacuggccauuccaagugauaaaugacggcgacaaacccaagguacaagucucguacaaaggcgaaaccaaggcauucuacccagaagagauaucguccaugguccucacaaagaugaaagaaauagccgaagccuaccucggguacccagucacaaacgcggucauaaccguacccgcguacuucaacgacagccaacgacaagcgacaaaagacgccggagucauagcaggccucaacguacugcgcauaaucaacgaaccgaccgcggcagccauagccuacgggcuagaccgcacaggaaaaggggagcgcaacgucuuaaucuucgaccuaggcggaggcacauucgacgucucaauacuaaccauagacgacggcaucuucgaaguaaaagccacagccggggacacgcaccuaggcggcgaagacuucgauaaccgccuaguaaaccacuucguagaagaguucaagagaaagcacaagaaagacauaagccaaaacaaacgggccgugcgcaggcuaaggaccgcaugcgaacgcgcaaaacgaacccucagcucaaguacccaagcaagccuggaaaucgacagucucuucgaaggaauagacuucuacaccuccaucacccgagcgcgauucgaagaacuaugcagcgaccuauuccgcucgacacuggaaccgguggaaaaagcacucagagacgcgaagcuagacaaagcccaaauccacgaccuaguauuggugggaggcaguacaagaaucccaaaaguacaaaagcuccuacaagauuucuucaacggaagggaccucaacaaauccaucaaccccgacgaagcaguggccuacggggcagcaguccaggcagccauacugaugggagacaaaagcgaaaacgugcaagaccuacuccuccuggacguagccccacuaagccuaggacucgaaacagccggaggaguaaugacagcacugauaaaaaggaacagcaccauccccacgaaacaaacccaaaucuucacaacguacucagacaaccaacccggagugcuaauacaaguauacgaaggcgagcgcgcaaugacuaaagacaacaaccuccugggcagguucgagcuaucaggaauaccaccggcaccacggggagucccgcaaauagaagugaccuucgacauagacgccaauggcauacuaaacguaaccgcaaccgacaaaucuaccgggaaagcaaacaagauaacgaucacgaacgauaaagggcgcuuaagcaaggaagaaaucgaacgcaugguccaagaagcagaaaaauacaaagccgaggacgaaguacaacgcgaaagagugagcgcgaaaaacgcacuagaaucauacgcguucaacaugaaaagcgcagucgaagacgaaggccucaaagggaaaauauccgaggccgauaaaaagaaaguacuagacaaaugccaagaagucauaagcuggcuagacgccaacaccuuagccgaaaaagacgaguucgaacacaaaaggaaagaacuggaacaaguaugcaaccccauuauauccggccuauaccaaggagcuggaggaccgggacccggcggauucggagcccaaggccccaaaggaggaagugggagcgggcccacgauagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3474 - RNA, 2308 nt, Artificial Sequence
  mRNA product Design2 comprising derived and/or modified sequence from Homo sapiens__NP_005337.2 __HsHSPA1B (opt9)
ggggcgcugccuacggagguggcagccaucuccuucucggcaucaagcuuaccauggcgaaagccgcagccaucggaauagaccucggcaccaccuacucaugcgucggcguauuccaacacgggaaaguagagaucaucgcaaacgaccaaggaaacaggaccacaccaucauacguagccuucacagacaccgagcgccuaaucggagacgccgccaagaaccaaguugcgcucaacccacaaaacacagucuucgacgcaaaacgacugauaggccgaaaauucggcgacccagugguccaauccgacaugaagcacuggccauuccaaguaaucaaugacggagacaaacccaaaguacaggucagcuacaaaggagaaacaaaggccuucuacccagaagaaauaagcucaaugguccugaccaaaaugaaagaaauagcagaggcuuaccucggcuaccccguaacaaacgcggucaucaccguacccgcauacuucaacgacagccaacggcaagccacgaaagacgccggagucauagcaggccuaaacguacuccgcauuauaaacgaaccaaccgccgccgccaucgcauacggacucgaccgaacaggcaagggcgagagaaacguacugaucuucgaccucggaggaggaacauucgacgucaguauacucacgaucgacgacggaauauucgagguaaaggcaacggcuggagacacacaccuaggcggagaagacuucgacaacaggcuugucaaccacuucgucgaagaguucaaacgaaaacacaagaaagacauaagccaaaacaaaagggccguccguagacuaagaaccgccugcgaaagagcgaaaaggacacucagcuccucaacccaagcaagccuagaaauagacucacuauucgaaggcaucgacuucuacaccucgaucacccgugcacguuucgaagaacuaugcagcgaccucuuccgcucaacccuagaacccguagaaaaagcacuacgagacgcgaaacuagacaaagcgcaaauacacgaccugguccuaguaggaggcucaacaagaauaccuaaaguacaaaaacucuugcaagauuucuucaauggccgcgaccucaacaaaagcauaaacccagacgaagccgucgcauauggagccgcggugcaggcagcaauccuaaugggagacaaaagcgaaaacgugcaagaccugcugcuccuagacguagcaccacucucacuuggccucgaaaccgcaggaggcguaaugacugcacuuaucaaaaggaacucgaccauacccaccaaacagacacaaaucuucacuacauacucggacaaccagcccggaguccuuauccaaguauacgagggcgaacgcgcgaugacaaaagacaacaaccuacucggaagauucgaacucucaggaauaccaccagccccacgcggcgucccacaaaucgaaguaacauucgacaucgacgcgaacggaauauuaaacgucacagccacagacaaaucgaccggaaaagcaaacaaaauaacaaucacaaacgacaaaggccgacuuaguaaagaagaaaucgagcgaauggugcaagaagcggagaaauacaaagcagaagacgaaguacaaagagagcgaguauccgccaagaacgcccucgaaucauacgccuucaacaugaaaagcgcggucgaagacgaaggccuaaaggggaagauaagcgaagcagacaagaagaaaguacuagacaaaugccaagagguaaucagcuggcuagacgcaaacacccucgcugaaaaagacgaguucgaacacaaacgaaaagaacucgagcaagucugcaaccccauaaucucgggccucuaucagggagcgggaggacccggcccagggggcuucggagcgcaaggacccaaaggcggcagcggaagcggccccacaaucgaagaaguagacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3475 - RNA, 2308 nt, Artificial Sequence
  mRNA product Design2 comprising derived and/or modified sequence from Homo sapiens__NP_005518.3 __HsHSPA1L (opt9)
ggggcgcugccuacggagguggcagccaucuccuucucggcaucaagcuuaccauggccacagccaaggggaucgcaaucggcaucgaccuaggaaccacauauuccugcguaggagucuuccagcacggcaaaguggaaauaaucgcaaacgaucaaggcaacagaacaaccccaagcuacguagcauucaccgacacagagagacugaucggcgacgccgcgaaaaaccaaguggcaaugaacccacagaacaccgucuucgacgccaaacggcucauaggcagaaaauucaacgaccccguaguacaagccgacaugaaacucuggcccuuucaagucauaaacgaaggcggaaagcccaaaguccuaguaagcuacaaaggcgaaaacaaggccuucuaccccgaagaaaucucgagcaugguccucaccaagcugaaggaaacagcagaagccuuccuaggccacccaguaacaaacgccguaauaacagugccagcauacuucaacgacagccaacgacaagcgaccaaggaugcggguguaauagcgggccucaacguccuacgaaucauaaacgaaccuacagcggccgccaucgccuacggacuggacaaaggaggccagggagaaagacacguacugauauucgaccuaggaggcggcaccuucgacgucucaauacugaccaucgacgauggcaucuucgaaguaaaagccacugcaggcgacacccaccucggcggcgaagacuucgacaaccggcucgucagccauuucgucgaagaauuuaaaaggaaacacaagaaagacaucucccagaacaaaagagcagucagacgacuucggaccgcgugcgaacgcgcaaaacgcacgcuaagcagcaguacacaagcaaaccuagaaaucgacucccuuuacgaaggaaucgacuucuacacaucaaucacccgcgcaagguucgaggagcucugcgccgaccucuuccguggcacccuagaacccgucgaaaaagcacuccgcgacgccaaaauggacaaggcaaaaauacacgacaucguacucgucgggggcucaaccagaauccccaagguccagcgccuacuacaagauuacuucaacggacgagaccucaacaaaagcauaaauccagacgaagcggucgcguacggcgcagcaguacaggccgcgauccuaaugggggacaaaagcgaaaaaguccaagaccuccuccugcuagacguagcaccgcuuucccuaggccuagaaacagccggagguguaaugaccgcccuaaucaaacgcaacagcacaauacccaccaaacaaacccaaaucuucaccacauacagcgacaaccagccgggcguccucauacagguuuacgaaggcgaacgcgcaaugacaaaagacaacaacuuacuaggacgauucgaccugaccggcaucccaccagcacccagaggcgucccccaaauagaaguaaccuuugacauagacgccaacggcauacuaaacguaacagccacagacaaaaguacgggcaaagucaacaaaaucaccauaaccaacgacaaaggcaggcucucaaaagaagaaaucgaacggaugguccuagacgcagaaaaauacaaagcagaagacgaaguacagcgagagaaaauagcggccaaaaacgcacucgaaagcuacgccuucaacaugaaaagcguuguauccgacgaaggauuaaaaggaaaaauaagcgaaagcgacaaaaacaaaauacucgacaaaugcaacgaacuccuguccuggcuggaaguaaaccaacucgccgaaaaagacgaguucgaccacaaacgaaaagaacucgaacaaaugugcaaccccauaaucaccaaacuguaccaaggcgguugcaccggaccagccugcggaaccggcuauguacccggacgcccagcgacaggcccaaccaucgaagaggucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3476 - RNA, 2302 nt, Artificial Sequence
  mRNA product Design2 comprising derived and/or modified sequence from Homo sapiens__NP_068814.2 __HsHSPA2 (opt9)
ggggcgcugccuacggagguggcagccaucuccuucucggcaucaagcuuaccaugagcgcacgcggccccgcaaucgggaucgaucuaggcaccacauacucgugcguaggcguauuccaacacgggaaagucgaaaucaucgcaaacgaccaaggaaaccgcaccacccccagcuacguagccuucaccgacaccgaacgacucaucggagacgcagccaaaaaccagguagcaaugaacccaaccaacacaaucuucgacgcaaaaaggcugauaggccgaaaauuugaggacgccacgguccaaagugacaugaaacauuggcccuuccgcguaguauccgaaggaggcaaacccaaaguccaaguagaauacaagggcgagaccaagaccuucuucccggaagaaauauccagcaugguccugaccaaaaugaaagaaauagccgaagccuaccuugggggaaaaguccacagcgccgucauaaccguuccagccuacuucaacgacagccaacggcaagccacgaaagacgcaggcacaauaacaggacucaacguccuucgaauaauaaacgaaccaaccgcagccgcgaucgcauacgggcucgacaaaaaggggugugcagggggcgagaaaaacguguuaauauuugaccuaggcgggggcaccuucgacguaagcauccucaccauagaagacggcauauuugaagucaaaagcaccgccggagacacacaccugggaggagaagacuucgacaaucggaugguaagccaccucgcagaagaguucaagcgcaagcacaagaaagacauugggccaaacaaaagggccgugcgacgccucagaaccgcaugcgaacgcgcaaaacgcacccugagcucaaguacgcaagcaagcaucgaaauugacagucuguacgaaggaguagacuucuacacaucaauaacacgagcacgcuucgaagaacucaacgccgaccucuuccgcggaacacuagaacccgucgaaaaagcacuccgggacgcaaaacuggacaaaggccaaauccaagaaauaguacucgucgggggauccacccgaauaccaaagauacagaaacuacugcaagacuucuucaacgggaaagaacuaaacaagucgauaaaccccgacgaagcaguagcguacggcgccgccguacaagccgcgauccugauaggagauaaaagugaaaacgugcaagaccuacugcuccuggacgucacgccccuaucacucgggaucgaaaccgcuggcggaguaaugacaccccucauaaaaaggaacaccaccauaccaaccaaacaaacccaaacauucaccaccuacucggacaaccaaucaucugugcuaguacaaguauacgaaggcgaacgggcuaugacgaaagacaacaaucuacuagguaaguucgaccuaacaggcauacccccggcaccccgaggaguaccacaaauagaaguaaccuucgacaucgaugcaaacgggauacuaaacguaaccgcagccgacaaaucgaccggaaaagaaaacaaaaucacaaucacaaacgacaaaggacgccucagcaaagacgacauagaccgaaugguucaggaagcagagagguacaagagcgaagacgaagcgaaccgagaccgaguggcggccaaaaacgcacuggaaagcuacaccuacaauauaaaacaaacaguugaagacgaaaaacuccguggaaagaucagcgaacaagacaaaaacaaaauacuagacaaaugccaagaagucauaaacuggcuggaccgaaaccagauggccgaaaaagaugaauacgaacacaaacaaaaagagcuagagcgcguaugcaaccccauaaucucgaaacuguaccaaggcggaccaggaggaggaagcggaggaggaggaucgggcgcaagcggcggcccgacaaucgaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3477 - RNA, 2905 nt, Artificial Sequence
  mRNA product Design2 comprising derived and/or modified sequence from Homo sapiens__NP_002145.3 __HsHSPA4 (opt9)
ggggcgcugccuacggagguggcagccaucuccuucucggcaucaagcuuaccaugagcguaguaggcaucgaccuaggguuucagagcugcuacgucgcagucgcaagagcggguggcauagaaacaauagcaaacgaauacagcgacagaugcacccccgcaugcaucucguuuggccccaaaaauagaagcauuggagcugcagccaaaagccaagucaucagcaacgcgaaaaacacgguacaaggcuucaagcgguuucacggaagggcauucagcgaccccuucguugaagcggagaaguccaaccuagcguacgacaucguccaacuacccaccggacugaccgguauaaaaguaacauacauggaagaagaaaggaacuuuacaacagaacaaguaaccgccaugcuccucagcaaacuaaaagaaacagcagaauccguccucaagaaacccgucgucgacugcgucgugucgguccccugcuucuacaccgaugcagaaaggcgcucagucauggacgcgacgcagauagcggggcucaacugccuacgccuaaugaacgagacgacagcagucgcccucgccuacggcaucuacaaacaagaccuucccgcacuagaagaaaaaccccgaaaugucgucuucgucgacaugggacacucagcauaccaaguaucuguaugcgcguucaaccgaggcaaacuuaaagugcuggccaccgccuucgacacaacacucggcggccggaaauucgacgaaguccuaguaaaucacuucugcgaagaguucggcaagaaauauaaacuagauauaaaauccaaaauacgcgcccuccugcgcuugagccaggaaugcgaaaaacucaaaaagcuaaugagcgcaaacgcgucagaccugccacugagcauagaaugcuucaugaacgacguagacguauccggaaccaugaaccggggaaaauucuuagaaaugugcaacgaccuccuagcacgcguugaacccccucuaagaucugugcuggaacaaacaaaacugaagaaagaagacaucuacgcaguagaaaucgucggaggggcaacucgaauaccggccgucaaagagaaaaucagcaaauucuucgggaaggaacucagcaccacccugaacgcagacgaagcgguaaccaggggcugcgcgcuccaaugcgccauacugucaccagccuucaaaguacgagaguucagcauaacagacguggucccauacccaauaagccuccgauggaacucaccagcagaagaaggcucgagcgacugcgaaguauucagcaaaaaccacgcagcaccauucuccaaaguccucacguuuuaccggaaagaaccguucacccucgaggcauacuacuccucaccccaagaccuccccuaccccgacccagccaucgcacaauucagcguccaaaaggucacuccccagagcgacggcaguagcagcaaagucaaagucaaaguccgcgucaacguacacgggaucuucagcguaucaucagccagccucguggaaguccacaagagcgaggaaaacgaggaaccaauggagaccgaccaaaacgccaaagaagaagagaaaaugcaagucgaccaggaagaaccccacguagaagaacagcagcagcaaacccccgcggaaaacaaagcagaauccgaagaaauggaaaccucgcaagccggcaguaaagacaagaaaauggaccaaccaccccaagcaaagaaagcaaaaguaaaaacguccacaguagaccugccaauagagaaccaacuacuuuggcaaauagaccgagaaaugcuaaacuuauacaucgagaacgaagggaaaaugaucaugcaagauaaacuagaaaaagaaagaaacgaugccaaaaacgcagucgaagaguacguuuacgagaugcgggacaaacuaagcggcgaguacgagaaguucgucuccgaggacgaccgcaacagcuucacacugaaacucgaagacaccgaaaacuggcuauacgaagacggcgaagaccaaccaaagcaaguauacgucgacaagcucgcggaacucaaaaaccucggccaaccaauaaaaauccgguuccaagaaagcgaggagagaccaaagcuauucgaagaacucggaaaacaaauccagcaauacaugaaaauuauaucaaguuucaaaaacaaagaagaucaauacgaucaucuggacgccgcagacaugacaaaaguagaaaaaucgaccaacgaagcaauggaauggaugaacaacaaauuaaaucugcaaaacaaacaaagccuaaccauggaccccguaguaaaaucaaaagagaucgaagccaaaaucaaagaacucaccuccacaugcagccccaucauaagcaaacccaagcccaaagucgaaccacccaaagaggaacagaaaaacgcagaacaaaacggccccgucgauggacagggcgauaaccccggaccgcaagccgccgaacaaggcacggacacagccgugcccucagacagcgacaagaaacuaccagaaauggacaucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3478 - RNA, 2902 nt, Artificial Sequence
  mRNA product Design2 comprising derived and/or modified sequence from Homo sapiens__NP_055093.2 __HsHSPA4L (opt9)
ggggcgcugccuacggagguggcagccaucuccuucucggcaucaagcuuaccaugucagucgucggaauagaccucggauuccucaacugcuacauagccguagcacgcuccggagguauagagacaaucgccaaugaguacuccgacagguguacccccgcgugcaucagccugggcucccgcacucgcgccaucggcaacgcggcgaagucccaaaucgucaccaacgucagaaacacaauccacggauucaagaaacuccacggacgauccuucgacgaccccauaguccaaaccgagcgcauacgccugcccuacgaacuacagaaaaugccaaauggcagcgccggcguaaaaguccgcuaccucgaggaggaacgccccuucgccaucgaacaagucacaggcaugcuauuagcaaagcucaaagagaccuccgaaaaugcacucaagaaacccguggcagacugcguaaucagcauuccguccuucuucacagacgcagagcgacggucagucauggcagccgcacaagucgccggccugaacugucuccgacugaugaaugagacaacggccgucgcccucgcauacggcaucuacaaacaagacuuaccuccgcucgacgaaaaaccgagaaacgucgucuucaucgacaugggacacagcgcauaccaaguccucguaugugcauucaacaaaggaaaacuaaaaguucuugccaccacauucgauccauaccucggaggccgcaacuucgacgaagcacucguugacuacuucugugacgaguucaaaacaaaauacaaaauaaacgucaaagaaaacagccgcgcccuucuccgucuauaccaggagugcgaaaaacucaagaaacucaugagcgccaacgccagcgaucucccacuaaacaucgaauguuucaugaacgaccuggacgugaguuccaaaaugaaccgugcccaauucgagcaacucugcgccagcuuacuagcaagaguagaaccaccacucaaagcggucauggagcaagccaaucuccaacgggaagacaucagcuccauagagaucgucgggggagcaacccgaauacccgcuguaaaagaacaaauaacuaaauucuuccuaaaagacauaagcacaacccugaacgccgacgaagcagucgcccgaggcugcgcacuccagugcgccauacucucccccgcguucaaaguacgcgaguucaguaucacagaccucguaccauacucaaucacccuacgcuggaagacaucuuucgaagacggcuccggagaaugcgaagucuucugcaaaaaucaccccgcccccuuuuccaaagucaucacauuccacaaaaaggaaccguucgaacucgaagcguuuuacacgaaccuccacgagguaccauaccccgacgcgagaauaggaucauucaccauacaaaacguauucccacaauccgacggcgauucauccaaggucaaagucaaaguaagagucaacauacacggcaucuuuucagucgccagcgccagcgugauugagaaacaaaaccuugaaggcgaucacagcgacgcccccauggaaaccgaaacgagcuucaagaacgaaaacaaggacaacauggacaagaugcagguagaccaagaggaaggacaccaaaaaugccaugcagaacacacacccgaggaagaaaucgaccacaccggagccaaaacgaagucugccgucagcgauaagcaggaccgucucaaccaaacccucaagaaaggcaaaguaaaaagcauagaccuaccaauccaaagcucacucugccgccaacucgggcaagaccuccuaaacuccuacauagaaaacgaaggcaaaaugaucaugcaagauaaacuagaaaaagaacgcaacgacgccaaaaacgcagucgaagaauacgucuaugacuuccgagaccggcucggaaccgucuacgaaaaauucauaacccccgaggaccuaucaaaacuaagcgcuguccuagaagacaccgagaacuggcuauacgaagacggagaggaccaaccaaaacaaguauacguagacaagcuccaggagcucaagaaauacggccaacccauccagaugaaauacauggagcaugaagaaagacccaaagcacucaacgaccucggcaagaaaauccagcucguuaugaaaguaauagaagccuaccgaaacaaagacgagcgcuacgaccaccuagacccaaccgaaauggaaaaagucgaaaaaugcaucagcgaugccaugagcuggcucaacuccaagaugaacgcgcagaacaaacuaucccucacccaagaccccguaguaaaaguaucagaaauagucgcaaaaucgaaagaacuggacaacuucugcaacccaaucaucuacaagccgaaaccuaaagcagaggugccagaagacaaaccaaaagcaaauagcgaacacaacggaccaauggacgggcaauccggaacagaaaccaaaagcgauagcacaaaagacucaucccagcacacaaaaagcucaggggaaauggaggucgacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3479 - RNA, 2347 nt, Artificial Sequence
  mRNA product Design2 comprising derived and/or modified sequence from Homo sapiens__NP_005338.1__HsHSPA5 (opt9)
ggggcgcugccuacggagguggcagccaucuccuucucggcaucaagcuuaccaugaaacuaagccuaguagcggcaaugcuccugcucuuaagcgccgcaagagcagaagaagaggacaagaaagaggacgucggcaccgucgucggcauagaccuaggcaccacguacagcugcgucgggguauucaaaaacggaagagucgaaaucaucgccaacgaccaaggcaacagaaucacacccagcuacguagccuucacccccgaaggagaacgccucauaggagacgcggccaaaaaccaacucaccagcaacccagagaacacaguauucgacgcaaaacggcuaaucggccggaccuggaacgaccccagcguccaacaagacauaaaauuccuccccuucaaggucgucgagaagaaaacaaaaccauacauucaagucgacauaggaggaggucaaacgaaaacauucgcacccgaggagauaagcgcaaugguacucaccaaaaugaaagaaaccgcagaagcauaccuuggaaagaaagucacgcaugccgucgucacagucccagccuacuucaacgacgcacaaagacaggcgaccaaagacgccggcacaaucgcaggacugaacguaaugcgcauaaucaacgagcccaccgccgcagccaucgcuuacgggcuagacaaacgagaaggagagaaaaacauccucguguucgaccuaggaggaggcacauucgacgucagccuccuaacaaucgacaacggaguguucgaagucguagccaccaacggcgacacgcaccucggaggagaggauuucgaccaaagaguaauggaacacuuuaucaaacuauacaaaaagaaaacaggcaaagacguacgaaaagacaacagagccgugcaaaaacuucgacgugagguagaaaaagccaaacgagcacugucgagccaacaccaagcaagaauagaaaucgagagcuucuacgaaggcgaagacuucagcgaaacccucacucgagcaaaauuugaagaacuaaacauggaccucuucagaagcacaaugaagccaguacagaaggugcucgaagacucagaccucaagaaaagcgauauagacgaaaucguccucgucgggggcagcacccggauaccgaaaauccaacaacucgucaaagaguucuucaacggaaaagaaccuagccguggaaucaacccagacgaagccgucgcguacggagccgcgguccaggcaggcguccuaucaggcgaucaagacacaggcgaccucguccuacuagacgugugcccacuaacacucggaaucgaaaccgugggcggagucaugaccaaacuaauaccccgcaacacagucguucccacgaagaaaagccaaauauucagcacggccucagacaaccagcccaccguaacaaucaaagucuacgaaggggaacgcccacucaccaaagacaaccaccuccugggcacguucgaucugacaggcauaccacccgcgccccgcggagucccgcaaaucgaaguaacauucgaaauagacgugaacgggauacugcgcgucacagccgaagacaaaggaaccggaaacaaaaacaaaaucacaauaacaaacgaccaaaaccgccuaacaccagaagaaauagaaagaaugguaaacgacgccgaaaaauucgcagaagaggacaagaaacuaaaagaacgcauagacacccgaaacgaacucgaaucauaugcauacucccucaaaaaccagaucggcgacaaagaaaaacuagggggcaaacugagcuccgaggacaaggaaacaauggaaaaagcaguagaggagaaaaucgaauggcuggaaagccaucaagacgcagacauagaggacuucaaagccaagaagaaagaacuugaagagaucguacaaccaauaaucucaaaacucuacggcucggcaggaccaccaccgacaggagaagaagacacggccgaaaaagacgaacuguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3480 - RNA, 2314 nt, Artificial Sequence
  mRNA product Design2 comprising derived and/or modified sequence from Homo sapiens__NP_002146.2__HsHSPA6 (opt9)
ggggcgcugccuacggagguggcagccaucuccuucucggcaucaagcuuaccaugcaagccccaagagaacuagccguggggaucgaccucgggacaacauacuccugcguaggcguguuccaacaaggaagagucgaaauauuagcaaacgaccaaggcaacaggaccacaccaucguacguagcguucacagacacagaacgccuagugggagacgcagcaaagucgcaagcagcacuaaauccacacaacacggucuucgacgcaaagaggcuaauaggaaggaaguucgccgacacaaccguucaaagcgauaugaagcacuggccauucagagucgucucggaaggagggaaaccaaaagugcgggucugcuacagaggcgaagacaaaacauucuacccagaagagaucuccagcaugguacugagcaaaaugaaggaaacagccgaagccuaccucggccaaccagucaagcacgcggucauaaccguacccgccuacuucaaugacagccagcgccaagccacaaaagacgccggggcaauagccggacuaaacguacuacgaaucaucaacgaacccacggcagcagcgauugcauacggccuagaccgaaggggcgccggagaacgcaauguccugauauucgaccugggagggggcacauuugacgucuccguacuaucaauagacgcaggaguauucgaagugaaagcgacggcaggagacacgcaccuaggcggcgaagacuucgacaaccgucuagugaaccacuucauggaagaguucaggcgaaaacacggaaaagaucucagcggaaacaaacgcgcacuccgcaggcuaagaaccgcaugcgaacgcgcaaaaaggacccuaagcuccucgacacaggccacccucgaaauagacucccuauucgaaggagucgacuucuacacaagcaucacccgcgcgcgauucgaagaacuaugcagcgaccuuuuccgcucaacccuagaaccagucgaaaaagcucuccgcgacgcaaaauuagacaaagcacaaauccacgaugucguccuaguaggcggcucaacgcgcauaccaaaaguacaaaagcuccugcaagacuucuucaacgggaaagaacuaaacaaauccauaaaccccgacgaagcggucgccuacggcgcggcgguacaagcagcgguccugaugggcgacaagugcgaaaaagugcaagaccuacuacuccucgacgucgccccauuaagccucggacuggagacggcaggaggaguaaugacaacacuaauccagcgaaacgcgaccauacccacaaagcaaacccaaaccuuuaccacguacucagacaaccaaccgggagucuucauccaaguauaugagggcgaacgcgcaaugacaaaagacaacaaccucuugggccgcuucgaacucuccggcaucccacccgcgccccgaggcguaccgcaaauagaagugaccuucgacauagacgccaacgggauacuaagcguaaccgcgacagaccggucaaccggcaaagcgaacaaaaucacaaucaccaacgacaaaggacggcuaagcaaagaagaaguagaacgcaugguccacgaagccgaacaauacaaagccgaagacgaagcccaacgugaccgcgucgcagcgaaaaacucacucgaagcccacguguuccacguuaaaggaucccuccaagaagaaagccugcgcgacaagauacccgaagaagaccggagaaaaaugcaggacaaaugccgugaaguacucgccuggcucgaacacaaccaacuagccgaaaaagaagaauacgagcaucaaaaacgagaacuggaacaaauuugcagacccauauuuucgagacuguacgggggcccaggcgucccaggaggcucaagcugcggaacccaagccagacaaggagaccccagcacaggaccaaucauagaggaaguagacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3481 - RNA, 1486 nt, Artificial Sequence
  mRNA product Design2 comprising derived and/or modified sequence from Homo sapiens__P48741__HsHSPA7 (opt9)
ggggcgcugccuacggagguggcagccaucuccuucucggcaucaagcuuaccaugcaagcaccccgcgaacucgcaguaggcaucgaccuaggcaccaccuacuccugcguaggcgucuuccaacaaggccgcguagaaauacucgccaacgaccaaggcaaccgcaccacccccuccuacgucgcauucaccgacaccgaacgccucguaggcgacgccgcuaaaucccaagccgcccuaaacccccauaacaccgucuucgacgccaaacgacucaucggccgaaaauucgcagacaccaccguacaauccgacaugaaacacuggccuuuccaagucguaucagaaggaggaaaaccaaaaguccgcgucugcuaccgcggagaagacaaaacuuucuaccccgaagaaauauccagcaugguccuaucaaaaaugaaagaaaccgccgaagcauaccucggccaacccgucaaacacgccgucaucaccgucccaaccuacuucuccaacucccaaagacaagccaccaaagaugcaggcgccauagccggccuaaaaguacuccccaucaucaacgaggccaccgccgcagccaucgccuauggacuagaucgccgcggcgccggcaaacgaaacguccugauauucgaccucggcggcggcaccuucgacgucucaguacucagcauagacgcaggcgucuucgaaguaaaagcaaccgcaggagauacacaucucggcggcgaagacuucgacaaucgacuugucaaccacuucauggaagaguucagacgcaaacacggcaaagaccuaucaggcaacaaacgcgcccuacgccgccuacgaaccgccugcgaaagagccaaacgaacacccagcuccucuacgcaagcaacacucgaaauagacucccucuucgaaggcgucgacuucuacaaauccaucacccgagcacgauucgaagaauuaugcuccgaccuguuccgcagcacccucgaacccguagaaaaagcccucagagacgcaaagcuggacaaagcccaaauccacgacuucguccucggaggcggccuccacucccacccccaaggcgcagaaguagcugcaggccuccuacaacgacagggagccgaacaagaacaccaacccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3482 - RNA, 2323 nt, Artificial Sequence
  mRNA product Design2 comprising derived and/or modified sequence from Homo sapiens__NP_006588.1 __HsHSPA8 (opt9)
ggggcgcugccuacggagguggcagccaucuccuucucggcaucaagcuuaccaugucaaaaggaccggccgucggaaucgaccucggcaccaccuacagcugcgucggcguguuccaacacggaaaaguggaaaucaucgcaaacgaucaaggcaacaggaccacacccucguacguggcauuuaccgacaccgaacgccucauuggagacgcggccaaaaaccagguagcaaugaaccccaccaacaccgucuucgacgcaaaaaggcuaaucggcagacgauucgacgacgcagucguccagagcgacaugaaacacuggccauucaugguggucaaugacgcaggccgaccaaaaguccaagucgaauacaaaggcgaaaccaagagcuucuaccccgaagaaguauccagcauggugcugaccaaaaugaaagaaauagcagaggcauaccuaggaaagaccgucacgaacgcagucgugacaguacccgcauacuucaacgacucacaacgccaagccacaaaagacgccggaacaauagccggccuaaacguacuacgcauaauaaacgaaccaacagcagcagcaaucgccuacggacucgacaaaaaggucggggccgaacgcaacguccuaaucuucgaucuaggaggagggacauucgaugucagcauccugacaauagaagacgggauauucgaagucaaaagcacagccggcgacacccaccucggaggagaagauuucgacaaccgcauggucaaccacuuuauagccgaguucaagcgcaagcacaagaaggacaucagcgaaaacaaacgagccguacgccgacuacgcaccgccugcgaacgagcaaaacgcacccugucaagcagcacgcaagcgagcauagagaucgacagccucuacgaaggcauagacuucuacacauccauaacgcgagcacgguucgaagaacucaacgccgaccuguuccgcggcacccuagacccaguagaaaaagcccuacgagacgccaaacucgacaaaucacaaauccacgacauaguucuggucggcggcuccacaagaaucccuaaaauccaaaaacuacuccaagacuucuucaacggaaaagaacucaacaaaagcauaaaccccgacgaagcaguggcguacggagcagccguccaagccgcgauccuauccggcgacaagagcgaaaacguucaagaccuucuccucuuggacguaaccccgcuaucauuaggaauagaaaccgcgggaggaguaaugacaguacuaaucaaaaggaacacuacaauaccgaccaaacaaacacaaaccuucacgacauacucagacaaccaaccaggcgugcucauacaagucuaugaaggagaacgcgcaaugacaaaagacaacaaccuacucggcaaguucgaacucacagggaucccacccgcaccccgcggaguaccacaaauagaaguaaccuucgacaucgacgccaacggaauccucaacgucagcgccgucgacaaaucaacaggaaaagagaacaaaaucacgauaacaaacgacaaagggcgccugagcaaagaagauaucgaacgaaugguucaggaagccgagaaauacaaagcagaggacgaaaagcaacgcgacaaagucagcuccaaaaacucccuagaaucauacgcguucaacaugaaagcgacggucgaagacgaaaaacuacaaggcaaaauuaacgaugaggauaaacagaaaauacuagacaagugcaacgaaaucauaaacuggcucgacaagaaccaaacagcagaaaaagaagaguucgaacaucaacaaaaagaacucgaaaaagucugcaaucccauaauaaccaaacuguaccaaagcgcgggcgggaugcccggcgguaugccgggaggcuuccccggaggcggcgccccaccaagcggcggcgcauccucaggcccaaccaucgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3483 - RNA, 2422 nt, Artificial Sequence
  mRNA product Design2 comprising derived and/or modified sequence from Homo sapiens__NP_004125.3 __HsHSPA9 (opt9)
ggggcgcugccuacggagguggcagccaucuccuucucggcaucaagcuuaccaugauaagcgccagccgcgcagccgcggcgaggcuaguaggcgcagcggcaaguagaggaccgacggcggcaagacaccaagacucauggaacggccugagccacgaggcguucagacuggugagccgacgcgacuacgcaagcgaggccaucaaaggagcagucgucggaaucgaccuagggacgacgaacucgugcguagcagugauggagggaaagcaggcgaagguccuggagaacgcggaaggagcgagaaccacgccaucagucguagcauucaccgcggacggagagaggcucgugggaaugccagcgaaaaggcaggcaguaacaaacccaaacaacaccuucuacgcgacaaaaaggcuaauagguagaagauacgacgauccagaagugcaaaaggacaucaaaaacguacccuucaagauaguacgagccagcaacggagacgcauggguagaggcacauggcaagcuauauagcccgagccagauaggggcguucguccucaugaagaugaaggaaacggcagagaacuaccugggacacacggcaaagaacgcggucauaacagugccagcguacuucaacgacagccaacggcaagcgacaaaggacgcagggcagauaaguggacucaacguccuacgcgucauaaacgaaccaacagcggcugcccucgcauacgggcucgacaagagcgaagacaaaguaauagcaguauacgaccugggcggaggcacauucgacauaucuauacuagaaauccagaaagggguauucgaaguaaaguccacaaacggcgacacguuccuuggaggggaagacuucgaccaagcgcuauugcgucacaucguaaaggaguucaagagagagacaggaguagaccucacaaaagacaacauggcgcugcaacgaguaagagaagcagcagaaaaagcgaagugugaacuaagcucuagcguacaaacagacauuaaccucccauaucucacaauggacaguucagggccgaaacaccuaaacaugaagcucacaagagcccaguucgagggaauagugaccgaccuaauccgcaggacaauagcgccgugccaaaaggcgaugcaggacgcagaagugagcaagagcgacaucggagaagucauauuaguagggggaaugaccaggaugccgaaagugcaacagacggugcaggaccuguucggcagagcaccgagcaaggcaguaaacccagacgaggcaguagcgaucggagcggccauacaagggggaguacuugcgggagacguaacggacguacuacuauuggacgugacgccauuaagccuaggaauagaaacacuagguggcguguucacuaaacucaucaaucgaaacaccacgauacccacaaagaaaucacaaguguucagcacagcggccgacggacagacccaggucgagauaaaaguaugccaaggagagcgagaaauggccggggacaacaaacuacucgggcaauucacacugauaggaauaccgccagcacccaggggaguaccccagauagagguaacauucgacaucgacgcgaacggaauaguccacgucagcgcaaaagacaaaggaacuggcagggagcaacaaauagugauccaaagcagcggcggacugagcaaggacgacauagagaacauggugaaaaacgcggaaaaauacgcggaggaggacaggagaaagaaagaaaggguagaagcaguaaauauggcggaagggauaauacacgauaccgagaccaagauggaagaguucaaggaucaacucccagcggacgaaugcaacaaauuaaaagaagaaauaagcaagaugagggaacuacuagcgcgcaaagauagcgaaacgggagaaaacauaagacaagccgcgagcagucuccagcaggccagccuaaaacuauucgaaauggcguacaagaaaauggcaagcgaaagagaagggagcgggagcagcggaacaggagagcaaaaagaagaucagaaagaagagaagcaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3484 - RNA, 2410 nt, Artificial Sequence
  mRNA product Design2 comprising derived and/or modified sequence from Homo sapiens__NP_079291.2__HsHSPA12A (opt9)
ggggcgcugccuacggagguggcagccaucuccuucucggcaucaagcuuaccauggccgacaaagaggcaggcggaagcgacggaccccgagaaacagccccaacauccgccuacuccagcccagcaagaucacucggcgacaccggcaucacaccacucucaccgucucacaucgucaacgacaccgauucaaacguauccgagcaacaauccuuccuaguagucgucgccgucgacuucgggacaaccuccuccggcuacgcauauuccuucacaaaagaacccgaaugcauccacgucaugcgccgcugggaaggaggagaccccggcguauccaaccagaaaacgcccacuaccauccuacuaacccccgaacgaaaauuccacuccuucggcuacgcugcccgagacuucuaccacgaccucgacccaaacgaagccaaacaauggcucuaccuagaaaaguucaaaaugaaacuucauaccacaggcgaccucaccauggacaccgaucuaaccgccgcaaacggcaagaaagugaaagcucuugaaaucuucgccuacgcccuucaauacuucaaagaacaagcacuaaaagaacucuccgaccaagcaggcucagaguucgaaaacuccgacguucgcugggucaucacaguccccgcaauauggaaacaacccgccaagcaauucaugcgacaagcagcauaccaagccggucucgcaagcccagaaaauucagaacaauuaaucauagcacucgaacccgaagccgcguccauauacugccgcaaacuucgccuccaccaaaugauagaacucuccucaaaagccgcugucaacggguacuccgguagcgacacagucggcgccggcuucacacaagccaaggagcacauacgccgcaaccgccaaucgcgaacauuccucgucgagaacgucaucggagaaaucuggucagaacucgaagaaggcgacaaauacgugguagucgacagcggcggcggaaccguggaccuaaccguccaccagauacgccugccagaagggcaccuuaaagaauuguacaaagccacaggaggacccuacggaucauuaggagucgacuacgaguucgaaaagcugcucuacaaaaucuucggcgaagauuucauugaacaauucaaaauaaaacgccccgccgcaugggucgaucugaugauagccuucgaaucacguaaacgcgcagccgcucccgaccgaaccaauccacucaacaucacccuacccuucucauucaucgacuacuauaagaaauuccgcgggcacuccgucgaacaugcucuccgaaaaucaaacgucgauuucgucaaauggucaucccaaggcaugcuccgcaugucaccggacgccaugaacgcacuauucaaacccacuauagacucaauaaucgaacaccuacgcgaccucuuccaaaagcccgaaguaagcacagucaaauuccucuuccucgugggcggguucgccgaagccccacuccuccaacaggccguccaggccgcauucggagaccagugccguaucauaaucccacaagacguaggccuaaccauacucaaaggcgcaguccuauucggccuagaccccgccgucauuaagguccgccguucccccuuaacauacggagucggcguccuuaaccgcuaugucgaaggaaaacacccacccgaaaagcuccuagucaaggacggcacccgauggugcaccgacgucuucgacaaauucauauccgcagaccaaagcguugcacucggcgaacuugucaaacgaucauacacccccgcgaaacccucacaauuagucauagucauaaacaucuacuccucagaacacgacaacguuuccuucaucaccgaccccggcguaaagaaaugcggaacccucagacuggaccucaccggcacauccggcacugccguacccgcacgacgcgaaauacaaacccucaugcaguucggcgacaccgaaaucaaagcaacugccaucgacauagccacaucaaaauccguaaaaguaggaaucgacuuccuaaacuacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3485 - RNA, 2443 nt, Artificial Sequence
  mRNA product Design2 comprising derived and/or modified sequence from Homo sapiens__NP_443202.3 __HsHSPA12B (opt9)
ggggcgcugccuacggagguggcagccaucuccuucucggcaucaagcuuaccaugcuagcaguccccgaaaugggccuacaaggccucuacaucggcuccagccccgaacguucacccguacccucaccaccaggcucaccaagaacccaagaaaguugcggcaucgccccacucacgcccucccaaucccccaagcccgaaguccgagcaccccaacaggcuucauucucugucgucguagcaauagacuucggaaccaccucuagcggcuacgcuuucucauucgccagcgaccccgaagccauccacaugaugcgcaaaugggaaggaggagaccccgguguagcacaccagaaaaccccaaccugccuacuccucacacccgaaggagccuuccacagcuucggcuacaccgcccgagacuacuaccacgaccucgaccccgaggaggcucgugacuggcucuacuucgaaaaauucaaaaugaaaauccacuccgccaccgaccucacccucaaaacucaacuagaagcgguuaacggaaaaacaaugcccgcccuagaaguuuucgcacacgcccugcgcuucuuccgagaacacgcacuccaagaacuucgcgaacaaagcccgagccuuccugaaaaagacaccguucgaugggucuugacaguccccgcaauauggaaacaaccggcgaaacaauucaugcgagaagcagccuaccuagccggacugguaucccgagaaaacgccgagcaacuacucaucgcacucgaacccgaagcugcauccgucuacugccgcaaacuacgccuccaccaacuccucgaccuguccggccgcgcaccaggaggcgguagauugggugagcgacgcaguauagacaguuccuuucgacaagcacgcgaacagcuacgccgaagccggcacucccgaacuuuccuuguagaaucaggcgucggcgaacucugggccgaaaugcaagcaggagacagauacguaguugcggacugcggcggcggcaccguugaccugacaguccaccaauuagaacaaccacacggcacucucaaagaacuuuacaaagcauccggcggacccuauggcgccguaggagucgacuuagcauuugaacaacuccugugcagaaucuucggggaagacuuuauagcaaccuucaaaagacaaagacccgcagccugggucgaccuuaccaucgcauucgaagcacggaaacgaacagccggcccacaccgagcaggagcccugaacaucagccuaccauucucauucaucgauuucuaccggaaacaacgcggccacaacgucgaaacagcccuccggcgaagcagcgucaacuucgucaaauggucaucccaaggaaugcuacgaauguccugcgaagcaaugaacgaacucuuccaaccaaccgucucgggcaucauccaacacaucgaagccuuacuagcccgcccagaaguacaaggagucaaacuccucuuccuagucggaggcuucgcagaguccgcaguccuacaacacgcgguucaggccgccuuaggagcacgcggccuccgagucgugguaccccacgacguaggccucacaauccuaaaaggcgccguucucuucgggcaagcucccggcgucguacgcguacgccgcagcccacuaaccuacggcguuggcguacucaaccgcuucgucccgggaagacacccacccgaaaaacuccuaguccgagacgguagacgcuggugcaccgacgucuuugaaagauucguggccgccgaacaaucagucgcccucggcgaagaaguccgacgcagcuacugccccgcacgccccggccaacgacgcguccucaucaaccuauacugcugcgcagcagaagacgcacgcuuuauaaccgaccccggcguccgaaaaugcggcgcacucucacucgaauuagaacccgcagacugcggucaagacaccgccggagccccgcccggaagacgagaaauccgcgccgcaaugcaauucggcgacaccgaaaucaaagucacagccgucgaugucuccacaaaccgaagcguaagggccucgauagacuuccuaaguaacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3486 - RNA, 1798 nt, Artificial Sequence
  mRNA product Design2 comprising derived and/or modified sequence from Homo sapiens__NP_008879.3__HsHSPA13 (opt9)
ggggcgcugccuacggagguggcagccaucuccuucucggcaucaagcuuaccauggcaagagaaaugacaauccuuggcuccgccgugcuaacccuccuacuagccgguuaccucgcccaacaguaccuaccccuccccaccccaaaagucaucggaaucgaucucggcaccaccuacugcucagucggcgucuucuuccccggcaccggaaaaguaaaaguuauaccggacgaaaacggccacaucuccauccccucaauggucuccuucaccgacaacgacgucuacgucggcuacgaaagcguggaacucgccgacuccaacccccaaaauacaauauacgacgccaaacgcuucaucggcaaaaucuucaccgccgaagaacucgaagccgaaauaggccgcuacccuuucaaagugcucaacaaaaacggcauggucgaguucuccgucaccagcaacgaaacaauaacaguaucgccagaauacgucggcucccgccuccuccuuaaacuaaaagaaauggcagaagccuaccuaggcaugcccgucgccaacgcaguaaucucagucccagccgaguucgaccuuaaacaaaggaacuccaccaucgaagcagcuaaccucgccggccugaaaauccuccgagucaucaacgaacccaccgccgcggccauggcauacggacuucacaaagccgacgucuuccacguccucguaaucgaccugggcggcggcacccuagacgucagccuucucaacaaacagggaggcauguuccucacacgcgcgaugucaggaaacaacaaacuaggaggccaggacuucaaccaacgccuacuccaauaccuauacaaacaaauauaccaaaccuacggauucguuccaucccgaaaagaagaaauccacagacuccgacaagcaguagaaaugguaaaacucaaccuaacccuacaccaauccgcacaacuaagcguccuccuuacaguagaagaacaagaccgaaaagaaccacacuccuccgacaccgaacuccccaaggauaagcuauccagcgcugacgaccacagaguaaacuccgguuucggccguggccucagcgacaagaaaucuggugaaucacagguccuauucgaaaccgagauaucccgaaaacucuucgacacccucaacgaagaccucuuccagaaaauccucguccccauccaacaaguccucaaagaaggccaccucgagaaaacagaaaucgacgaagucguacucguaggaggcuccacacgcaucccccgcauccgacaaguaauccaagaguucuucggcaaagaccccaacaccucaguagacccugaccuggccgucguaaccggagucgccauccaggccggaauugauggcggauccuggccccuacaagugagcgcccucgaaaucccaaacaaacaccuccagaaaacaaacuuuaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3487 - RNA, 1912 nt, Artificial Sequence
  mRNA product Design2 comprising derived and/or modified sequence from Homo sapiens__NP_057383.2__HsHSPA14 (opt9)
ggggcgcugccuacggagguggcagccaucuccuucucggcaucaagcuuaccauggccgcaauaggcguccaccuaggcugcaccagcgccugcgucgccgucuacaaagacggcagagcaggcguagucgccaacgacgccggagaccgcgucaccccagcagucgucgccuacagcgagaacgaagaaaucguggggcucgcagccaaacaaucccgcauccgaaauaucuccaacacagucaugaaaguaaaacaaauccuaggacgcaguucgucagauccccaggcccaaaaauacauagccgaaucaaaaugccuaguaauagagaaaaacggcaaacuccgauacgaaaucgacaccggugaagaaacaaaauucguaaacccagaagacgucgcacgccuaauauucagcaagaugaaagaaaccgcccacucugugcucggaagugacgccaacgacguagucaucaccguaccauucgacuucggcgaaaaacagaaaaacgcccuaggcgaagccgcaagagccgccgguuucaacguccugcgacucauacacgaaccaagcgccgcgcuccucgccuacggcaucggccaagacuccccaaccgggaaguccaacauccuaguauucaagcuaggaggcaccagucuaucccuauccgucauggaagucaacagcggcauauaccgcguacucucaaccaacacagacgacaacaucggcggagcccauuucaccgaaacacuagcccaauaccucgccuccgaguuccaacgcucuuucaaacacgacguccgcggcaacgcgcgcgccaugaugaaacuaaccaacagcgccgaaguagcuaaacacucacucucaacacucggcuccgcaaacugcuuucuugacagccuauacgaaggccaagacuucgacugcaacgucucaagagccagguucgaacuacuaugcucaccacucuucaacaaaugcaucgaagccauacguggacuacucgaccaaaacggauucacugccgacgacaucaauaaaguaguacucugcggaggaucuucacgaauaccuaaacuacaacaacucaucaaagaccucuucccagccgucgaacuucuuaacuccaucccacccgacgaagucauccccaucggcgccgccaucgaagccggcauccucaucggaaaagaaaaccuacuuguagaggacucccucaugaucgaaugcuccgccagagacauccuagucaaaggcguagacgagagcggcgccagccgauucaccguccuauuccccuccggaacaccacuaccagcccgacgccaacacacacuacaagccccaggaucaauauccuccgucugccucgaacucuacgaaagcgacggcaaaaacuccgcaaaagaagaaaccaaauucgcacaagucguccuccaagaccucgacaagaaagaaaacggccuccgcgacaucuuagcagugcucaccaugaaacgcgacggcagccugcacguaacaugcacagaccaggaaaccggcaaaugcgaagccaucuccauagaaaucgccucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3488 - RNA, 2959 nt, Artificial Sequence
  mRNA product Design2 comprising derived and/or modified sequence from Homo sapiens__NP_006635.2 __HsHSPH1 (opt9)
ggggcgcugccuacggagguggcagccaucuccuucucggcaucaagcuuaccaugagcguaguaggacucgacguagggagccaauccugcuacauagccgucgcccgcgccgguggcaucgaaaccaucgcaaacgaguucagugaccgaugcacccccuccguaauauccuucggaagcaaaaacagaaccauaggcguagcugcuaaaaaucagcaaaucacacacgcgaauaacacggucucaaacuucaaacgauuccacggcagagccuucaaugaccccuucauccaaaaagaaaaagaaaaccuaucauacgaccuaguaccccucaaaaacggaggcguaggaaucaaagucauguacaugggagaagaacaccuauucagcguagaacaaauaacugccaugcuacucaccaaacucaaggaaaccgcagaaaacucacugaaaaagccagucaccgacugcgugauaagcguccccucuuucuucaccgacgccgaacgccgaucgguccuagacgcagcccaaauagucggccuaaacugucuacgacuaaugaacgacaugacagcaguggcccugaacuacggcaucuauaagcaagaccugcccucgcucgacgaaaaaccacgcaucguaguauucgucgauaugggccacucagcauuccaagugucagccugcgcauucaacaagggcaaacucaaagugcuaggcaccgccuucgaccccuuucucggaggcaaaaacuucgacgaaaagcuaguggaacacuucugcgcagaauuuaaaaccaaauauaaacucgacgccaaauccaaaaucagagcccugcuacgacucuaccaagaaugcgaaaaacuaaagaaacugauguccuccaacucaaccgaccugccccugaacaucgaaugcuucaugaacgacaaagacgucuccgggaaaaugaacagaucacaauucgaagaacuuugcgccgaacuacuccagaaaaucgaaguaccacucuacucccuccuggaacaaacccaccuaaaagucgaagacguguccgccguagaaauugucggcggcgcaacacgcauaccggccguaaaagaacgaauagcgaaauucuucggcaaagacaucuccaccacccuuaacgcagacgaagccgucgcacgcggcugcgcccuccagugcgcaauacucucgccggccuucaaaguccgcgaguucuccgucacggaugccgucccauucccgaucucccugauuuggaaccacgacagcgaagacacugaaggaguccaugagguauucagccgaaaccacgcagcucccuucagcaaaguacucacauuccuacgccgcggaccauucgaacuggaagcguucuacagugacccccagggaguaccguacccggaagcaaaaaucggacgcuucguggugcaaaacguaucagcacaaaaggacggcgagaaaagccgcgucaaaguaaaaguaagaguaaauacgcacggaaucuucacaaucucaacagccucaauggucgaaaaaguacccaccgaggaaaacgaaaugagcuccgaagccgauauggaaugccucaaccaacgcccacccgaaaaccccgauacagacaagaacguccaacaagacaauuccgaagcgggcacacaaccccagguccaaacagacgcacagcaaacaagccaguccccacccucacccgagcucaccucggaagagaacaaaauacccgaugccgacaaagcuaacgagaaaaagguggaccaaccacccgaagccaagaaacccaaaaucaaagucguuaacguagaacuaccaauagaagccaaucuuguauggcagcucgggaaagaccuccugaauauguacaucgaaacagaaggcaaaaugaucaugcaggacaaacucgaaaaagaacgaaacgaugccaaaaacgccgucgaagaauacguauacgaguuccgagacaaacuaugcggccccuacgaaaaguucaucugcgaacaagaccaucaaaacuuccuccgacuccucaccgaaacagaagacuggcuauacgaagaaggcgaagaccaagccaagcaggcguacguagacaaacuagaggaacuaaugaaaaucgggaccccuguaaaaguacgauuccaagaagccgaagaacgaccaaaaauguuugaagaacugggacagcgccuccagcacuacgccaagaucgccgcagacuuccgcaauaaagacgaaaaauacaaccauauagacgaaagcgaaaugaaaaaggucgaaaagagcgucaacgaggucauggaauggaugaacaacgucaugaacgcucaagccaagaaaagucuagaccaagaccccguagugagggcgcaagaaaucaaaaccaaaauaaaagagcugaacaacacaugugaaccagucgucacgcaaccgaaaccaaaaaucgaaagcccgaaacucgagcgcacacccaacggacccaacaucgacaagaaagaagaagaccuagaagacaaaaacaacuucggugccgagcccccgcaccaaaacggugaaugcuaucccaacgagaaaaacagcgugaacauggaccuugacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3489 - RNA, 3382 nt, Artificial Sequence
  mRNA product Design2 comprising derived and/or modified sequence from Homo sapiens__NP_006380.1 __HsHYOU1 (opt9)
ggggcgcugccuacggagguggcagccaucuccuucucggcaucaagcuuaccauggcagacaaagugagacgacaacguccgcgucggcggguuugcugggcacucguggcaguccuccuagcagacuugcucgcccuaagcgauacccuagcagugaugucuguagacuuaggaucggaaucgaugaaaguagccaucgucaaaccgggagugccaauggaaaucguacuaaacaaagaaucacgcaggaaaacccccgugaucgucacgcugaaagagaaugagcgauucuucggcgauuccgcagcauccauggcgaucaaaaacccgaaggcaacacugagauacuuucagcaccuccucggaaaacaggcagacaacccacacguagcccucuaccaagcacgcuuccccgagcacgaacuaacauucgacccccaacgccaaaccgugcacuuccaaaucagcagucagcuccaauuuagcccagaagagguacucggaaugguacucaacuacuccaggagccucgcugaagauuuugccgaacagcccauaaaagacgcagucauaacaguacccgucuucuucaaccaagccgaaagacgagcgguacuccaagcagcaagaauggccggccucaagguccuucaacugaucaacgacaacacagcgacagcacucuccuacggaguauucagaagaaaagacauaaacaccacagcacagaacaucauguucuacgacaugggaagcggaaguacuguuugcacaauaguaaccuaccaaaugguaaagaccaaagaggcaggaaugcaaccacaacuucaaauacgaggggucggcuuugacaggacucuaggaggacuggagauggaacuccggcuucgagaacgccuagcaggacucuucaacgaacaacgaaagggccagagagccaaagacguacgagaaaauccacgagcaauggccaaacuccuaagagaagcgaaccgacucaaaacgguccuaagcgcaaacgcggaccacauggcccaaaucgaaggacuaauggacgacguugacuucaaagccaaaguaacacgaguagaguuugaagaacucugcgccgaccucuucgaacgagugccaggaccgguacaacaagcacuccagagcgcagaaaugucccuagacgaaaucgagcaagugauccuaguaggaggcgcaacccggguaccacgcguacaagaaguauuacugaaagcggugggaaaagaagaguuagggaaaaacauaaacgccgacgaagccgcagcaaugggagcaguauaccaagccgcggcccucagcaaagccuucaaaguaaaacccuucguagugcgggacgcagucguauacccaauacugguggaguuuaccagagaagucgaagaggaacccggcauccacagccuaaaacacaacaaaagaguccuguucuccaggaugggacccuacccacaacgcaaggugauaacauucaaccgauacagucacgacuuuaacuuccacauaaacuauggggaccugggcuuccuaggacccgaggaccuccgcgucuucggaucccaaaaccuaacaaccguaaaacucaaaggaguaggagacucuuucaaaaaguaccccgacuacgaaucaaaggggauaaaagcccacuuuaaccucgacgaaagugggguccucagccuggaccgcguagagucggucuucgaaacacucgucgaagacagugccgaagaagaaucaacccuaacgaaacuaggcaacacaauaucaagccucuucggaggaggcacaacaccugacgccaaagaaaacggaacagacaccguacaagaagaagaggaaagccccgcggagggaucaaaagacgaaccaggcgaacagguggaacucaaagaagaagcggaagccccagucgaggauggaagccaacccccaccacccgaaccgaaaggcgacgcaacaccggaaggcgaaaaggccaccgagaaagaaaacggggacaagucagaagcccaaaagccaagugaaaaagccgaagcaggcccagaaggaguagccccggccccagaaggagagaaaaagcagaaacccgccaggaaacgccgaaugguggaggagauaggcgucgaacucguaguacuggaucuaccagaccuccccgaagauaagcuagcacaaagcgugcaaaaacuccaggaccucacccugcgcgacuuagaaaaacaagagagagagaaagcagcaaacagccuggaggccuucaucuucgaaacacaagacaagcuguaccagcccgaauaccaagaagugagcacggaagaacaaagagaagagaucuccggcaagcuauccgcagccagcacguggcucgaagacgaaggaguaggggccacaacaguuaugcucaaagaaaaauuagcagaacuaagaaagcuaugccaaggacuauuuuucagaguggaagagagaaagaaauggccggaaaggcucagugcccucgacaaccuacucaaccauuccagcauguuccugaagggcgcaaggcuaauaccagaaauggaccaaauauucacagaaguagaaaugaccacucucgagaaaguaauaaacgagacaugggcguggaaaaacgcaacccucgcagaacaagcgaagcugccagccacggagaagccgguucuacucagcaaggauauagaagcaaagaugauggcacuagacagagaaguccaguaccuguuaaacaaagcaaaauucacaaaaccacgcccaaggccgaaagacaaaaacggaacacgagcagaaccaccacugaacgcgucagcuucagaccaaggagaaaaaguaauacccccagcagggcaaaccgaggacgcagaaccaaucagugaaccagagaaaguugagacgggaagcgaaccaggagacacggaacccuuagaauuaggaggcccaggcgcagaaccagaacaaaaagagcaaagcacuggccaaaagcguccccucaaaaacgacgagcuaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3490 - RNA, 2581 nt, Artificial Sequence
  mRNA product Design2 comprising derived and/or modified sequence from Homo sapiens__NP_005339.3 __HsHSP90AA1 (opt9)
ggggcgcugccuacggagguggcagccaucuccuucucggcaucaagcuuaccaugcccgaagagacgcaaacgcaagaucaaccgauggaggaggaagaaguggaaaccuucgcguuccaggcagaaaucgcgcaacugaugagccucauaaucaacacguuuuacagcaacaaagaaauauuccugcgcgagcuaauaagcaacagcagcgacgcacucgacaagauacguuacgaaucccuaacggacccgagcaaacuagacagcgggaaggaacuacacaucaaccucauccccaacaagcaggaccgaacccugaccauagucgacaccggaauagggaugacgaaagcagaccucaucaacaaccucggaacgaucgccaaaagcggcacgaaggcuuucauggaagcacuacaagcgggcgccgacauaaguaugauaggccaauucggaguaggauucuacagugccuaccuaguggcagagaaagucaccguaauaacaaaacacaacgacgacgaacaauacgccugggaaagcagcgccgggggcuccuuuacaguaagaacagacaccggagaaccaaugggccgcggaacaaaaguaauacuccaccuaaaagaggaccaaacagaauaccucgaggaaagacgaauaaaggagaucgucaaaaagcacagccaauucauaggauacccaauaacgcuauucguggaaaaagaacgagacaaagaagugucagacgacgaagcggaggaaaaagaggauaaggaagaagagaaagagaaagaagaaaaagaaagcgaagacaagccagaaaucgaggacguagggucggacgaagaggaggaaaagaaagacggcgauaagaaaaagaaaaagaaaaucaaagaaaaguacaucgaccaagaggagcuaaacaaaacaaaaccgaucuggacacgaaacccagacgacaucacgaacgaggaauacggcgaguucuacaaaucacucacaaacgacugggaagaccaucuagcaguaaagcacuucagcgucgaaggccaacuggaguucagagcucuccuguucguacccaggcgcgcccccuucgaccucuucgaaaacagaaagaagaaaaacaacauaaaauuauacguaagacgaguauucauaauggacaacugcgaagaacugaucccggaauaccucaauuucauccgcggagucguagacagcgaggaccuaccacuaaacauaagcagagagaugcuacagcagaguaaaauccuaaaaguaauacggaaaaaccuugucaaaaagugccuggagcuauucaccgaacuugcagaggacaaagaaaacuacaagaaguucuacgagcaguucagcaagaauauaaaacuaggcauacacgaagacucacagaaccgcaagaaacuaagcgaacuccugagauacuacaccagcgccagcggggacgagauggucagccuaaaagacuacugcacaagaaugaaagaaaaccaaaaacacaucuacuauaucacgggagaaacaaaagaccaggucgcgaacucagccuucgucgagcgacuccgcaaacacgggcucgaaguaaucuauaugauagagcccauugacgaguacugcguacagcaacuaaaagaguucgaaggaaaaacccucguaagcgucacgaaagaaggccuagaacugcccgaagacgaagaggagaaaaagaaacaagaagaaaagaaaacaaaauucgaaaaccugugcaaaaucaugaaagacauccuggagaagaaaguggagaaaguagucguaagcaaccgccuaguaacgagcccaugcugcauagucacaagcacauacggauggacggcgaacauggagcgaauaaugaaagcccaagcccugcgagacaacagcacaaugggauacauggcggccaaaaagcaccuagaaaucaaccccgaccacuccaucaucgaaacacucagacaaaaagccgaagccgacaaaaacgacaaaagcguaaaggaccuggugauacuccuuuacgaaaccgcccugcucucaagcggcuucucccuggaggacccacagacccacgcgaacagaaucuacagaaugauaaagcugggccuaggaauagacgaagacgacccaacagccgacgacacauccgcagccgucaccgaagaaaugccaccccuagaaggggacgacgacacaagcagaauggaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3491 - RNA, 721 nt, Artificial Sequence
  mRNA product Design2 comprising derived and/or modified sequence from Homo sapiens__NG_005218__HsHSP90AA3P (opt9)
ggggcgcugccuacggagguggcagccaucuccuucucggcaucaagcuuaccauggacucaucaaaacuagacuccggcaaaggccuacacauaaaccucguccccaacaaacaaaaccaaacccucaccaucguagacacacgcaucggcaugaccaaaaccgaccucaucaacaaccucggaaccgucaccaaauccggcacaaaagccuucauggaagcccuccaagcagacgcagacauauccaugaucggccacuucggaguaggcuucuacuccgccuaccucgucgccaaaaaagucaccgucaucucaaaacacaacaacgacgaacaauacaccugggaauccuccgcaggaggcagcuucaccguccgcaccgacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3492 - RNA, 2557 nt, Artificial Sequence
  mRNA product Design2 comprising derived and/or modified sequence from Homo sapiens__NP_031381.2__HsHSP90AB1 (opt9)
ggggcgcugccuacggagguggcagccaucuccuucucggcaucaagcuuaccaugcccgaggaaguacaccacggagaagaggaagucgaaaccuucgccuuccaagcggaaaucgcccaacuaaugagcuugauaauaaacacguucuacuccaacaaagagauauuccugcgggagcuaauaucgaacgccagcgacgcccuagacaagaucagguacgagucccucaccgaccccagcaaacuagacucgggcaaggaacugaaaaucgacauaaucccgaacccgcaagagcgcacccucacccuaguggacacgggaauaggcaugaccaaagcagaccucauaaacaaccucggcaccauagccaagagcggaaccaaggccuucauggaagcacugcaagcaggagcagacauaaguaugaucgggcaauuuggcguaggguucuacucagcguaccucgucgccgaaaaaguaguagucauaacgaaacacaacgacgacgagcaauacgcgugggagucaagcgcaggagggagcuucaccguacgggcagaccauggcgaacccauaggcagaggcaccaaaguaauccuccaccuaaaggaagaccaaacagaguaccuagaagaacggagaguaaaagaagucgucaagaaacacucccaauucauaggcuaucccaucacacuauaccucgagaaagaacgagaaaaagaaauauccgacgacgaagccgaagaagaaaaaggggaaaaagaagaggaagacaaagacgacgaagaaaagcccaaaauagaagacguuggcucggacgaggaggacgacagcggcaaagacaagaaaaagaaaacgaagaaaauaaaagagaaauacaucgaucaagaagaacucaacaaaaccaaaccgaucuggacacggaaccccgacgauaucacgcaagaggaguacggcgaguucuacaaaucacuaacgaacgacugggaagaccaccucgcggucaagcacuucaguguggaaggccaacuagaguuccgagcgcuauuguucaucccaagacgcgcacccuucgaccucuucgaaaacaaaaagaagaaaaauaacauaaaacuguacguacgacggguguucaucauggacagcugcgacgaauugauaccggaauaccugaacuucauccgaggagucguggacucagaagaccucccacuaaacaucucccgagaaaugcuucaacagagcaaaauccuaaaagugaucaggaaaaacaucguaaagaaaugcuuagaacuauucagcgaacuagcagaggacaaagaaaacuacaagaaauucuacgaagccuucagcaaaaacuugaaacuaggcauacacgaagacagcacgaaccgaaggcgcuuguccgaacuacuacgcuaccacacgucccagagcggcgacgagaugaccagccugagugaauacgugagccgcaugaaagaaacgcagaaaagcauauacuacauaacaggcgaaagcaaagaacaaguagcgaacagugccuuugucgaaagaguacgaaaacgcggauucgaggucguauacaugacggaaccaauagaugaguacugcguccaacaacuaaaagaguucgacgggaaaagccuagucaguguuacgaaagagggccucgaacuacccgaagacgaggaggagaaaaagaaaauggaagaaagcaaagcaaaauucgaaaaccugugcaagcucaugaaagaaauauuggacaagaaagucgaaaaaguaacgaucucgaaucgacucguaucaucccccugcugcauagucacgagcacauacggauggacagcgaauauggagcggaucaugaaggcacaagcccuacgcgacaacagcaccaugggcuacaugauggcgaagaaacaccucgagauaaacccagaccacccgaucguggagacgcuaagacagaaagcagaagccgacaaaaacgacaaagccguaaaagaccuaguaguacugcuauucgaaacagcccugcucagcagcggauucucacucgaagacccgcaaacccacagcaaccgaaucuaccgcaugaucaagcucggacucggcaucgacgaagacgaaguagccgccgaagaaccgaacgcagccgucccugacgagauaccgccccucgaaggcgacgaggacgcaagccgaauggaggaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3493 - RNA, 2794 nt, Artificial Sequence
  mRNA product Design2 comprising derived and/or modified sequence from Homo sapiens__NP_003290.1__HsHSP90B1 (opt9)
ggggcgcugccuacggagguggcagccaucuccuucucggcaucaagcuuaccaugcgagccuuauggguccucggacucugcugcgugcuacugaccuucggcagcguaagagcagacgacgaggucgacguagacggcacgguagaggaagaccucggcaaaucgcgagaaggcucacgcacagacgacgaaguaguccagcgagaagaagaagcgauacaacuugacgggcugaacgcgagccagauccgcgaacucagggagaaaagugaaaaauucgcauuucaggcagaaguuaacaggaugaugaagcuaaucauaaauucccuguacaaaaacaaagagaucuuccuacgggaacuaauaucaaacgccagcgacgcucuagacaaaaucagacuaauaagccuaacagacgaaaacgcacuaagcggaaacgaagaauugacagucaaaaucaagugcgacaaagagaaaaaccugcugcacgucaccgacacaggcgugggcaugacccgagaggaacucgucaaaaaccugggaacgauagcaaagucagggaccagcgaguuccucaacaaaaugacagaagcccaggaggacgggcagagcacgagcgaacugauagggcaauucggaguaggauucuacagcgcguuccugguagcggacaaagucauagucaccagcaaacacaacaacgauacccagcacaucugggagagcgacaguaacgaauuuagcguaaucgcagacccucgaggcaacacacuagggcgagggaccacaauaacacugguacuaaaggaagaagccagugacuaccucgagcuagauaccaucaagaaucucguaaagaaauacucacaauucaucaacuucccaaucuacgucuggagcagcaaaacagaaacgguugaagaaccuauggaggaagaggaagcggcaaaagaggaaaaggaagaaucagacgacgaggccgccguggaagaggaagaagaggaaaagaaaccaaaaacgaagaaaguggagaaaacaguaugggacugggaacugaugaacgacaucaagcccauauggcaaagaccaagcaaggaaguagaagaagacgaguacaaggcguucuacaaaaguuucuccaaggagucagacgaccccauggcauauauacacuucacggcagagggcgaagucacauucaagagcauacucuucgugcccaccucggcaccacgcggacuauucgaugaguacgggagcaagaaaagcgacuacauaaaacuauacgucaggaggguauucauaacggacgacuuccacgacaugaugcccaaguaccugaacuucgucaagggaguagucgauagcgaugaccuaccccugaacguaagcagggaaacccuacaacaacacaaacuucucaaaguaauccggaaaaagcucgugaggaagacccuagacaugauaaagaaaauagcggacgacaaauacaacgacacauucuggaaagaguucgggacaaacauaaaacuaggugugauagaggaccacagcaacaggacgagacuggccaaacuccuacgauuccaaucaagccaucaccccacagacaucacgagccuagaccaguacguagaaagaaugaaggaaaaacaggacaaaauuuacuucauggcaggguccagcagaaaagaggccgaaagcucccccuucgucgaaaggcugcucaagaaaggguaugaagucauauaccuaacagagccagucgaugaauacugcauacaggcacugccagaguuugacggcaagagauuccaaaacgucgcaaaagaaggagugaaauucgacgaaagugagaagaccaaagagagcagagaagccgucgagaaagaguucgaaccucuccucaacuggaugaaagacaaagcgcuaaaagacaagauagaaaaagcagucguaagccaacgacucacagaaagcccaugcgcgcuagucgccucgcaauacggauggucagggaacauggaaagaaucaugaaagcgcaagcguaccaaacugggaaagacauauccacgaacuacuacgccagccaaaagaaaacguucgaaaucaaccccaggcauccacugauaagggauaugcuacgcagaauaaaagaagacgaggacgacaaaacaguccucgaccucgcagucguccucuucgaaacggcaacccuuagaagcggcuaccugcugccagacaccaaagccuacggagacaggaucgagcgaaugcuacgacucucacuaaacauagacccggacgcaaaaguagaggaagaaccggaggaggagccagaagaaacagccgaagauacaacagaggacacggaacaagacgaagacgaagaaauggacguagguacagacgaggaagaagaaacagccaaagagagcacagcggagaaggacgagcuauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3494 - RNA, 2497 nt, Artificial Sequence
  mRNA product Design2 comprising derived and/or modified sequence from Homo sapiens__NP_057376.2__HsTRAP1 (opt9)
ggggcgcugccuacggagguggcagccaucuccuucucggcaucaagcuuaccauggcccgagaauuaagagcccuauuacucuggggacgucgucuccguccccuccuccgcgcaccagcccuagcagccguacccggcggcaaacccauucucugcccaagaagaaccacugcccagcuagggccccgacgaaaccccgcguggucgcuccaagcuggacgacucuucucaacccaaaccgcagaagacaaagaagaaccccuccacagcaucauaucuucaacagaauccguccaagguagcacauccaaacacgaguuccaagccgaaaccaagaaacuguuagauaucgucgcccgcucccucuacagcgaaaaagaagucuucauccgcgaacugaucucaaacgccagcgacgcccuagagaaacuacgccauaagcuagucucagacggccaagcacuacccgaaauggaaauucaccuccaaaccaacgccgaaaaaggcaccauaacaauccaagacaccggaaucggcaugacccaagaggaacucguaagcaaccucggcacuaucgcgcgcucagggucaaaagcauuccuagacgcuuuacaaaaccaggccgaggcuucauccaaaauaaucggccaauucggcguaggcuucuacucagccuucauggucgcggaucgcgucgaagucuacucccgcagcgcagccccagggagccuaggguaccaguggcucagcgacggcuccggcguauucgaaaucgccgaagccuccggagucagaacaggaaccaaaaucauaauucaccugaaaucugacugcaaagaguucagcuccgaagcacgcguucgagacguagucacaaaauacuccaacuucgucuccuucccacucuaccucaacggaagacgcaugaacacccuccaggccaucuggaugauggaccccaaggacguccgugaauggcaacacgaagaguucuaccgauacguggcacaagcccacgauaaaccacguuacacccuacacuacaaaaccgacgccccacucaacaucagaagcaucuuuuacguccccgacaugaaaccgucaauguucgacgucucccgugaacuaggauccuccgucgcacucuacucacgcaaaguccuaauccaaacuaaagccacagacauccuucccaaauggcuccgguucauacgcggcgucguggacucagaagacaucccccuaaaccucucccgcgaacuacuccaagaauccgcgcuaauccgaaaacuuagagacguacuacaacaacggcuaaucaaauucuucaucgaccagaguaagaaagacgccgaaaaauacgcuaaauucuucgaagacuacggacuauucaugcgagaaggcaucgucaccgccaccgaacaagaagucaaagaagauaucgcaaaacuccuacgcuacgagucuuccgcccuacccucaggacaacuuaccucacuaagcgaauacgccagccgcaugcgcgcgggcacacggaauauauacuaccuaugcgcacccaaccgacaucucgccgaacacagcccauacuaugaagccaugaagaagaaagacacugaaguccuauucugcuucgaacaauuugaugagcucacccuacuacaccuccgggaauuugacaaaaagaaacuaauauccgucgagaccgacaucgucguagaccacuacaaagaggaaaaauucgaggaccgcuccccagcagccgagugccuaagcgaaaaagaaaccgaagaacuaauggccuggaugcgcaacguucuaggcucaagaguaaccaacguaaaaguaacccuacgacucgacacccaccccgccaugguaaccguacucgaaaugggagcagcccgccacuuccuacgaaugcaacaacucgccaaaacacaggaggaacgagcccagcuccuacagccaacacucgaaaucaacccccgacacgcacucaucaagaaacucaaccaacuccgggcauccgaaccaggacucgcccagcuccuaguagaccagaucuaugaaaacgccaugaucgcugcaggccuagucgacgacccaagagcaaugguuggacgacuaaacgaacugcucgucaaagcccucgagcgccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3495 - RNA, 844 nt, Artificial Sequence
  mRNA product Design2 comprising derived and/or modified sequence from Homo sapiens__NP_000609.1__HsIGF1 (opt9)
ggggcgcugccuacggagguggcagccaucuccuucucggcaucaagcuuaccaugggcaaaaucuccucccuacccacccaacuauucaaaugcugcuucugcgacuuccuaaaagucaaaaugcacacaauguccucaucccacuuauucuaccucgcacucugccuccucacauucaccucauccgccaccgcaggccccgaaacccuaugcggcgccgaacucgucgacgcacuccaauucgucugcggcgaccgcggcuucuacuucaacaaacccacaggcuacggcuccuccucaagacgagcaccccaaaccggcaucguagacgaaugcuguuuccgaucaugcgaccuucgccgccucgaaauguacugcgcaccccucaaacccgccaaaucagcccgcuccguccgugcccaacgacacaccgacaugcccaaaacccaaaaagaaguccaccucaaaaacgccucccgcggcuccgcaggcaacaaaaacuaccgcauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3496 - RNA, 925 nt, Artificial Sequence
  mRNA product Design2 comprising derived and/or modified sequence from Homo sapiens__NP_000603.1__HsIGF2 (opt9)
ggggcgcugccuacggagguggcagccaucuccuucucggcaucaagcuuaccaugggaauccccaugggcaaaucaaugcucguccuccucaccuuccucgccuucgccuccugcugcauagccgccuaccgacccuccgaaacacucugcggcggagaacucgucgacacccuacaauucgucugcggcgaccgaggcuucuacuucucccgacccgccucacgaguaucccgccgcucccgcggcaucgucgaagaaugcugcuuccgcucaugcgaccucgcccuccucgaaaccuacugcgccaccccagccaaauccgaacgagacgucuccaccccacccacaguacuucccgacaacuuuccccgauaccccguaggcaaauucuuccaauacgacaccuggaaacaaucaacccaacgacuccgccguggccuccccgcccuacuccgcgcacgccgcggacacguccuagcaaaagaacucgaagccuuccgcgaagccaaacgacaccgcccccucaucgcccuccccacccaagaccccgcccacggaggcgccccacccgaaauggccuccaaccguaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3497 - RNA, 1021 nt, Artificial Sequence
  mRNA product Design2 comprising derived and/or modified sequence from Homo sapiens__NP_000591.1__HsIL6 (opt9)
ggggcgcugccuacggagguggcagccaucuccuucucggcaucaagcuuaccaugaacuccuucuccaccuccgccuucggccccgucgccuucucccucggccuccuccucguccuccccgccgccuuccccgcccccgucccccccggcgaagacuccaaagacgucgcugccccccaccgccaaccccuaaccuccuccgaacgcaucgacaaacaaauccgcuacauccuagacggcaucucugcacuccgaaaagaaaccugcaacaaaucuaacaugugcgaauccuccaaagaagcccuagccgaaaacaaccucaacuuacccaaaauggccgaaaaagacggcugcuuccaauccggcuucaacgaagaaaccugccucgucaaaaucaucaccggccuccucgaauucgaagucuaccucgaauaccuacaaaaccgauucgaauccucagaagaacaagcccgagccguccaaauguccaccaaaguccucauccaauuccuccaaaaaaaagccaaaaaccucgacgccaucaccacaccugacccaaccaccaacgccucacuccucacaaaacuccaagcccaaaaccaauggcuccaagacaugacaacacaccucauccuccgcuccuucaaagaauuccuucaauccucccucagagcccuccgccaaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3498 - RNA, 1663 nt, Artificial Sequence
  mRNA product Design2 comprising derived and/or modified sequence from Homo sapiens__NP_002183.1__HsINHBA (opt9)
ggggcgcugccuacggagguggcagccaucuccuucucggcaucaagcuuaccaugccccuacucuggcuacgcggcuuccuacuagcaagcugcuggaucauaguaagaagcucacccaccccaggaagcgaaggacacagcgccgcgccagacugcccaucaugcgcacucgccgcccuccccaaagacguacccaacagccagcccgaaaugguagaagcagugaaaaaacacauacuaaacaugcuccaccuaaaaaagcgacccgacguaacccaacccgucccaaaagcagcacuacuaaacgcaaucagaaaacuccacguagggaaagucggcgaaaacggauacguagaaaucgaagacgacauaggaaggcgcgccgaaaugaacgaacucauggaacaaacgucggaaauaaucacauucgcagaaucagguacggccagaaaaacccuacacuuugagaucagcaaagaagggagcgaccuaagcgucgucgaaagagcagaggucuggcuguuccucaaaguuccaaaagccaacagaacacgcacaaaaguaacaauacgccuauuccagcaacaaaaacacccacaaggcagccuagacaccggagaagaggccgaggaaguaggacuaaaaggagaacggagcgaacuacuacuaagcgaaaaagucguagacgcccgcaaaagcacauggcauguauuccccguaagcagcuccauacaacgacuccuagaccaaggcaaaucaucacucgacguaagaaucgcgugcgaacaaugccaagaaagcggagccagccuuguacuacugggcaagaaaaaaaaaaaagaagaggaaggcgaagggaaaaaaaaaggcggcggagaaggaggcgccggagcagacgaagaaaaagaacaaagccacagacccuuccuaaugcugcaagcacgacagagcgaagaccacccccaccgcagacgccgacgcggacucgaaugcgacggaaaaguaaacaucugcugcaagaaacaauucuucgucagcuucaaggacauaggauggaacgacuggauaauagcaccgagcggcuaccaugcaaacuacugcgaaggcgaaugcccaagccacaucgcaggcacaagcggaagcagccuaagcuuccacagcaccgucaucaaccacuacagaaugcgaggacacagcccauucgccaaccugaaaagcugcugcgucccgacgaaacuaagaccaaugagcaugcuauacuacgacgacggccaaaacauaauaaagaaagacauacaaaacaugauaguagaagagugcggcugcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3499 - RNA, 1606 nt, Artificial Sequence
  mRNA product Design2 comprising derived and/or modified sequence from Homo sapiens__NP_002184.2__HsINHBB (opt9)
ggggcgcugccuacggagguggcagccaucuccuucucggcaucaagcuuaccauggacggccuccccggccgagcacuaggcgccgcaugccuccuccuacucgcagccggauggcuuggccccgaagcauggggcuccccaacaccaccucccacccccgcagcaccacccccacccccaccacccggcucccccggcggcagccaggacacaugcaccucaugcggcggcuuccgacgccccgaagaacucggccgcgucgacggagacuuccucgaagccguaaaacgccacauccuuucccgccuccaaaugcgaggccgacccaacaucacucaugccguccccaaagccgccauggucaccgcccuacgcaaacuccacgccggcaaaguccgagaagacggccgcgucgaaaucccccaccucgacggccacgccagccccggcgccgacggccaagaacgaguuuccgaaaucaucuccuucgccgaaaccgacggccuugcauccagccgaguacgccucuacuucuucaucucaaacgaaggcaaccaaaaccucuucguaguacaagccucccuuuggcucuaucucaaacuccuacccuacguacuagaaaaaggcucucgccgcaaaguaagagucaaagucuacuuccaagaacaaggccacggcgaccgauggaacauggucgagaaacgcgucgaccuaaaacgcuccgguuggcacacauucccccucaccgaagcaauccaagcccucuucgaacgaggggaacgccgccucaaccuagauguccaaugcgacagcugccaagaacuagccgucguccccgucuucgucgaccccggcgaggaaucccaccgacccuucgucgucguccaagcacgacucggcgacucucgccacagaauacguaaacgaggacucgaaugcgacggccgcaccaaccucugcugcagacaacaauucuucaucgacuuccgccucauuggauggaacgacuggaucauagcacccacuggauacuacggcaacuacugcgaaggcuccugccccgcauaccucgcaggaguccccggaagcgcauccucuuuccacaccgcaguagugaaccaauaccgcaugcgcggccucaaccccggaaccgucaacagcugcugcauccccaccaaacuuuccaccaugagcaugcucuacuucgacgacgaauacaacaucguaaaacgagacguccccaacaugauaguagaagaaugcggaugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3500 - RNA, 3841 nt, Artificial Sequence
  mRNA product Design2 comprising derived and/or modified sequence from Homo sapiens__NP_000623.2__HsITGAM (opt9)
ggggcgcugccuacggagguggcagccaucuccuucucggcaucaagcuuaccauggcacuaaggguacuccuccucaccgcccucacacucugccacggauucaaccucgacacugaaaacgcaaugacauuccaagaaaacgcgcggggcuucggacaaucagugguccagcugcaagguagccgcgucgucgugggcgccccgcaagagaucguagcagccaaccagcgcggcucucuauaucaaugcgacuacucaacuggcaguugcgaacccaucagacuacaagucccagucgaagcugucaacaugagccuuggacuaucgcuagccgcaacaaccucgccuccucaacuccucgccugcggcccaaccguccaccagaccugcuccgagaauaccuacgucaaaggccucugcuuuuuguucggcucuaaccugcgccaacaaccgcaaaaauucccggaagcccugcgaggcugcccccaggaagacucagacauagcuuuccuaauugacggguccggcuccaucauaccccacgacuuccgucgaaugaaagaguucguaucaacuguaauggaacaacucaagaaaucuaaaacgcuguucucacucaugcaauacagcgaagaguucaggauccacuucaccuucaaagaguuccaaaacaacccaaacccacgcucgcucgucaagccaauaacccaacuccucggcagaacccauacagcuacaggcauccgaaaagucgucagagaacucuucaacaucaccaacggcgcccggaaaaaugccuucaaaauccuuguagucaucaccgacggugaaaaauucggcgauccucuuggauacgaagacguaauuccugaagccgacagagaaggagugauucgauacgucaucggagugggcgacgcauuccgcagugaaaagucccgacaagaacugaacaccaucgccuccaaaccuccccgagaccacguuuuccaaguaaacaacuucgaagcacucaagaccauccaaaaccaacugcgcgagaaaauauucgcaaucgaaggcacgcaaaccggguccaguucauccuucgaacacgaaaugucccaggaaggauuuuccgcagcgaucacuuccaacggacccuuacuauccacagucggcucguacgacugggccggcggcguauuccuauacaccagcaaagaaaaauccaccuucaucaacaugacccgggucgacagcgacaugaacgaugccuaccucggguaugcagccgcaauuauacuaaggaaccgcguucaaucccucguacugggagcaccccgcuaccagcacauaggccuaguggcuauguuccgucaaaacacaggcaugugggaauccaaugccaacguuaagggcacgcaaauaggagccuacuucggcgccucucuaugcuccguagacguagacuccaacggauccacagaccuaguacugaucggcgcaccccacuacuacgaacaaaccagaggcggacaagucucaguguguccacucccccgcggucgagcacgauggcaaugugaugccguccuauacggcgaacagggacaaccguggggccgcuuuggagcugcccucaccguccucggcgauguaaacggugacaaacucacugauguagccauaggcgcccccggagaagaggauaacagaggagccgucuaccuauuccacggcaccucaggaagcgggaucagcccaucccacucccaacgcauagcgggcucaaagcuaucgccucgccugcaguacuuuggccaaagccucuccggcggccaagaccucaccauggacggucuaguagaccucacaguaggagcccaaggacauguacuccuccuucgcucgcagcccguacucagaguaaaggccaucauggaauuuaauccaagagaagucgcccgaaacguauucgaaugcaacgaucaggugguuaaagguaaagaagccggugagguacgcguaugucuccacguacaaaaaucgacccgggacagacuucgcgaaggacaaauccaaucaguagucaccuacgaccucgcucuagacuccggucguccccauucacgagccguguucaacgaaaccaaaaacucuacaagacgccaaacucagguacucggcuugacacaaacuugugagaccuuaaaacuucagcugccaaacuguaucgaggaccccgucuccccaaucguacugcggcuuaacuucucucucgucggcacaccccuuuccgcguucgguaaccugagacccguccucgcagaagacgcccaacgacucuucaccgcacucuuccccuuugagaaaaacugcggcaacgacaacaucugccaagaugacuuaagcauuacauucucauuuaugagccuagacugucucguaguaggcggaccccgggaauuuaacgucacuguaaccgugcgcaacgacggugaagacuccuacaggacgcaagucacauucuucuucccccucgacuuaagcuaccguaaagucagcacccuucagaaccagcguucucaacgauccuggaggcuugcgugcgaaucagcuagcucaaccgaggucuccggcgcgcucaaauccaccucaugcuccaucaaccaccccaucuuccccgaaaacagcgaaguuaccuucaacauaaccuucgacguagacuccaaggcaucacuaggaaacaaacuccuccucaaggccaacguaaccuccgagaauaacaugccacgcacgaauaaaacagaguuccaauuggaacuccccguaaaauacgcgguauacauggucgucacuucucacggaguaucuaccaaauaccuaaacuuuacagccuccgaaaacacaagccgaguaaugcagcaucaauaccaagugucaaaccugggacaaagaucgcuaccuaucucacucgucuuccugguaccggucaggcuuaaccaaacggucauaugggaccgcccccaaguaaccuuuucagaaaaccucuccagcacaugccacaccaaagaaaggcucccaucacauagcgacuuccuagcagagcuccgcaaggcgcccgucguuaacugcuccauagcagugugccaacgcauccagugcgacauaccauucuuuggcauccaggaggaguucaacgcaacccucaagggaaaccucucuuucgacugguacauaaaaacuucccacaaucaccuccuaaucgucuccaccgcagaaauccucuucaacgacagcguauucacccuacuaccaggccagggagcguucguccggagccaaaccgaaaccaaaguggaaccauuugaaguacccaaccccuuaccccuaaucgucggguccucagucggcggccuacuacuucucgcuuuaaucaccgccgcccucuacaaacuaggcuuuuucaaaagacaauacaaagacaugauguccgaaggaggcccacccggggccgaaccgcaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3501 - RNA, 1786 nt, Artificial Sequence
  mRNA product Design2 comprising derived and/or modified sequence from Homo sapiens__NP_002415.1__HsMMP8 (opt9)
ggggcgcugccuacggagguggcagccaucuccuucucggcaucaagcuuaccauguucagccucaaaacgcuccccuuccuccuacuccuccacguccaaauaucuaaagccuuucccgucuccucuaaagaaaagaacacaaaaacaguacaagacuaccuggaaaaauucuaccaacucccauccaaccaauaccagucaacccgcaaaaacggcaccaacguaaucgucgaaaaacucaaagaaaugcaacgcuucuucggacucaacgucacugguaaaccaaacgaagaaacccucgacaugaugaaaaagccgagaugcggcguaccagacuccggcggcuuuaugcucacccccggaaacccgaaaugggaacgcaccaaccucaccuaccgcauacgaaacuacacaccccaacucucugaagccgaagucgaacgugccaucaaagacgccuucgaacucuggucaguagccuccccacucauuuucacacgaaucucccaaggugaagccgacaucaacaucgccuucuaccaacgagaccacggcgacaauucccccuuugacggcccaaacggaauacuagcccacgccuuccaacccggucaaggcaucggcggcgacgcccacuucgacgcagaagaaaccuggaccaauaccuccgcaaacuacaaccucuuccucgucgcagcccacgaauuuggacacucacucggccucgcacacucuagcgaccccggcgcccucauguaccccaacuacgccuuccgagaaaccuccaacuacucacucccgcaagacgacaucgauggaauccaagccaucuacggccucuccuccaacccaauccaacccacuggccccucaacccccaaacccugugacccaucccucacauucgacgccauuaccacccuccgcggggaaauccucuucuucaaagaucgcuacuucuggcgccgacacccccaacuacaacgcgucgaaaugaauuucaucucccucuucuggcccucccucccuaccggcauucaagccgccuacgaagacuucgaucgcgaccuuauuuuucucuuuaaaggcaaccaauacugggcccucucgggcuacgacauccuacaaggauaccccaaagacaucuccaacuacggauuccccucuuccguccaagcuauagacgccgccgucuucuaccgauccaagacauacuucuucgucaaugaccaauucuggcgauacgacaaccaacgacaguucauggaacccggguaccccaaauccauuuccggagccuucccaggcaucgaauccaaagucgacgccgucuuccagcaagaacacuucuuccacgucuucucaggcccccgcuacuacgccuucgaccuaaucgcccaacgcgucacccgcgucgcccgaggcaacaaauggcucaacugcagauacggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
